United States Patent 12,642,819 (COMPOSITIONS AND METHODS FOR TREATING INFLAMMATORY BOWEL DISEASE) - sequence listing, part 107

SEQ ID NO: 56 - DNA, 2262214 bp, Weissella sp.
  modified_base (983979)..(983988): a, c, t, g, unknown or other
  modified_base (1885430)..(1885529): a, c, t, g, unknown or other
tcagccagttcttccaattatttcgctccgttttgaagcggctcttcaattgctctgctgcatgctcactgaactcatacagctcaatacgcttaattcccatacttgctccttaatacccaccactaacccgtcatttctgacacacccaatattttagaaacgctgtacaacacgtctgccgttcgctgtgcgcccgtttgacgtattagcggctaatcggtcagctcgtgtccttctaagttctgacagcttctctgctgtccccttagccatatcttcaactgatgcatagccaagttctttagccatacgttgattttgctgatcaatctgttcaatggtcggcttactaggcccactttcgaatttcaaaggttgaccaaattttcctgtttgaccgcgcagacttctgtttttctcaaattccccaacttgttcagcagttgcaaggccgttagacaaccaaagctccactttcttcttcacatatgcacttgagtagccaccttcatttttggccgctcgaattgccagaattaaaatctttcgagcttcttgttcgctcggagcaaccctggcaatatcagtcaagaaataatagatgtcttcagccgtatatttgttcggctctatctcgttagcggtccactctcgcataatttgggggttgtttcgtgtaatcattgaaactaccttccgttccgtccgccgccgttcgtacacgcaaaatcccctatactatgaaagcgtatcttccggcggcggcttgatattctttaattattgatattcttatatattgatattcttagggtgtcggtttactacatgtagtaaatgcgacatgtggttaatgccctgatatcaacgttcaccaggtgtcgcatttgcgacatgtggtttttcgtgtacaatccgctcccattcaacgatttggcccttgttatttcgcaatggttggcgcgtcatgtacccatacttttccaagatattcatctgatttgaaacccaacgctcgttgtgacccaagtcctttgcaatgaccgaattgtgaaacacccagttatcagccattgatagcatgtacatcagtaaccgatacgggccatctttcaagcgcatgtctcgcaaagtctcattcggtatctggtaaacccattgggtcgcctttctcttttgatcatcatcaaactccttaatctgtttcttcgacatcaagccaagcttaacgagctggtcaccacgcaaataaattccttcaacgtgatatttagctgcaaagccaggccacccaatatcgtgagcttccttgtggtgaaccgcacacaatgcaatcaaacgatgttcccgatggtcagtttcagtacgattgtttcccattccaatcgtgtcgacgtggtgtatctgagctggctgtccgcagataacacaacttcgatgaatcagtgacatttccatgtaccgcgccaaatcatcatttagttcggcaccactcttactcattgggatatgatgtctgattgcaaattccaacaagaacgaaatgaactctctagccgtcgtcatgtcagtatctgagaagctgaagtagtcttctccagtctcggcaacccaataagacttcattaggtccttcacttcttccggagcatacccggtccacttcgcaatgtcattcatgattgcgtatgcttttttgcgttgtatcttgctaacttgccgttcatcagctaattgaagcaccgcttgtggtatttcattcgttgttgtcaaggatagactagcaagctcttgggcatcactaaccgtaaacgtcacgtttcgaccatttacattcgtaacccttccccacaagtccatctctcacctcttaaaacggtaaatcgtcttcgttaatatcaatctcgtcagctggtgcgccaactggcttgcctgtaaacggattaataccttggactttcgccggttgttgttgtgctgttggttgaccaccactagtgatcacaacctgtggtgctggtgtcgttgcacttttggcagcttcaacaattcgttcacttgctgaaatcatgtctagacgatattgttcaatcgtttgtgcagcactttcggaccacttgatgaatccatcaattttttcctctggaatgtcgctaatctcaaaatcaagcaccatatttgtgccaccagcatcattagttcgcgtcgttcccttagctgtcaccttaattaaagtacgggctgatagttgaccataattgttcatggcttcgttcagcaagtaagcgttaacacctcgtgacacgtaccaaactggttcagcaataccaatcgcttctccgtcaagattgacaatgtagccaacaaaaacctgctcttgcttcaacttattagcatctgcaccaagcttaacggccatctgcttcccagaatctgcaacgtgagtaatgccatcaaccgtcatcacatatggcgtgtcttctccagcaataacgtaattagatagcgtcttagtcgttgcgtccggtgtgtacttcagacgagtcattacaaagtgtgtaatgaattgaagcgacttgatgtctggtgcatctgaaagatttgaacctggctgcatgatgctgaacttcccgctgttaccgttaaaggcagtgaactgccctgggaacggtggcaattcagacgtcgttgtttggatgcgatcattgtttcgcaagcgctctgcaaatgtgtttgtcatgttttcactcctatacttcatatgcactgaatgagataccccactcattaaatgtcttatccaagaattgtttttgttcatctgtaagctcattgaacgtgtattgccaatttcgtagttgtggaccagctggttcaacaatttcgccggtatccttatcaactaaccgttcgccgaccttcatggcttcctcagcccgcttcttgcgtgcttcgtactcggcctgttccttagctttttgcgcttcgaacttagccttagcttgttgaacgtcacgttccatagtcgtcttcacttcatcaagtgtcttgaatttaagctggccgatatagcccgacacgcccactggatcaatgccaagttgttccgcatgagacgtgatttgttgggcctgaagctcaaacaactccgcttgctgctttaatacatcgaattgactgcgaacagcattttccgtctcattccacttagccgtcttattcaaccacttatcatcaaacacaatgttttcagctggcatgctgtactcagaagcaatctttttaatttcagacaatatcaactgcttacggctttgcttttctgcttcaatcacatcgtcaatttgtggcttcaatgtctcatcagacaccttttgaatcttcttctcaatttccttgatgcgtgtttccgtctctggccagttaccagcaacttgactcgcaatcttcttgcgggtatcaccaaggcctttgtacgccttatttaagtcagtgcgtgcttgcttagcctgcgctaacgtttcaggtgacacaggtgtcttcttgtacgtctcaagcatgccatcaacatacttgtccaggtcgtcaattcctggcacttctacaagtgccggcttaacgtttgcttgttgcaaagtcagttcattcataggtctgtatcctcgtattcatccatgtaatcgttaagtgcttcttcttcatcttttgggtcatcaggtggatcaattaatttatcgaacatatccagccacccagttcaaaacgtcagcaacgcccgtttcaaaatatgaaacagtcccgtcattgttatcccgttgttccgccttaaaggctcgattcatacgtttttgcgcttctaatcgcaattcgtttttcattacatacctccttgtggtattctggaggagtaaattttcctaaacagatttactccttttgacgcttaacggttgcagccgttaggcgtttttttcaccttccaaccactgttgatcaacaccatagaacacacttaatgcgtaccaagctagacgactcggtgtccgtactcctgtttcatactgcgacaatacgttaggtcgtacgccaatcgcatctcccacttgtgtttgggtaaatcctcgcttaagcctgatttcttttatccgattcatataattacctttctgggtcgcacaccccaagacacacaccaacatgttgttagggatacaaacagtaagagaaaaaatattacatgtaagtggttgatgtgcatctggcgatgtgcgacccatattcaatttttagcgacgtggcaatgcgtcagcgtcaccagtgatcaggtaatagattgttgggcccaatcgcttgaaccaaacaaacttaatcagctcaaacatgttgtaggcaacaatcatcaacgcaaacccgccgaacgccgcccaaagtgcaatgtataacatcgtcaatcctccatatacttgttcttagcttgtgtgttggtgtaagcctcaatctgcttcttgtatcgtggcttgaccggtgcatgtgctcctagcttgctgacgaagtacaacgcaacacctgcaatcgcaatccagctcaacaccaagccgattcccatcaataagttagtcatctgtatatttgcctccgtattgcacgtctgctaacccttcgtacacacgtccagtgtagaaagccgataagaaacctcgccaatcatctagcggtactgaccacacttcaccaaccttacgtactggccaatcaggacgactcccgtagaacttttgaatggtcaaccactgacgttgcatgtacagttcaatatcttcgcgcgtcataatctgtggccaaccattgcgttgatactcagccttgcgtgcttgctggtcttcagtcatttgaaacttagttgccatttttttctccttgttctttattgtcccaatcaatcttctttaattcgttcaaatctaaatctaacgcgatggccactttaaccatcgctggtaaagttaacctatttcgttttccgttcgttacgtcatataacgctgcgatagatacacccgttacatttgctaaccaatatcgggtcttattaccctttaattgcaagccattattaatcatttctgctagtgacatatacctaactctccgctttcttatctccgtttagtggtataattaaatatggaaacgtttttgaatccgattttccaaaggttcatttgctttccaaaaatttacacgaaagcaggtgtttgtatgacaaaccctattaagccaggtactgataatcaacggcctggccgttacactgaagtcggccctcgcggtggtaaagttcctggtggccgaaatgttgaaatcggtcgtggcgaccgactccccccaacccaaaagcctggtcgtggttgggaacataaataatcttgtagcacacgtctcttacacagatgtgtgctttttactttcctacacgctttccatcaatgtactcacgcttgcttaacgtaaatgaccagtgaaagatattcagttgaatccagctaacataatgaagtcgatcaccttcatcaagatatttcgtcatgtagtgctcaatcatctcctatacctccaataaagccttagtttcaccaagaaacttgttaatgaaatattgttgacccttgccggtcacctttggcgtcttagtagtcacattcacaccattagagttgatgtggttgtgttccttaatctcaaacaagccaagctccatgctcttctgtgttggcatgttccggtctgaaccttgtcgcttaaccagatagccattttcacggagataaccgaataaacggttctgccccatacctacgccgttttgcttaagcaactttgccaactcaccaataagaattgatgactgactagctgatactgcgtcagcaaacaaagccttgggcgtcatctctgcgatgatcttgtccttgtggtctaacatcagttgagctgacttcaaacccatcgccatttgaatacgtgggtctgccatcaatgccttgtgttctttctcaactgcgatgaagtagttacgtacttcagcacccttggcggttccgctcatcattgcgatgtgcttcgccatttcaaccgtcatgttgtaatcatctaacatacgaactgcaccgttgttcacaaccgtacttgcatgtccccttgtaaaatcgacgccctcttcaaacatctttgagttaatatcgaaccagcgagcaaacttatacttcgcttccaacgccttgtgcaattcacgagcgctaacccgttgctcaccttcttggtttgtttgaaccttaatcagttcgtttgtcatgtttatttctcctttaaatttcaataccgtaaatacgtgctgccgccttttgaatttgaatatcgcgtggacgtgttccagtcaatgctcgtgacaattgctgtggtgatacgtttagcatcttggcgacctccttatatggaataccagtcttgatattcgcaatatcaaacttctctttgacgttcttagccgcaagctccaattctgtcattgttatgctccttcctttttgttgattagttaatcaagttgttgacttatttttagactaggtctaatataaaggcatacaaaaaagcacaataaacgcctgtatatcaacattagctcgccaaagcattgattattttaggtctgttttttgttgctcaattacttgatgaattaaatataagcctaagtctaaaattttgcaagcgtttatttagacttagactaatttttattcatcatattcaggagaaacccttgatatgacagtattggaacgaataaaagaagtttctaaactcagaggatataaccttactaaggttaatgaaatggctcatctgggtaagaacaccatatattcttggaaaaccaaagagcctagtcacaataatgtgcaagccgtggcagacgtgctaggcgtatcagtagactacctattaggtaacactgatgagatgcaccctaccagcgcagaaccagaagtgcccaatgatttagaggaagttttgaagcaggttaaccctgtaatgtttggaggtgctgaactaacagacgaccaaaagatgcttctatataacatggctaaagaaatgtcacgcaacaatcaacaaggtggtaagtagtttgaacgatgaattgagtgagttaagagactacctacttaaccttgcccaccgacacgatattgacgttgaggatatgctatccactacaggtacacatatgtacgtccgcgtgttcaacaagatatttatgaatccgaatgaaacgaaggcaacttatgaatttggactagctcacgaactggcccatgccatttatggagatcctaatggtgaacagtactaccctttttcattgttgttcagaaagactgaagaaaagattgccaacaagaacgcgatccgactgatttctgactttgtctatcgcgatacgccacttgaatgcagaaattgggaacactttattgatattttcaacctacccagttattttgaaggcattgtaaaggaagttatttacgactgatgaaacgtccagacaggaacgacgttaaaagctttggggagtaatattatgcacaagttatttaagctagcttctgtagcgcttgtttcagcttcactagctggtacagcattggaagcagtcaatatcgttttggatgccggaactgttagcgcagccaagaagaaggcaaaaaaactaacatctggcaagaccgttaaactcactgacattaatctcaaaatcacaaaatgggccgtcattccagttggggcaactggtaatgaatatggcgacaagcctgttattgcattttggtatgacgtaaaaaataagaccggcaaggacatagacccaatttcagcttggcttgctgcctttaacgcatatcaagatacaagcaagacacaagtaaatgaattagatgttgcgtcattaccagaccaacaattcttagattctcaaaccgagagcattaagaaaggcgcaacggctaagaatgctattgcgtactcattagatgatgaaactacacctgttgtattgaaagctactaagggatacgacggaaagttacttgctaagcaaactattaagattcaggatgcgttagaaaaagcgaaagctagctcaacagctgacccaaacgcacctgtacagtaattaaacaaacgaaccccgcctggttagcggggatacataaaaaagccacccgttaaggtggcgtacatacgtccagatgggaacgacgttaaaagcttaaggagaatgttactaatgctcaaagattttgattacagttctttgataagctttgcactggggttatctgtttcattggtagtacatttttggcaggatttttctgctaaacggcgttttaagaagttcaaagaaatgatcaaaacagaatatatgaataatttgttcgacgcaccaaacaaaccaattgccgataaattgattcttgaaaacacaaaaaaacttgaatatttaaaaaaatcagaaatatcatttttaacttcgaaattgcaattagaatatatacgctatatcgagttttgtttaatggtttataaaaatactaatacccttattgagagctatgcctttcgtgatccttcttttgtctatcaagataacgaccatgaaaacgaaatattcaaaaaagatttagagtggttttgcagaatttttgaagaacgcagcattgattacgtgaaattaaaaactgatcacttcataactaatacagaattagaagaattaaaatcagagcttacagatccccaatcgattgagtgaggcgtgaaaggatttaatatgagcaacgatgtatgggaagacttaaattatattattccaaaccattaaaaaacacgcacaccccccgccgccaagctagaagtgtgcgtatcagataaaacagaacatcactgccctatttacgtatttaattgtaccagacccgggtatgtctttaaactgcctaaattttttatgtaaaggttaggtttaacttatcatggcaagtataactagacgcggcaacaagtggcgcgctcgtgcatcttatgttgatgcaggcggcaatcgtcagcaacctagcaaaacgtttgataccaaacgagaagccacagaatgggctgccaaactagaaactcaaattatcgacggtgctgatatcaacgctgcgaaaatgaagttttcagaatactaccgaacatgggtagcaacttataaagaaccaaccgttcgtacatctacgctggtgaagtatcatagtttcaccaacgagttagacaagcttattggtgatgtgcagctagataagctgacggcgttatatctgcaaaataaaatcaacgagtttggcgaatcacacaccaaagcttacgttaacaatattgtatccactatcaaggcttcactaaaagatgcacaaattaacggcatcataaagaaagatatttacagtcgtctcaaagcaaacggtggcgcctcaaaagaggatgataactatttaagcgctagcgattttgaaaaactgcaatcttggctatatgatcatacagacctgatgattgaagacaagttctactttgctgtccttatcgccctcgagaccggtgcacgagttggcgagatactcgcactaacggtagatgacttcaatttttcaaacaacaccatgaccatcaacaaggcgtactccaaagcaactgcgtctaataccgaaactaagacgcgctccggtaatcgaacaattgacgtgactgacaatctattggctttggtaaatgaactagaagaaggcggtgtcctgttccctaagaaatggtttagagacgtattttcggagcgtatgaagcagcttgccgaagaagttggcttcccagccatacgcttccatggtctaagacactctcatgtatcttacctgctacacaacggtgttgatgttgcgtacatttcaaaacgagttggtcactctaatgtaaacgttacgcttaaaacctacgctcacatgcttaaggaaaaagaagcagagcaatctagtcgcactataaatttgctacaaaaaaacgccgttcataagctccagtgaccaaaagtgaccaaaacgcttataaacagcggttttataacgctaaaattacttagcgatgatttgcttgtactcttcacgagtaacaactgatacttggcgacggtcacggcccaaacgaccgaactttacgacaccatcagtcaaagcgtacaacgtgtcatcgtttccacgaccaacgtttacacctgggtagatgtgcgtaccgcgttgacggtaaatgattgatccagccttgatgtcttgaccatcagcacgcttcgttcctagacgacgacctgctgagtcacgaccgttggcagaagatccgcctcccttgtggtgggcaagcatcgtcaagttgttcaaattcaattgcatgatttaaatcctcttctttccgatgtcttaggcaatagagtcgatgacaaccttagtgtatggttgacggtgaccttgcttcttgtgtgagtgcttctttggcttgtacttgaaagtaacaaccttcttttccttaccttgcttctcaacagtacctgatacagtaacaccttcaacgtaaggtgcaccgatcttgccgtcagcgaagacaaccttgtcgaatacgaccttgtctccttcagcggcgtccatcttttcgacgtagattacgtcaccggcagaaaccttgtattgctttccgccgttctcaatgattgcatatgctgccatgagtttgcagacctccataaaatatttttctaaaaaaacttagactcaccgagtccgcgagttccaaggaactacttaatacagaccacgagtggttgcagtttgtggattccacaaacacaacgtagataattataaaacaagttctaactaaatacaataaaatcccccacaaatgtggaggacttctaagtttttcatgcagctggtgggactcgaacccacaaccgctcgggtagaaaccgagtgcactatccagttgtgctacagctgcaaaaaaagatgagttggcataacttaccaactcatctattgtacgtttaaaacgctggtgaatcaaggtcagaagcgtccaaaaccgcacgaacttcttgatcaatatcatcctgtgtcaatttaagttcgactaggccgagtttcaaaaatgaccgccaggcatgtgaaaaatcagcttggcgcttttggtgataagaatttagcaacatcgtcttaataccaataaattggtgggccaaacgcatttgtgggaagcgtgaaaacttagccaagtcctcatcctcaagcaccatcaagtgcgtccattgctgcttcaaactaatcaacaagaattgggcgaaggcagtcgcatacaacgccttcacttcagcattgcttgtcatcactgcattgtgtggcacatcattgttgattgcttcaacgcgtaacatcaaggtactcaatgacacgtctagattcaaataatcattcaacaagacatccttaggcccgattgggttttcccaatcagccacaactgcgcgatatgactcacgtgcttcacgcaagtaacctgcaatatccatcgtcattattccgcctcgtctgacgcttgtggttgcaacacctcaacttgtggcgccgcagaagttgaggcctcaggctctgtttcaactggtgtaccatatgaaatcagaccttcacgttgcaacccaaagacaagctcatcactctcaattgccaagtaacgacgttccgtcaaataccaagccccgatgaagtcataatccaacaagacatctaaccatgaaatggcatcacgaccatcaatgacttggaagtgccaacgttgggcaccgattgccgtggcatcgttaacgtagaagatacggacttcaacgccattctccaacatcaagccagcaccatttggaatgctttgcaagaagtagtctgaatcagctgacagaacaaacaaacgatccaacatacccgctggcatttcagtttgtaccaatggatacaagaaatcatcgcgcgtttcaagaatgttgtagtccacttgataaccgaactcgcgctccatgtaacgaccgaactccgtcaacaacgtagccaacgtacgaatgcgcgctgctgttgtcttcttacggaagttttcaaccatcaaatcagtgatagcttcggcgttaaacaaaatttgcttacgctcaagtgaccagtaaaatagacgcgcctcagtacccaactcaacaaagtaagcaccaccgttgttatcgtcgttcacaacgaattcaaaggttgctggcacatccaaatcagtcatcaccaacgtcaactcttcacgctcagctggcgtcaaaatatcataggctggcatccccgcaaatgaaaggaaacgatccatcgccatcaagtaccagtctgccttcgcatattgacgtggtactgtcacccattctgtatcaaggtgcgcattcgttaggcgttgtgccaacatgtggaccttctttggatcatttgtttcagcaagctcacgaacttgcgctaaggtttgttgaatttgaccaatatcatcggtcaacaaatcaacgtatgaaacagcgcgttcacgtaggtgttctgtcatgcttattcacctccctgttcggctaccaatgatgagacatagtccacatacaatgagccgaccgcgttttggaaatcagcaaatgagccaaatgcatcgttaattgcacgttgctcataaatcaaaatcgtatcttcctttgagtagttcaagatttgggcattgttctcagcaatcaaatcaggaaccgctgccgccttagcatcagccgcgtccaattgggccaaacgcgcacgcaaaacttcgcgttgctctgcttgggcactcttgttgaacaaaccgctgcgctcttccgtggcagccaattgcgccatcaattgcgtacgctcagcatcacgtgcattttggtcgtttacaaccttttgcaaggcttcgttggcacgcgttgtatcttcaatgacttgggcgttgaaacgttgacctgactcagctagttcaaccgcacgagccaacttttcgtattcttcatcattaaaaatgaacttaactgacaatgggtccaagataccgaagtgacgacggtcccaccagtttccaaagaacaattggaagacaccaagttgtgactcctcatagtaaaagaacgggaacttttctgataggtaagcaataagcttttgtcccaagtggtggctcaactcatcttgcatatcatcaaccaaaactgacaacacgcggtttgactcggcttgtggtgcctggcgaatttgcatgttgtacttttggctatctagtaattcataaacacggcgatcgttcccttctgccacggcagtttgaatatcaccaatgtagtttagttttgcttgtaattttccatttaatacggattgatttgacggtaagtccgtcgtcaagtatggcgtgttctccatctcaacccctcctgtttgtggttgcaatcttacttctcaacttattatatctacctaatatatatatcatacaacctaaacttaaagaaaaacgccgaccatggactggacgacgttgtttttaagaagtttttacgaaattttagtattgctccaaataagtttccaattcccattgtgaaacttcttggcgatatgcttggtattccaaacgcttagcatccacaaacgtgcgtgccatgtgtgaaccaagggcttccttgataactgaatctgtgtccaagtcgttaacagctgccaacaacgtatcaggcaaatcagtgatgccagccttcttacgctcagcttcatccatcaagtagatgttacgatcaaccgcgtggtttggctccatttcgccggcaacaccatccaaaccagctgccaagataacagcgaaggccaagtatgggttagcagttgggtcaactgaacgcaattccaaacgtgttgagttaccacgtgaagctgggacgcggaccattggtgaacggtttgaaccagaccaagccacgtaaaccggtgcttcgaatccaggcgtcaaacgcttgtatgagttgaccgttgggttcgtgatagccgtgaagttagctgcgtgagccaagacaccacccaagaagttgtaggccgtctttgacaattgcaaatcaccagcttcatcgtagaagacgttaccatcttcattgaacaatgacatgttcgtgtgcataccgttaccgttgataccagaaattggctttggcataaacgttgcgtacaaaccgtgcttacgtgcaatcgtcttaacaatcaacttaaacgtttgaatgttgtcggctgcatccaatgcatcagcgtacttaaagtcaacttcgtgttgtccaggcgcaacttcgtggtgggccgcttccacttcaaagcccatcttttccatttccaagacaatttcacgacgtgtgttttcacccaaatcaagtggggccaaatcaaagtagccacccttgtcgtttaggttcatcgttgggttaccgtgctcatcaagcttgaacaagaagaattctggctcagttccaatgttaaagttcttgaaaccagcgtcttccatttgcttcaaaacacgcttcaagttgttacgaggatccccagcaaatggctcgcggtcggccgtgtaaatatctgcaatcaaacgtgcaaccttaccaccgtgtgaatcagtcgcccatgggaaaatcatgaacgttgatagatcagggtacaagtacatatctgattcttcaatacgaacaaatccttcgattgaagaaccgtcaaacatcaaattgttgtccaataccttttcaagttgtgaaacaggtacttcgacgttcttaattgtgccgaaaacatctgagaactgcaaacgtaggaattccacgttttcctcagcaatcattgtgcgaatatcatccttggtgtaagccttgcgaaccattgtaatctccttttactttatcccaaaacacatcatctaaaacttccgttgaccgttattaaaacgaccaatcttaagcaactcatcagccaacatgtgacgcatattaatttcatccggattaactttttctgcttcacgacgttgctttttagcatcaacctcgtgaatttcagaaatcgaataaccggcatctagataatctgctatttccaataagcgatcgacgtcatctaaagaaaaacgacgctgcttaccggcccctctatgtggctcaatgagtccctgctgatcatagtaccgaatctgacgatctgataagcccgtcaattcgcgcactacactcattggcaatactgccaaatcgcggcgtaactctcgtcttaccatacgtccgaccccctatgaatagcatattaccacctattttagaagattattctgttcatgtcagctattctgacacgaagttttggacagccgcttcgattgtgtttagttccgtagtattttgcaccaaatcataccaatgaatgtccgtgaactgattattgaaccaggtcatttgacgctttgcataacgacgtgaagcctgcttcaaagcctcgctcgcttgttcaagcgtttcaacgttctctaagtaaccaaacaattccttatagccaatcgcttttttcgccgtactgtcttctggtaatgtcgccgcaatctgagcttcttccagcaggccgttcgcaatcatcgcatcaacacgcgtattaatacgttcatacaaaactggtcgatcggttgttaaaccgatgatgtaggcgtcatataaacgctttggttccggctgttgctcagaaaacggcttgccagtgtggtcactaactaatagcgctctgaccaaacgacgaatttgtcctggcaggatacgagcctcactgactggatccagttcgcgtaaggcatcacgaaccaccgattcgccttgttcatgggcaatcgtcgtccacttctcaacaaatgcctcgtccgtaatgtcatccacatcagctaacggacggtcgcccaacaaagcttgaacataaaacccggttccaccaaccaaaattggcagtttcccgcgtgatgcaatatctgcaattgctgcctgcgcctcgcgcacaaatcgcgcagctgaatagtgttctgcggggtcagcaatatcaatcatatggtgcggtgcaaccgcctgctcctcgggggtagccttcgctgtcccgatatttagttgccgataaatttgcatcgaatctcccgatacaatttcgccgttaaatttcttcgctagttctagtgataaagcggtttttccaaccgcggttggaccgacaatcacaattaacttatccatactattttccatctctatctctaatttgttgggccaaacgcacatcatctgtaatcacaccggcaacgcgcgccatgaacatcatcttcaatacccaagctttcgttggtgtccaccaataagtcaccacttcccgggcacgcgcgaagataaacggtaaataccgatagtccaaattattattttgaatcacgccggcctgaaacagttgtcgactcaaccggttaggtcgatgttgcaacaaccctaatggtatcgtcttatccagtcggcgccaggtttcaagtgcgttgacttgaaatgattgcaacatcactggcgcatcaacttgggcagcctgtaattcacggtacaattgcgctgcaccctgtttacccttcagctcaatcaataacaaaccgtggtagttggtctctttcaccaacgctaagaatgatgcaaaatcatcaacaaccggtggcatatacgcatcaatattatgttttaagattaagcgcccctcgtgcaactgcacatcaacctctaaaccatctgcacccaattgtattgcagatgcaaaggccggtagtgaattttcaagttgtccagccgtgtgatcaccccggtgggcaataattaacggtttgttcatctgcatttcaaagaaccccagttattaaactcatataaaatatgttaaacttatcttaacaaatatatggaggaaccacatcatgaagaagtttggtttggggattttgactggtgttgctggtacgctagcaactgctgccgctgcagccttcacgttccacaaggttgctgttaagcctttggaagaagaagaggctaagtttgagcagacagagcgtaaggccgctcgtaaggctgctcactctcacggcgcacgtttctaatcgaatataaaaaacaaatacccacttacatggttcggcgtacaaacgtcagttcatgtaagtgggtattttttagttgctcttagtcttaccagtgtaagaaccaaaaccattcttcaagacgtagatatcgttgtatcccgccttcttcaacttacgcgccatacgcgcagccatttgcatgttttcgtcatacaaaaagactggcttgtcttgacgcaaagcactgtggttctcattcaacatagcgtattgaatgttacgtgcaccaagcacgtgctttgccttaaacttagctggctcacgcaaatcgatcaattggtgaccacgactttgtgcttcaaattcttcagagttcaaaagtgatgccgcacgcttcaatgttacgcgcgtccataccaatgtaccaaccgtccaaagaatccaaagcaacacaatgacaaacaatgcttgcaacatactactaaattccccatttcgtttttcagtcaagtactattctatcaaacctaaaataaaaagtctgccaaccttaggcagactttgatttttcttcaattattgagcttcagcaacaaacgtaccagtggcagcgttgtaaccgaaaccaacacgtgagtatgaacccaatacccaacgcgtgtgtgggtgtgaaccgttgtcaatcataccagtttcagcgtaccaagcgttaacggcatctgaaccagcaccgaagccgatagcaacaacttcgtgaccgtatgattgtgcaaagtgtgcagcatcaacgtttccagccatcatgtctgcacggtattgtgcagttgctgacaatgaagcatcgtatgaaactggtgacaaaccagcagccgtacggattgcgttcaaagcgttaacggcgtcagcgaatgaaccagttgaaactggtgcacttgcaactgacgtttgtgcaggcgctgcagaagcaactgatgctgatgaagcagccgttgaagttgaagcttgtgatgcagctgaagcatttgattgtgcaggtgcaactgaaccgttcaagcgaatctcttcaccaacgataatcaagttagggttcgtgatgttgttcatcttaacgatgtcatcaaccttcaagcccgttgcttgtgcgatcgtgtcaatcgtatcaccatcttgaatcttgtaagtcgtaccagcagtcttaacggcttccttaacgtcgtcaaccgtcttagcacgccatgaagtagcatccgtagctggctttgcgttatcatcggctgatacagcagtgtttgagttcgtcattggcaaaattgcagcagctgcaaccaaagcggcagctcccattcccttagccatagcattcatcttagagttaatcatattgtttataatccctttttgtacgtttttagccagtccaacgactgagcctcgtatggtttctatcataacaattgcgtatatcaagtaagttacatcacgataacaaaaaaatgggacattgatgacaatgtcccataggcaatacattttaaattagtgaatgaacaatacgcctgctgcagggatagtacgtgatgaaaccacgaattcacccttagcgttcatttctgagattgtgatcatgtcaccgttaacaccagtaactacggcaacgtgaccgtatgatgaagcgtatgcaacacctggcatcataactgcaaccgcaccaacagctgggttcgtgtctacaacacggccagcgtacgttgcgttgttagcccattctgcggcgttaccccagaagttaccaacccatggcaattgattcttaacgtaccacgtgcattgaccagcgtagtatgagttaccaggtactgccgtgtaatcagcgctgtatgatggtgctgctggttgttgtacttcttgtgcaactggtgcttctgaaacagcaacttcttgcgtagcaacaggtgcggccacttctgcaacaactggtgccacttcaactgcagcttcttgtgcaactggtgcttctgaaacaacttcttctgcaactttcttagtcaagttgatttcttgaccaataacgataaagttagcgtctgaaatgttgttagctgaagcgatttcttcagtcgtaagttcagtagcagatgcgattgttgacaacgtatctccagcttgaaccgtgtacttttgtcctgcggcttgaacggcttcaaccacttggtcaaccgtctttgcacgccatgatgaagtcgtttgtgcaacttcttcgttagcgtatgctgattcagttgagatcattggtgcaacagctgcggctgcagcaacaacagctgcggctacccagttcttacctgacttgtacatcttcttgcgtgaatttacgttttgcatgattaattcccctaataaatattgctcgtgtaaagcgtttgtttctaatagttataaaacttgatttgtttttgttatgcgttgccttaacaacatgattaatcataccgacggcgcgtaacagttatataacagcgtctgaacaacatgtaacgcacaaaatggtcacatttaaacaccgaacgaaacccgtcatttaggctcatcagttctcgtgttcacaattagttcaaaaacagtccctactctgaaaataacttttttcgtgttttcattacttttcaggccgtttattacaaacattacatcgttttctgggaattttgttacagttcaatgcaatttgcggtgtgtgtcacacaaacaaccacaacaaaaaagacgagaaccatcactgattctcgtctttattttacttatttaattaggcaatcacgcggtctgagttacgggccaatgaagcagcaccgtaagcaccagcatcgttacccaactcagccaacttaacttcagtcacgtcacgcgttgacttgaaggcaaattgcttaaagttcttctcaacacgatccaacaagaactttcctgcggctgaaacaccaccaccgataacaacagaagatgggttcaagatgtttgagatgttagctgaagccaatccaaggtagtaagcaaccttgtctacaacttcgtttgccaagtagtcgccttccttggccaagtcaaagacaatctttgacgttacttcttcaccgttgtcgaccatagccttcaactttgagttaccaacgtaggcttctgcaaagtcttgggccaagtgaacaacaccagtagctgaagcgtattgctccaagcaaccgtagttaccgcatgtgcacaagtatccaccaggctcgacgatcatgtgaccgacctcaccaccagctcctgcaacaccgtggatcaacttaccatcgttaatcaatccaccaccaacaccagttcccaacgtaatgaaggcaacatctggttggttgtttccggcaccacgccattgctcacccaatgcggcagcgttagcgtcgttgtccatcgtcaatggcaaaccagttccagcttcgatttgctcacgaacgttttgcgtttccttccagttcaagttgaaggcacccttaacagtaccgttctcaagatcaaccgttcctggcgtacccattccgataccaatgatgcgatccttgtccaattggtacaagtccaagtggtggttaattgaatcaatgatgtcaggcacgatgtgtgacccttcatccaaaatgtttgtacggattgaccacttttgttggatttctccttcggcagtcaaaatggcgaacttgatagtcgtaccaccaaggtcaacaccaattagcttatctttagccatgatttttcctcgtcattctcacaaaaatattttgtaatcgctttcttatctttcaacattatttattataacgaatttctgaattaaaacaagtgttttattgaaaacgttttcaatactattatagcagtctttcttgcttctcttctaactcgtgctcatgtcgtaagaccagcttgatttgcgcatattcctttgcatcaagtagaccagccttatacatattatcgatttcaattgccgctaactcaatatccaataggcgctttccaacgtgaatgtagatatcatatttcttcaacaagtttaggacatctaaaaatgtttgcatatctatctcctattttcgtaacagtgcaataccaaccaaagcggcaatcaacacaacatacatcaacaacgctaatgctcgtcgaccgccaccgattttgaacaagcctgaatagtggaagcctgaaatgaacactggcacaatcaagaaaccgccaatcaagccaccaatatgggctgccagatcaattcctggtgtaaacagtgctgaaatgactgacaacagcacaaatgccgtcatcaattttgcctgactacgccaatatgctctacgtttgtccatcaaccccagcctaacaatggcgccgaatagaccgaacacaccaccagacgcaccggctgaaataacattcatcgcacccaatgctaaactcatcaaattcccactgataaccgttgtgaggaaaagaatcagaaaacgccaaggcccaatttctaactctaataatcggccaataaaatacaacgtaatcatattaaagattaggtgtgacgcggtaacgtgcaaaaagcctgccgtcagcaaacgccaccattcgccataatggagaacaattggtccaaattgcgcacctgtttcatacaaaacacgtgaactgatggtaaaactctgcgcaatcaaagcttcccataggtacaccacgaccataaacgccactagggcgctggtcgctggtgtcgctttaaaggcgcgtttaaattctgctatcatacttttcttccttaaacaggtggcaaaacaattaccttatctacctgttgatctgttttttcaatttcccaatttggggtcgtcacgtaattatctggaatcgtcacggcaatttttgcaccagtcgtctttggtaaccaacgatcatagtagccgccaccgaagcctagccgatcgcctgctgctgaaaaggctaacccaggcaccaagataaaatcaagtgtcgccacatccccaagcggttcaccaattggttctagcataccaaatctgtggcgttcatacttggttgactcatcaatctgaataaattcaagctgtcgttgtggcgctacttttggcaaatacacttttttaccttgcaataacgctgtctgaattaaaagctgcgtaggcaactcaacatcttgtgacaacgttaaggcgactgaagatgcttcctgccaagctggcaatgctgtcactgtacttgttatttgttgcatcaacgtcgcgcgttgcatatcagacagcttcgccaaatgactcttagctatctcacgagcttcattcttatccatcagacagtcaccctctctctaacaaaaaactgacacctagtaataggtatcagtttagcatagttactttgttgctgaaccagaatcttgcacgtccttccagaacgcttcgtagatttggattgcaatttgttggttaacgttttcgtctgattcgtaaaccgatggcacaacaatggccacggcaacatcagagttaggcacgaatgaaatcaatgaactggtatatgttgaaacaccgttagtcgttgtttcggccgttccagtcttagcgtagataccaggttgaacattcttcatacgcgttccagttgcataaccagaactactgtgaacaacttcttccatacccttccaaatcaagttacgctctgcttcagtccagccgaccgttcccaacacttctgttggcacagttgtttgcgtcttaacgcggttcgcttcatcacgttgttcaatagaagcaacaatgtgtggacgaacacggtaaccaccgttagcaacagttgcggcgtattgggcaagttgcatcgtcgtaaacgtgtcgtactgtccaaatgattcgtccagcgccttaccaatgtcttcacgggtcgttgaacccttcacaccagtaatttcacctggcaaatcaataccagtcttaacacctagaccgaaacgagcaatcccatcacgcattgtttggaacacactggttggcaaagctcccaagctcatacctgggaagtagttcaagccacccatcttcaacatcaattgcataacgtacgagttagatgacaccatcaaggccgtgtcagcagtcaaaggcatgctaccacttccgttacggttaaaccatgatgacttcgttgccgtaccagcaaccgtaatcggttggtcggtaatggtattattttcggccgtaatcgtaccgttcaagaatccggttgtaatcatcgctggcttaacaacagatcccacaacgttcgcttggttaacagtcgaaagggcatccggcgtcgtcttacccgtttcgttatcacggttaacacctgccgttgcgtaaacaccacccgtctttgggttgataacaacggcatacgcaccagttgtcatcccccctggaatgttgttctccaagatgctttgcacatcattttggaactttgaattaatggtcaacgtcaaactatcaccagcttgaccggcgtacgtcgtcttttcagtcgtcttgccgtccttgtcggtggtaacctcaacttgacccttcgttccctttagcgcgtcttcgtattgcttttctagatatgacgttccgacgatatcgtcacgtgaatacccttccgttagcaacttgttgacactatcttctggcaatccagacttagaagttgacgttgaaccaaccaacgccttgattgaatcaccttgtggatagtcacgcgtgtagtaaataccaacacgcacacctggcatctttgattgacgctcaccgatgttggcgatttcttcttgtgtgacacccgtctctttaatgtagaccgttgacaaagaatacgcatttgccatcttttggaaaatcatggcagcattcttttgcttatcactcaacgggaacttagcctcgtgcttttgtacgtaagacttcaaggcagcgacataatcatccgtacctggcacggtcttcgtaccgcttgccttaacaaccttcgccgcacgcttcgtatcttgaatgtaatacgtcgcataatttcctgatgacaattgatcagtgtcgattgaaatatacttggcaacctcattggcaatgtcgtacatctcagcctcggttacgccctttggcttcgtatacgtaatcgcttgtgatcccttgttagcgaccaacacttgaccagtactgtcgtaaatcatgcctcgttgcacgttcaccttttcagtacttgattcagcactattaacggctgacttgtacgtctcgctatctgtaacttgtagggtaaccaatcgccagcccaataatccgagcatcaaaaccacgatacccatcagcacattcaaacgcgctggaattcgagctaatgatccattctttgaccgacgattgccacgtcgctttggtgactgcataacttgaccctttcttccataatctaattgtttaattgtagcataaaaccagggcaacaaaccttaacccttgtcggaatttaactaaaagccaccctaataaacgactgcagaatatggtttaatagaactatctgaatttcagggagaaaacaactatgttcgcacgttttaatccactaaaatggcggtcatcaacgcaagcgctatgggtcagtttcttactacctctcttgattatgactgtctattttggctttcgtcacatggccccgttcggttcaagttccatcttgaccgtcgacttagggcaacaatacattgatttttttgaaaatttccgtcaagccatcctccacaatcccacgagtattttctatagcttcgcaaaggggttgggtggtgaaacgtatggcgattgggcctactatttattcagcccaacgaatttacttctcctaccattcccgaacacaatgttgccaaccgcaatcttgttaattaccgttctgaaatacggtttggctgggtggagtttcagctatgcgttgcgcgtgatgcgttggcaaaatggctggcgtttgccactttttggtgtcacgtatgccatgatgggctggtttgtcgctaacgacttaaacctactttggttggacgctgcaatcttattgccgttaatcattgctggatttgaacgctatttagatggtaaatcgtcatggctatttatcgccccactaaccgccatctttattattaactactacatggcctacatgattggcctattcctagttttgtacgtcttctggcgcttgttctggcaaccatacaccttacgtgaacgttggaccatcgctagcaagttcattttcggtagcatcattagcattggcctttcaactatcgtttggttacccactggttatacgttgctcaatagcaaggggcagcacatgttggataatctgacttggaagttcgaataccaagcgcctgatatactcggcaagttgttcttgggaacatttaacttcgaacaaatgccgtcaggtttaccaaatatttttattggtagtctgccaattatcattctttggttcttctttacctaccgattgattcgttggcaaacgcgtctaactgctttgatcgtaactgcctttctagttgtttccatgatgtacgccccattggatttgatgtggcacgggttccaatttccagtttggtacccctatcgtttctcatatgtctttagtttttgggtgctttggttggcagcctcagtctggtcaccaacgcttcgcttctcgtggacgcaaattggaacattggttatcttggcaattgcgaccgatgtgtacctctacttccgcctcgacagcctaaactttttgacattgaaccaattattagtaggtaacgccttctttattttgattttggcattacacgcgttgtcacatcgatcacgttggtggttgggcatcttgagtctgctagttatcgctgaaatgactgtcagcaccgtttggacgttgaataatttcagctacctcacgaatactgagtatcaaacttacatcaagagtttgaacaagattacccaacacttgccaagccagaaagataacttctaccgtgttgcgcaatcattccaacgtacgaagggcgacccactacaaggcaattacaacggtgcctcaacctttagttccgccttggaacaccaacaaagtgatttcatggcagcaatcggtcaacccgaaggcgataactacatcgcttacagtagcggaacattgttaactgatagtttgcttggtatgcgttacctcttgcaaccatctggcgtggagccaaatacaccaggtacgccaactaacatgcaaacctaccagcgcactgataccaatggtacttatcaaatgactaagtacaccgggatggcaattttgtctgagaacccatacgcactgccaatcgcatttgcagcgaacacaaatgcacttaacgtgacgtttaaggacaacgatccgctccgcaatcaaaatgatttttggaacgccttaattggttaccaacacgacgacatctttaaaagcgaaaacttcgatagctcgaccgctgccaacgttcctgcaccagcaacgattaccggtgcttatctgaagaaggaaaacaaaaagcaagttgcgtcattgaccctaacttacacgccaacgactgataatccttattatctaacgcttggcgacgcagttaataatgacaatgtggaaattcaattgaacggtaaggctctgccaacgatgccgagccatcgccacacaatcgttgtgccactgccggcttaccaaaaggggcaaaaacaaaccctgacgttcgttctaaagaaggatgatttgtggttacaaaacgtctcactttacagtgctgataaggatttgattaagtcacaagcccagtcacttcaggaacatggtctacaagttaagaaagattctgaaactgaaatcaacggtaaaattaatatgccaaagggccaaggtttgctcatgaccaccattcctaatgctgacggttggcatgttttggtcgacggtaaagaaaccgaaaccgtaaccgtcgggaagttctttattggtgtaccattgaaaccgggtgagcatacagtcacctttaagttcgctgccccatacttcaagataagcgcaattgtcagcttaggcttcttgctcttcatgcttgggctgggttggtcagagaacgaaaagcgacgtcactcattgcattactaaatcttagcgttgtgaacctttacacacgcgcatacccgtggtaatgtaacatttgaaaccttcgggtatacacacttattaaactaataaaatttaattgcataggaggccagaaacatggctgaagaaaagacatttccaatgacggtcgaaggaaaggccaagattgaagaagaactaaacacgttgattactgagacgcgtgccgagattactggacgtatccaaatcgcccgaagcttcggtgacttgtcagaaaactcagaataccaatcagctaaggacgaacaagccttcgttgaaggacgtatcaacacgttgcaaaacatgcttgataacgccatcatcatcgattcatcagaaattgctgacgacgaagtttcagttggtaagaaggtaacgtttaaggagttgcctgacgaagagcctgaaacttacgccatcgttggtgccgttgaagctaacccacttgagggtaagatttctaacgaatcacctatcgcggttgctttgatgggtaagaaggtcggcgaccaagttgaagtaccacttccaaacggtgcttcaatggaagttgagatcatcgctgttgaagttgcttaatcattaaaaaataaaagggtcgcctagacttgcatgttgcaaagtctaggcgaccctttttcattatttactttcagcaatgacgcgtaatacgtcagcgccataacgttctgctttagcttcaccaattcccgaaacggccatcaattccgcatcattaagtggctgctgtttagccaattccaccaaagtccggtcattaaaaataatgaacggcggaatttccgtcacccgtgccagctccaaacgccacttacgcaacgcttcaaagacattatgctgttgctcatccaagtcttcacgcgtacttggtgaacctgcacgcacacgatcgccgattgaacgaatatcttggcgacgcatcaccttgcgctcacccttcaaaacagccatcgcatccggcgccaatgttaacccagcatattgaccagtcacgcgcagataaccttccgcaatcagataatcaattaggctaataatgtgcacgcgtggcgtaccgcgcaaaataccaaatgttggcaattgatccaaattcgcccacgcaaagttatcaggaaccttaccacgtagcgtctcggccgtaaccgtcttaccaaagccgttctcaccaccgcgtgacttcaacatgcggacaacgtgactcaataccttttgcgcatcagtcgtgatatcgactgcctcacgcgtatccaagcagtttgagcaacgaccgcaatctggcgtatcttcaccaaaataacgggtaatataacgttgcaaacacatttgtgtcgccccgtaatttgccatttcttgtagcttcacccgctgcaaattttgatattctggcgtttgattatcactattatcaataaagaaacgttgcgtctgcaaatcagccgcggcatatagcaaaatcgcttcagatggcaaaccatcacgacccgcgcggccaatttcctgataatacgcttcaaccgaacccggaataccatagtgaatgacataccgtacattcgacttgttaattcccataccaaacgcattagtcgcgaccaccacatcggtacgatcatagatgaaatcatcctgagcttgcgtacgtttttcatctgacatccccgcgtgatagccaacggcattgatacccgcagccgttagcgattcagtgagcgcatcgacggttttacgtgtcggcgcgtaaataatacccgattcaccacggtgctctttgatatacgtcttaatgaagtcctctttaccctttttattcaggcccttttccatgcgaatggttaagttgtcacgtaccacactcgttcgaacagtgtgctgaatatgaagcatctcttccaagtcagcctgaacgcgttctgtcgccgtggccgtcaacgccattacacatggcgctgattccagattgttaattaaaccaacggccgccagataacttggtcgaaaatcgtgaccccattgcgagagaacgtgtacttcgtcaatgacgaccaatgaaattggcaagcgattcaacaagttatacgtcccttcacttccgagacgttctggcgccatgtacagcaacttggcttcttcattcaacaagctgttcattgccgcacggtactcatcatcattttgcgttgaatttaacgtcacggctggcacaccagcctcgtgcagctcatcaacctgatttttcatcaatgatagcaacggtgaaatgacaattgtaatgcctggcaacatcaaagctggaatttggtaagttagtgactttccgccacccgtcggcataattcctagtgttcgttcgccgttcattacggcattaatgatttcttcttgtccatcacgaaaggactcatagccaaacgtttgtttcaaggtttctagcgctgtcgccactcacgttgcctcctttaaatctcttcgaaaacaaatttccctatctgccattatggtcagctttaccccactttgtaaagcagtaaaaaagcaccctaagcagatgcttaagatgctttattgtatgtgattactttgatgatgaattcttcgcatcagcttcgcttccaactgattggttggttgcttccaaatcacctgacttgcccaagtgctcgtcataatcctttgagtaataaaccttaccagtcttcaagttagccacgaagtacaagtaacccttatcacggtcagatgggttcaaaaccgcatcaactgattgtgatgatgggttgttgaatggaccagggccgtaacctgagaacttatacaagttgtatgggttgtctgattgtacatctgagttagacaagttcgtcttgtttgtgtccaaggcgtactttgttgcaatatctgattgcaatggcatgttaattgccaaacggttttcaaagacacccgcaattgtcttacggcttgcttcgtcaattccctcacgctcaaccaatgaagccaacgtcaaaacttggtgtacggtcatgcctgacttcttaatggcgtcaaacttgtccttcatttgcacgtagtcttggtagaccatttggttgatcaactcgttaactgtctttgctgtcttccagtcgtaagttgctgggtacaagtatccctccaacttgtaacggatgtcaccagcttgttggctatccacttctgaatcaagcaagcctgggtaagcttccttcaaacggttgaagaagtcttggtcgttaacggccttcaaaaactcatccttcgtgaagttagtcttctcaccaacttcagtggcaatgttttcaatcgtctcaccttcacgaaccgtaatcgtatccttaccgttcaatgggtaagcagcgccaccttgacgcaatgacttcacaatcgtcttcacgttatcagctgggctaaacaagtagtaaccggccttcaaatccgaaacattgttcactgtcacataattcatgaaagcacgttctgaacgcaaaacctttgccttgctcaattcagatgcaatttctgatgccgtagcaccagacttaacttgcacttgaacttccttcttactcttaacatttaatgctgaataatccgtcttatccttttggatggtgtagtattggtaaccaccaacacccgcaccgataagtagaatcacaatcacaatcaacgaaatccaaagccctttgcgtgacttcttaccgttgatgcggctcaaatcttccattattatcgttctccttaaaatgcaatgacagcaaaaaagccatccgttattagttagtataccagtaacggatggcttttaaatatttgattgacaatttttaacgaatttcggcgttaaattggtcagccaatgcagctgtaatgttttcaacggctgcgttgatatcttcatcaaccaacgtcttttcaacgtcaacgaatgtcaacgcgtaagccaatgacttcttgtcatcagccacgttttcacccgtgtaaacgtcaaatagttcaacgtcgtgcaacaactcaccgccggcggcaacgattgccccgcgcaaatcagcagctggtacatcgcggtcaaccaagatagccaagtcacgcgcaacggctgggaagcgtgataccacttcgtaaccatccttcacctttggcaagtcgaagatggcatccaagttcaactcaaaggcgtacgtttcgttaaccttgtaggccttggccgtcaatgggtgtacttgaccgataaatccgattaacgtctcaccaacgtagatgtcagccgtacgacctgggtgcatttcagcacgcgcagttgttggcacaaagcgcacatcatcagccaaagcgtagttggccaataggcgctcaacaatacccttcaaagcgaagaagtcagccttttgtgcaccttctgcccaagtacgtggcaaaacgttacccgtaatcacaccagcaacgtgctcgatttcagctggcaattggttggcatccccgttagaaacgaagacacgtccttgctcatacaaagccacatcagcttgcttacgagcaacgttgtaagcaacatcatcaagcaaaccagtcaacaagctaccacgcgtttgttggcgatcttgtgacattgggtagtccaattggattggttgcccatcgtgcaattggaagttatttgccttctcaggcgtcgtcaacacgtatgaaatcgcttggttcaagcccaagccttccaaatcgtggcgtgttgcacgaatcaaagcttgctttggtgtcaacttacctggcgtcgtttcaccagttggcaacgttgctggcaagttatcgtaaccgtacaaacgggcaatttcttcaaccaaatcagcttcaatcgtgatgtcccaacgacgagctggtacagtcaccgtgaattcaccgtcgttcaactcatagtcaaagaacaaacgatcaaagatagctgagatttcagcatccgtgatttccgttcccaatacgtggttaacgtgggcagtcgtcaccttaacaactggggcttcgtaatcaaagtcttgcgcaaccacacgaccttcagtcacatcaccaccggcgatttcagcaatcaaagctgccgcgtgatccaatgccgtaaacgtatcttcaacgttcacaccacgttcgaaacgcgttgatgcttctgagtgcaagttttggtcacgagcagcgtggcggatggcctttggctcaaagatggcaccttccaaaacgatgttcgtcgtcttagcagtgacttcagttgactcaccacccataacaccagcaaacatcaaggcttcatcaccagcggcaataacgatatcaccttctgatgcttcacgctcaacgccgtccaatgtcttaatcttttcagcaggcttagccgtacgaactgcaatgtccttgcttggcaatgtatccaaatcaaaggcgtgcaatggttgaccgtacgtcaacaacatcaagttcgtcacgtcgacaacgttagaaattggacggattcccatcgtccacaaacgacgttgcaaccacaatggtgaatccttcacttcaacattcttaacgacacgcaaggcgtacttaggtgctaagtcagcgggtgctgtagctgaaatcaaatcagccgtcttctctgacgtctccgtcaattcgaatgttggcaacgtaggctcttctgacaagatagccgcaacttcccaagctgttccgttcattgagaacaagtcagcgcggttaggcgtaatacccgtttcaagcacgtcatcatccatacccaaaacatgcaaagcatcctcaccaggcgtcaagtcagcggcatcaacatcgttaaagacccagatgccttcttcaaagtccttaggcgcaaccttgtcgtcaaagccaagctcttgcaaagccgtcaacataccgtttgagacttcaccacgtagcttacccttcttaatcttttggccaccgccaacgattgagttgtgcttagccaaaataaccgtttgaccttcagcaacgtttggggcacccgtcacgatttggataggctcgtcctcaccagcgtccacttgggtaattaccatgtggtctgaatctgggtgaggcacaactgacaacaccttagcaatcacgatgttcttcatgtttgcttgtggttggtattgtccttcaatttcaacagtcgtacgtgaaatcttctcggccaactcgttagctggcaactcgattggcaaataatcacgcaaccaatttacagaaaccttcattttgtttgcttatcctttctggtcaaattgcgtcaagaaacgcacatcgttcaagtagaagttacggatatcttcgacaccgtacttcaacattgcgaaacggtcaggtcccaagccaaaggcgaatccgccgtaaacttctgggtcaacaccggccatacgcaaaacgttagggtgcaccataccagcaccaagcacttcaatccactcgatgtcttcaggggccatgtctggtgtcacagcgttccatgacacgtcaacttcaactgaaggctccgtgaatgggaagtatgaaggacgcaaacgaatttcgtggtcctcaccaaacaacttacgggcaaccgccaaaagcgttcccttcaagtcacccatcgtgatgtgcttatcgataaccaatccttccatttggtggaattggtgtgagtgcgtcgcatcatccgtgtcacgacggtaaacacgacctggtgaaaccatcttcaaaggcccggcattaaagtcgtgtgactccaatgtacgagcttgcacaggagacgtttgcgtacgcatcaagatttcaggtgtgatgtagaacgtatcttgcatatcacgggctgggtgatcctttggcaagttcatcatctcaaagttgtacttatcttgctcaacttcaggaccttcaatgacttggtaacccatgccaaggaattggtcttccaatgactcaatgatttgttgcaacacgtgtggttgaccttgtacagtcgcacgacctggcaacgtgacgtccaacgtttcagctgccaattgggcattcaaagctgcctcttccaatgacgtttgacgtgtcgcaatagcctcagtcaaggcgtcgcgcacctcattagccaaagcacctacaactgggcgctcttctggcgtcaaatccttcataccgcgcaacacttcagtcaacggtccctttttaccaagccagttaacacgcacttggtttaaagccttcaagtcagtcattgcttcaatctcgcccaatgcttgatcgcgcaattgcgtgagctcgtcttgtaaactcatggtttgtctccttagaaaataaaatcaaaataaaaagtccctgcgacaaataacttgtcacagggacgctcattaacgtggtaccaccctactttagtcgtcacttaagacgaccctcggacatccgttaacggggatgaaccgcaaaggccttgcaaccaatgaactcctgactgaaattcagttttaacgtcgatgggattttcaccagtgcccactctctaaaacgacataccaacttactaggtcattcaaagtttcttatattattgtacaacattatcagtcattcgcaaccggtatgcaaaaaaccagcgaacgcgttccccttgttcactggcttaacaattaatgcttaattaggcgttccagttgtctgaccattcgtgaatggcagccatcataggacgcattgactcaccgcgctcagtcaaagcgtattcaatcaatgatgagtcttcgtatgtacgacgctcaacgataccagctgcttccaattccttcaaacgctcaaccaaaacacggtctgagcacttcgtcacagcttgtgccaaatccttgaaacgacgtggaccgttgttcaacaacacttcgatgatcaatccattccacttacgtcccaagatatcaaacgttgcgataaacttgtcgcacaatgtgtttgctactacttcatgtgatgctactgccataattactgtctcctaatactctagttctaatcggaattttatttacattttataagtgatttaattgtaacgctcttcacaaattaagtcacgcttccatactcggaaaaaggacaatctgtgttgcgagctaacgtttttttctcacttttgatacttacattataaaaccagaattgtgatttttttaagaataaactctgcacgaaataaagacaaaatatgcacgagccttgatttgaacagggttaaacgttttaaacggtggctgaattgccgtttttcaatacaaaaattgtccatctaaaacgattaactatgaagactattttttcgaggtgtatactaaaaaatagtttttattagaaagttaggtgtttattacgtctcagaaatcaaattcccgtatctttaatgcaacgtttattcagctcttcgttattcaaattttgagcatggttacgttctatagtctctttgtcatcattggaccatacaccgtggcaacctaccacgttagcaatgccatggctggtctggtgactggtatgacgattatcggtacaatgattgcgcgtttttcagctggtattttaaccaccaagttcagcgcacgccaattaaccatcattagtatggcaattttggtacctgtgctgctagcctatcaactccaaggcggtttgatttatttgcttgttgtgcgtttcattcaaggattgtcagtcggcattacaggtactgtaacgaataccgctgtaatcaacgtcattccaactgagcgacgtgccgaaggaattgcctacttctctttggcaaccatcctcggtacagcattcgggcctttcttggctttgttgattacgcaccacgcttcatatagtacgctattctggcttgagttcttgactggccttattgctttgattgcttccctatttgttaagtcagacaaggtttacattgaaacgaagccggtcgctaagcaagccaaccaacgtttcgatatccgtactttgatggaaccacgcgtgctaccaatctcattaaccctcggttttgtaacgattggctacgctgccttgcaagctgatctggatttctttgctagtcaattgcacttggtgacgttcgcgtcatacttcttcttggtgtacgcgttcgttatcttgctttctcgtccgctcgtcgggcgcttgatggatcgtaagaatgaaaactatgtcatttacccatcattggttattctagcaatcgggttgctacttctagccacaatggtaaacggttggatgatgttgttagctgccatctttatcggtgtcggtttcggtaatttccaatccgccgtgcaatcgactacttcacaaatgattccagctgaccgtttgacgcaagccacggcaacttattttattgcttacgaagcgtcacttggttttggtccgtcaattattggactattcgagccttaccttggctaccgtcatctctttatggtgatggttgcgattacggtaatcggcttggtcgtctatcacttggtacacggtcgtcgtgtaaaataatgtcaaatttaaaacgccaattaatcggttgctgaaaccggctaattggcgtttttatcatagcagctgttggtcttatctataagataatattgtcttccctcaactcagcgagcagttccgggttgacgtttggcacatcctcatatgtcttaatccgcgacatatacgcgatgatttttaacgcagattcaattgaaaattcgcagtcttggatatactgaatcagcatctgcttagcactttgtcccattgcactatcccccaaaagattgttcaatctgtcatagcatgggtctatcctatcatcttcaaaaaatggctgcgtcgcattgattacatgaaaagcagtacaatttggtccgcaatctagtgtccgatttttacgtacaaaaacaaaacgaccgcgttttcttcaaaaaatcttcaaagccaaccgataatcttttatgtaacttactataagttcacaaagagagaaagtatatcggtagacaacaatgcctgttttaaatctattgcaggctcatgagaagacacaacttgaagtcattgtatctttggatagcatgggccaatcaacaaaaattagtttacatagtttagcgctcaaactagacatgagcgagtttacgctaaggggcgtgttacagaccttggaagcggaggcgttaactgaattatctaaatacttcagtttgacatttgcaaatggtatcgttcattaccaacgcgtctcaaatgcctcgccaattactgcccttcgttacgcctattcgagacgttccgactacattgcattagttgagcactcattccacgaatgtttttcaactgtcgaagactatgtagcggatgaatctatctcgcgcacgacgtttttccgcaagcggaagattctccgtgaatacttcgcagaccgtcatttagacttgtcagaatcattgatcttaactggggacgaaattacgattcgagagctctattaccatcattattcagtgctgtttggtgattttagctacccattttctgataaattgaaagcatcatcagaacgaattattgatgcaatttcaatggctctacatatcaccttatctgattcacaaaaactaagcctgttgtactacacctacgtgaaatacaatcgcatcatgcaggggcatctgttaacggatcacatgccaattgcacggccattttttgtcgatgctactgagctagttgatgacgatatgttagctagtaccatcgcaattttcgatgaatcgctacaacgtaaaaatatccacttatcacagcacgaactaacactggaagcaaacggctatctgaactttatgattagtttgcgcatgttgcctattccagttagcaaagtgcccaactttctgcgcgtcacagcgccattaaaagagcaactggttaagacttttgcggccgcagttaatcaatcttactggtcgctgcaaccattcttctttaagcaggacgtgacgccgattgacatctatttgtatcacttggtttgttacaatcaccccgaatccgaggtcacgacgacgttccataacgattacctagatagtaattttgcggactacgaagccgtcgcgcaatcattcatggactggattgctcatacgtacccaaacaagcacgctgatatcacactgaataacgttgatttttgcaacgatattttatatctgttaattgcaaccgtgccacgtcacgttgtcgatcaacccatcagtgtggcgctggatattaattatgggtttggctataccgaaatgttgaagcgtcaaatcgcaacctttttcgatttgaatgtcatcatcaccgagaagccaactgaaacaactgatattatcatttcaaatgttgtacccaaaaccccaattcgtgcgattcacttagagtggagcaatccgccaacttacagtgacatcgaattgtttaagcaagccgttcgcacgattcagtgtgaacgtaaaggctgcactgacgtttgttgtgcttaacaaaaacgactgttccgcaaaaatgcagaacagtcgttttttagtgtgcgtggaatagtcttttgactcgagctgatgctggcgagaaaaactcagcaaccgccatataatcatcaactaaatccagcaaaaaactttcacgataatgtggtagcgcagctgtcgcaccccacatgtgcttcaggataatatccttttccatcggtgataactgcgtaatcttctcagcatttcgtagtgaaacgcggggatgaataaacgcatgcgttcctagctcgaacttcgtggtacgccaatcataaaagaagagatcgtgcaaaataccagctcgtgcgaccgcagttgcattcaagccaagacgtaatgcccacttgtagctcacatatgaaaccgcaattgaatgcgttaaccgatccgagtggtggtgttgggtataattcgccaactcttgcacttggggatgggctaacaagtctttcacgatattataatacgcggtgtcgcgttgccaatcttgcatataaaagccccctctttgcatgattaacagtaccttatcaaactaggctttagcgtgccttcaacgcaaacattgcaataccggctgccacaccaacgtttagtgattcagcttggccagaaattggaatgtaaagattcttagttgtcatcttagccaattcaggattcatgccttgaccctcgttacccataatcaacgcaaattgggtttgcgctggaatcgtaaacaagtcagcggcttctggatccaattgggtgccataaacgttcatgtcattttgcgtaaacgcagctgtccactcttgcaagtttccagtcgtcaatgtcatgtggaattgtgatccttgcatagcgcgcaatgcctttggtgaatatggatcaactgatccatccccaaacacaacgccggcaaagccagctgcatccgccgtacgaatcatcgttccaacgttacctgggtcttgaatcgcatccaagaacaaccaagcgccatcgtgaataaattgtggttcacgagttgccgttggcaatgagacttccgcaaagataccttgtggcgttaccaagtctgatagcttcttagcaatatcggccgtaatttcgaataccggtaccccaagtggcaagtcatcttggtgttctgccaattgttctggtgttgccataattgcgtgcaacttaccatcgtgttgaatggcctcttggaccaaatgccagccatcaagcaagtaagtcttacttgcttggcgacctttcttcgtttgcaacttttgccatgacttaacacggccattttgtactgatgtaatagtttccataagagtcattatactctgaaactggtaaacttgcctatgttataatttatcacggttgctattggtctaaaaatcctggctttagccaggattcaagaccaagaacgcccctgataagggcgacttggtcacgtcggaggttctaaacctccgacgcttccagtctgctttattgagattgaatgagactgtttttcagttagaaagaaggaaaaacaatgccagttttggatatgaatgatgcagctgccgttgaacgttttacgacgtttgtccgcaactcaaagttcggccaagtgacacaagacttgggctgggcacacgttaagaataattgggagcctcgccacgcgtatgttgaagacgctgatggcaacattattgccgctatttcgcttttgttgacgcaaacgccaaccggtaagaagtttgcttacgcctcaaaggggccggtgatggacgttacggaccttgatttgttggataagttagttgctgaggccaagcttgctgtggccgacgacgatgtgtacgtcattcgtatggatcctgaagtcccttactcagatgaatttaacgatgctttgcgtgcccgtggctacgaaacgcgtaaccgtaacgtggctgaccaggggatgcacgctaccattcaaccccgtttgaacatggtcatcgatttgactgctaagccagatgccaaggaaacgctggacttgtacccttcaaagacaaagtcaaagttgaagcgtcccgtccgtgacggtgtaaccgttcgttgggctaacgacgaagcagccgttgatgccttctttgagacatatgccggcatggcacaacgccacggcatctcacaccgtcctaagaaatacttcgagcgtatgcgtgaagcattcgcggatgatgatatcatgcgtatctatattgccgaacgtgaaggcgaattgctttcaactggtatgggctttaagtacggtgacaagatttggtacatgtacgccggttcatttgacggtaacatctactacgccccatatgccgtccaaacggccatgattcaatgggccatggattcaggcgtgtcattgtatgatatgggtggtattgaagaagcttctgaccaagatggtttgttcgtcttcaagcgcacgttcgtcaaggatgacccacgtgaatacatcggtgaaatcgacgtcgttgttgacgaagacgcctacacagaattagttcgcaaataatcaaaaagcagtctgccacagtattggcagactgcttttttgtcttacaacgcatccatcgcgatacgaataattttcgtcatccccgcgtttggcgttacttgaatattttgacccgcgcgttgggcttcccacgcggccttaaccgtatggtgatgcgacccgttgattaagacaacgccgacatcatatcggtttgctcggatttcatcaatcactttgctttccgtgtactttgagccgtctaaccacgtggcttgaccaccaacctcgttgattttgttcgcagcgtttttagcgctcgccccaaaccacgacacaatcaacacacgtttaccaaatagttgtcgctccagttcactatctgtcgcagtcttttcgtcctcggtggcttttgtttctggcagtctacccagactacgcagtaactgtactgcatgagtatccgatcgaacacgcgccgagtatgtctcttccgcattcagactcgcttcatcaaggccattcaggtcaatttgatccatgccgaccagatgcccctgattatcaacaaagtagcgctcttcatcttcaacatagaatcggccttgtaccggtatccacagagcaacatcatcatttgttaactcattgtaggtttgaacaagcaacggcaatttgcgataggcagccaaattatcacgggttaagtgcgcaatcaattgtgataacgcctctgaatctgtgaccggcacagtttttgtcatcacaactggctcagcttgtttcgtaataatgcgaaccggttgcggtgcggttactggtgtttcttgaaccggcgcttgttgctgttgctccaattcactaatgcgcaccgccaacgttcgaatcacagtatccttgtaatccgtattcgtatgaattggctgtgtcgtattatgctgcataacttggagttgttccaacgattcatttgcctcatgcaacgcttcctcaagttcagcaatacgaccactttcattgcgatgcaaattctcgtattccgtgacctgatttttcagttcttccatcctggttgcttgatgttccaaatccaattgacgttgatgggaaatttgttgcgtcgcctgttgtgtcgcttgcgccgtttcaagctgatctgataacgccgctgtttcttgcgtcgtggccgtattcgcttgctttaattcacgctcaagctcttggacccgttcgctagccgcaacgtttttggcttttaacgttttattcgccttttctaatcgatcgatttgactctttaacgccgtgacatcctcacttggcgtttgtggctcgactgacttaacttgaggtgtcgccgtcattctagttcgtggcaccctggcttccgtaagcacatcccgaaataatgcgagcccatccccttcatcgcgaacttgatacgcaatgccatagactcgccgtgacgaaacaacgttctttgaattctcccaaacgtaaaccaaatccggtttcgcggttagtgtcagtcgtacggtaatatcggccaatagctcgttcacatcatcttcagaagcttgtagggcttccgccaacggtggtgcaagcgtctttttaactgcattttgatcggccgccggtatcgcataatgatacttttttatcaggttatccgtctctttcgctaacgctaaattgtcgataaaaaacttttccccactcgataaacctgggttacggttcatctgtttacgtatcttttttgctagcttatttctgtccattttagtcaccccatgtacaacgcgtttactctgtttataccacaaaccagtacccaaaaggttgtacgctgtctcaggtggccaaaacttaaaattcacggccaaattagcccctaggttcataaaaaaaggattcggaaagtgattttccgaatccttttaatctttaatattaatcttagcgaacttcaatatcgttgttcaagaatggcaactttgaacgcaagaatggcgttacccagtggtccaaaccgatacgtgctgagttgaagccaccgatcaagatgaacatctcgatgaagatgaacgttgggttaactgacacaacaccggcacccaagtatgagaagttcatgatcattccgaagaaggcagctgccaaagtcaacgtaccaaagatcaatcccaaaccaacaaacaactcaccccatgcaacggcgaatgagaagaaaccagtagcgtgaccgtggttcgttgctaggttcaagaaccagtcgtaccatgggaaggccttcgtttgtgctggtgtcataactggcttagcaattgccatgttaatcatgcctgaagcatcgaagccacccttagtggtaaccttctcaaaaccatccattacccattggaatcccaagtaaacacgggcaatcgtcaatacccacattgcaaccttgctgttacgtagccatgaaatcataataatatctcctaaaaaataaataaccttatttaaaatatgtgaatcaattaacatatattatcttaatctacttacataagtttagcaacatattattcacaatttattcacacttagtgtttcgcattcggaacacactaaatgaaaaagcctagttttaggcactttcgattttattaacaatgtgaacaataacacattgttaagtaccgcaaatcttgatttcgaacgtcggaaggtcaatttgtgcactttatccttactatcttttcggcaacgtaccattacatgttggaataaacagacagcttggtactccctgccgacaaattcttggttaaatgatagatattaaagaatgcagacgtctagaatgaatttacgcataacacaaggagctagccatggctatttttgacctgttagatgaatatgagcagattcagttacgcataattgtcacgttagagaatatgccagcaccggtcatcaccaccgtttcagaattgtcacgattgctaggtgcatcggaatttgtcattaaaaaggctgttcaaacgttagcccatgaatcaatggatgaattatcttggctttttacattaacgtttgatcgcaatacaatcacgtatgtgcgtgtaacaaatagttcacccgtcacttcaatacgctatctttattctagacggtcagatactgttcaaattctagaaagcagtttcgaagaagatttcaccaacgtcgaagacttctcgaacaaaagtttgatgtcacgtacgaacttctttcggcgccgcaaacgtctgatagcctactttcggaaacatcatctggctctatcagagcgtctagttttgactggtgacgaaatctcagtacgtgagttctattatcactactactccgtcatattttgcgactttgagtacccgttttcaaatacatcattaaagacatcaaccaatatgattaaagaattagctgagcgtttggatttccagttatcaccaacaaaccagctaaatttaatttactacacgtatattggctatcgccgaatcgctaacggacatctggttaatcaagacaacgttggatcccgaatgttcttctcgccagaaacattactagttgattcagaaaacgtggcgatcgctattgaaattttagacaaaacgcttcaaggggaaggtattcacctttccgaagaagaactagcttgggaggcagtctcatacctaaactttcttttagcgatgaacattctgccaatttctttgcaaaaaaacgtggcgttgcaaaatcacattgcccccattaaagaactgctgggtaaaacatttgcaactcatttttcattgtcatattggtcaatcgctcccatgttcttcaagaaagaaacaacgccactagatacctacctgttacgtttgcttggctatacgcagcccctttccgaggtcaccacacaccaacgtagtgcatacctgatggataattttgctgagtatttagatgtttcgaaggaattcttcgcgaagttcctgacgcaattcccagacaagctaaccgatttcgaaaccaatcaagagaatttctacaatgatttgctgtacctattggtcattacaattccgagaacgattattgaaaagccactagtggtcgcactggatttttcttatggttatgcttacaccgaaagccttaaagcacggattgtcgcaacttcgaaccataatatcattgttaccaatgaattcactgacaaggctgacattttgctttctaatatcacacctcacgatgctaaaaatgcggtccatattgaatggagtaatccgccgactcgacgtgactgggacttatttgaagctgctattaaagcactgaacgcccaacaataaccgttctaaattgttagatgatttgcttaataattggcacactcacttttatcacgaatgatatagtttagaggtaggtttgtaggaatgcagtatgtcgtcgctttgtgcgacaactttctttcccaaatatggttattgccactaaccatcatttcttttgtacgaaggtcctgatttataaatcagggccttttccgtaccaaattgtggtttaaaaatcgctaactctggcacggccggtctaaccatctttgatatactcattcttgtaagttatctcttacaagcgtatttctttaaatactaattttttctcttcatgtggctttaatagccaaaaaggcttgggttcccactaacccaagcctttttctctgtctgttattcccatgcagctttaacgaacttctccgtatcgccgtgcacagcaatctgatgttcattcatgaccgtatcaacagcatttcgaatactgtcgccgttcttaaacacttctgccgcctcaatcaatagctcaaccaaaccggtttgccaagtcatcttgggctcataaccgtattgaatccattgactatccatctctgcatcatcccaaccactggcaccgtggtatggtcgatcatcaaccaaaatgccaccaggtgtgcgtgctaggctcttatcatgtgcaagaatcacgcgcttataaaatggactcttctcatcatcaccgaaatgatgttgcaaccaaatcaacttatcttgccaagcgctcacattttgccaaggcgctgtcgacaaaatatataactcataatagtcgttcaacttatttaccgcgtcaatcgcccctggtaccggtggcaaatctcgaaaaatgcctggaatctgatctggcttagcgactgtctcaccagccatatcaatcgcattcaaaataagtaacgtatcaacaaggacattgtccatgtccaaaaacaatttaggcttattcatctttccctcacagcaatcggcattatgcctttgttagtgttacttgtgccttattcgctgacccaagcatttgaatcatctcttcagcagcttgttgcgcagcgttgacacctgaacgaagcaacttacgtggatcgtagttagtgccttccaaatcgcgatctgtcacaatgaattcacgcaatgcgttgtggaacgcccattgcaattgcgaattaatgttaatcttagccacgccaagcgtgatcgccgtttggatttcatcctcaggcaaaccagaagccccgtgcaagacgaatggcatctcatgacgcgtcgctgcttcaaactcagttagcgcccccaaatctagaccagcaaagtcttctgggtaagccccgtgaatgttgccgatgccagctgctagcatgtcgatacccgtgttagccatttcaacaacttgttgcttatcagcaatttcacctagcccaacaataccatcttcgacaccgccaattgacccaacttcagcctcgacactaacacccaattcagcagccttagccaccaaagccttggtttcgcgcaggttttcttcaaatggtaaatcagacccgtcaaacataactgatgtgaaaccatcattcatcgcttggtacgccatctctagattaccgtgatccaagtgaatcgctaccggcaccgtaatcgccatactctcaactaaatcacgcaccatgtcggctaccatcttcgtgccacccatgtacttaatagcgcccattgatgctgcgataatcaccggtgccttttggctttccgccgcacgcaagattgcttgtgtccattccaaattattcgtgttgaagtgcgctaccgcatatccttgtgcgtgtgcttgcgcaatcatttctgatgcatttacgatacccatttttatccccccatggttaaaaaagtcattttaaagtactaagtttacttaatccagtcgttcccccgaacattctcgattaaatacgaaacaatgtacgaataataccacgacgaacgacactttgccaccgacttcatgaatccactttaaacaactcgtaaattcgccacagatatttcagtaaattccaaacttcgtcatacctacagaaaaggactgccaaacctcgtgtttggcagtcctttagtttttagtctggattttgttcagctaacttccaacgtaggtatgaattaatgaatggatccaaatcaccatccattacaccttgtgggttacctgattcaaagttcgtacggtgatccttaaccatgcggtatggttggaaaacgtatgagcggatttgtgatccccaaccgttttccaattgctcgccagcaatcgatgcacgttccttttccttcttatccatttccaattgatacaacttcgcacgcaacatagcataggccgtatccttgttttggaattgtgaacgttgttgttgtgaggcaacgacgatacctgttggaatgtgagtcaaacgcacagcagatgacgtcttgttgatgtgctgtccaccggcaccagaggcacggtaaacgtccattttaacgtcagctgggttaatatcaacttcaactgagtcatccaattcaggcatgacatcaattgatacgaatgacgtgtgacgacgaccagctgaatcaaatggtgaaatacggacaaaacggtgtaccccacgttctgaacgtaggtaaccataagcattgtgtcccgtaatcatcaatgtggctgagtcaataccagcgacatcgccagggtggtaatccataatttcgaccttaaagccgtggcgctcagcccaacgcgtgtacatgcgttgcaagttggcaccccagtcggcagactcggttccaccagaccctgggtgaatttccaagatggcgttgttcttgtcatatggctcgttcaacaattgtgccaaacggtagctctctaggtcgtctgacaacttttgcaagtccgcttccatctcagcttgcatgtcttcatcaggcaattcagccaatagttcaagtgccgtctcaacgttctctacgccagctgtcaagttcaagtagtcatcacggcgacctttcaagatgttgttggcatcaatcaccttctgcgccgcaacattgtcattccagaaatctgggtgaaccatttcgtcttcgttggccgcgatttcatcgttcaaagcatccaagtctagagactcaccaaacttcgtaatctcttctgacatctcagctaatgagcgacgtgcttctgatagctccattttctctataacctcaactctctaatgcgaaaaaggaaagccagtcgcaactaactttcccctccaataacatttatgcacgcaagttttgacggatttctgacttcatgaatagacgcgttgcatcatattcaataccagcaatcatttcttcaaacatacggaaaccttcgttttgatactcaatcaatgggttcaattgaccgtaaccacgcaattggatagcatcacgcaattggttcatggcgtccatgtggtccgtccattgtgagtcaaccacacgcaagataaccacgcgtgtgaattgtagcatttgctcatcatcaaccaaagcagaacgcttgtcttcgtagacttccttggcacgaccatacaagtaatccttgatttcttgttggctcttaccctcaaggtcagcgaccgtaattgaatcctcaggaatcaaaacagccccggcgaagtcaacgattgattgcaaatcccattcttcagtcttacccaaagcatgacgatcaacaacacgtccgatagtacgctcaaccattggcaaaataacattgcgcaatgacttgtcttcatcgataacctggttacggtttgcatagaacgtgttacgttgttgcgacataacatcatcgtattgcaaaacgttcttacgtgaatcgtagttgttaccttcgacacgcttttgtgctgactcaacagaacgcgtaatcaagcggttcttgatcacagcatcttcatcagccaagttcatacgttccatcatcgtcttgatacgctcaccaccgaaacgaatcatcaaatcgtcttccaatgacaagaagaattgtgagtatcccttgtcaccttgacgaccagcacgtccacgcaactggttgtcgatacgacgagattcgtgacgctcagttccgataacggccaagccacccaaatcagaaacaccagggccaagcttgatgtcagttccacgaccagccatgttagtggcaatcgtaacggcaccacgttgaccagcgttggcaacgatttcagcttccttggcgtggttcttggcgttcaacacgttgtgcggaataccttcacggtccaacaattgtgacaacaattctgatgtctcaacggcaaccgtaccaatcaagattggttgacccttggcgtgcaattccttaaccaattcaacaacggccaagaactttgagcgcaagttagggtacaacaaatctggttcgtcgacacgttgaattggacggttcgttgggatttcaacaatttccatgttgtaaatctcacggaactcttccgcttcagtcttggccgttccagtcatacctgacaacttcttgtaacgacggaacaagttttggtacgtgattgaagccatcgcacggttatcttcttggatttgaacttgttccttggcttccaaggcttggtgcaatccatcagagaaacgacgaccttcttgaatacgtcctgagaacgcatcaaccaacacaacttcgccatcgcggacaacgtagtccttgttgttgaacatcgtgtagttggcacgcaatgattgatcaatgtggtgagtcaaagctgtgttgcctgaatcgtacaagttttcaaggttgaagtaacgctcagccttcttaataccttcgtcttgcaacaaaaccgtctttgattcttcatcgaccgtaaagtcttcttccttcgtcaatgacttaacaaaacgatcagcgcggatgtacaattgtgtgctttcttgtgctggtgcaccagaaataatcaacggcgtacgcgcttcgtcaatcaagattgagtcagtttcgtcgaccaatgcgaagttcaatggacgttgtacacggtcttccttacgggcaaccatgttgtcacgcaagtagtcaaatccgatttctgagttagtcgtgtacgtaatatctgcgttgtacgcagcacgcttctcatctggtgacatttctgaaccgttgataccaaccgtcaaaccgagccacttgtacaattcacccatttcctcaccgtcacgagcagacaagtactcgttaaccgtgacaacgtgaacaccttcttgtggcaacgcgttcaaataaaccgccatcgtggccgtcaatgtcttaccttcaccagtacgcatttcggcgatgtttccaccgtgcaaaacggcagatcccatgatttgcacacggaatgggtacaatcccaagacacgacgtgcaccttcacggacaaccgcgaatgcttctggcaaaatatcatccaacgtcttgccttgcttcaacaagtcacgcaagtaaggcgtctttgcttgtagttcttcatcagaaagggctgccatctcatcggcatgtgcttcaacttgatccgcaaggcggttcaagcgacgcattgtccccttatcactctcaataattttacgtaatggattagccatcttttacctattccctcttgtcttcactagctgttacagctaatggtactaacaaatattttaacacactcacaacgctgattgtgtgcattatttttgaatatgtggtaagtgggagctagtagtatgtgtcctcccttactgtcggagtgacctgccccttcttttggctcgctaacccaagtggaccatgacctgtggggagcggagtccactgcgttgcagcggacacctttacctcctcgtggctctaagcgggaaacccgctaaaaacccacacccacgggtcaaggtccacttgggtctatatgctcggcggggcaggtcacagcagccaagcgatactctgttcttatgctaaccatccactcggcgcgatagcgacgacacacactaccaacaaaaaaatccagcacccaaacaggcactggacttaatttgttgtttaattttacaagaactcgcggatgtttgcgattgtttgctcgcgtcctagcaattctagcaattcaccaaggtttggaccttgctcctcacgcgtcgttgcaatacgcaatgggttccacaaagcacgtgccttgacgtccatttcgttttgaatctcgcggattgcattcaaaattgcagcagccgtaaacaatggcattgcttccaacttctcgatgaacaagttcaacattgctggtacgttttcagcagccatccattccttagctgaatcagtaatctcatcagcagcaggcatctcgaagaatactggctttaccaaaggtacaatttgtgacgtgtatgatacaccgtccatgtaaacgttcataactgaacgcaaccattgcatcttttcagccgtcaattcagctgggttaaccaagtcagccttaacaagttgttgcatcatcttgtcgaagaccatgttttggtcagccgtcttaatccattggttgttgatccattcaagcttcttgttatcgaacttggctggtgactttgacaaacggttttcgtcaaacatcttaaccaattggttcttgttgaagatttccttctcaccaactggagaccatcccaacaatacgatgaagttcaacattgcttctggcaagtatcccaactcacggtattgctcgataaattgcaagattgactcgtcacgctttgacaacttcttacccgtctcagcgttgataatcaacgtcatgtgaccgaaaattggggcttcccaaccaaaggcttcgtaaatcatcaattgctttggcgtgtttgacacgtggtcatccccacgcaaaacgtgtgagatttccatcatgtggtcgtcaacaacaacggcaaagttgtacgttggcataccgtcagccttttggataacccagtcaccaccgatagtgtttgagttaatctcaacgtgccccttaacgatgtcatcccatgcgtatggcttgtcttcaggtacacgtaaacgaacaacagctggcaagcccttagcttctgcctcggcttgtgcagcggcgatttgttcgtcgttcatgccttcgtattcgtaaacgtagtgtggggcttgcttagcagcgatttgtgcctcacgctctgcttccaattcttcagatgtcttgtatgacttgtatgccaaaccacgatccaacaactcttgaatcaatggcttgtagatgtccaaacgttctgattgacggtatggaccatactttcctgggttagctggagattcgtcccagtccaatcccaaccatgccaaattatccaactgtgacttctcaccgtccgcaatgttacgtgcttggtcagtgtcctcaatacggataacaaattcacccttgtggtgacgtgcgtacaaccagttaaacaatgccgtacgtgcgtttccgatgtgtaggtgcccagttggagatggagcgtatcgaacacgaatcttcttctcagtagtctcagccattctgtctattccttcttttctgtttataataccgcttactaatataccgcggtttttcatgggtttcaatgttaattacttaatccaccacaataccgaagatcatacgtccggcatcggtctgcaaagctgacgtcacttccacagcaacggtttcttgcaggtggtcgcgaccttcttcagcaaccaccatcgttccgtcgtctaggtaaccaaccgcttgttggcgctcagttccattcttaaccaacgtcaccgtcaaacggtcaccaacagccacacgtggacgcaaggcaccagccagctcgttgatgttcaagacttcgacgttttggaactttgtgaccttgttcaggttgtaatcgttggtcaccaagataccattcacatcctttgcaaggcggattagcttttcatcaacttccttgatgtcttcgtaatcaccttcccacatttcgagtggaatcgcgtccgtttcacgtagttcgttcaaaatatccaatccacgtcgaccacggacacgcttgattgattcacctgcatcggcaatgtattgcaactcatacaagacaaagttcggtaccaacagcgttccttcgatgaagcccgtttgcaccaaatcagcaatacgaccatcaatcaaaatgttcgtatccaaaatcttgtagtggtgatagttcgtttcttcgtcagacaacacatcactttgatttgctgaacgacgcggacgaacgcgcttcgtcatgttgttgaagtttggcaccaacgtacgccattcatcaatacgcgttgtgcccaaacggaaaccaagataaccaaataacaacatcacaaaaactggaataactgcacttaaaaagaaattacctgtgcgttgcaatgggacagttaccaagacagccaacgccaaaccaatcaacgttgacactgaaccaatcaacaaaacaactggcgactgttgattcaagtatgcttcaatcttacgaatcccttgatcaaccggacgccatagtgccaaactcaataaccaaaaaataatggcaccaataataaaattcacgatggcattgtttagccaaatttgattatgttgattcataatccgccaaacaattggcattaacgtgaccgctaagccaccaccagcaacaaagaatgctgcttgtataattcgttttcgcataagtttcctcactaatccagtgccaaacgtagcgcatccgtcaacgttgcgacaccgataacttgaataccagaaatctctttcatcgtatcaactgcatgctttggtacaaatacgcgcttgaaacctaatttcttagcttccaaaatacggtcaacgacattgggcacacgacgaatctcaccagtcaaaccaatttcaccaacaaaggcatccgttggacgagtccccttgtcacggtagcttgatgcaatcgcaatggcaatcgccaagtcaatggctggctcatctaattttacgcctccggcagctcgaacgtacgcatcttgattttgtagcaacaagttcgcacgcttttccaaaactgccatcaacaatgaaatccgattacggtcaatacctgaagcagtgcgttgtgcattaccaaagaccgttggcgttaccaaagcttggacttcaaccaagattgggcgtgacccttccatcgcaatcacaactgctgaaccactggcatcatctaggcgctcttctaagaaaaggcctgatggattcgttacttcagccaagccactttcgttcatttcaaagacacccagctcattcgttgaaccaaaacggtttttaaccgcacgcaacaaacggaagctacgttggttatcaccttcgaagtacagtaccgtatcaaccatgtgctccaaaatcttcggaccagcgatggccccatccttagtcacgtgaccgacaataaagatggtaataccatttgtcttggcgatttgtagcaactcagctgtcgtttcacgaatttgggcaaccgatccaaccgctgatgacacgtcgggttgttgcatcgtttgaattgagtcaatgatgacgtaatctggcttcgtttcatcgatagccttacgaatttgcgtcatgtccgtttcaggatataggaagaaatcagcatcccccttcacacccaaacgttcagctcgtaacttgatttgtgacgcactttcctcaccagcgacatacaaaatcgtgccaccgtggtttgccaattgacttgaaacctgtagaagcaacgttgactttccaataccaggatcaccaccgattagcaccattgaaccaggtacgacaccaccacccaagacacggttgaattcatcaattgatgtatcaacacgtggcgtttcttcgatgctgacctcacccaaacgttcaacacgggcaatttgaccagccaagttaacacgtgatttgcggtctgccttttcaggttggacaacctcttcaacgaacgtgccccaagccccacagttagcgcatcgtcccatatagcgttgtgatacataaccacaattcgaacatacaaattgtgttttcgttttagccatagcctacacctctttaattaacgccggagctaccaaaacctcccgtgcgttcttttttctcttgcaacttatcattatctgttaccaggaatggcataaagataccttgaccaatacgctcgccctttttaatgtgaacatcgcgcaatccccagttagtcatttggataaaaatttcaccttcatttttatcattatcaacatagtcggcatcaatgatacccacaccatttggcaaaatcatgccacgcttcaatggatttgatgagcgatttgcaatcattaagtactcgttttcgcccatataggctttaatgccagttggcactaggaggggcttcaaaacagcatttgcttcctcatagtcgttcgccgtcaattctttcttggtcgccaaatgcaccagaattttgacaaatggtaacttccaaattgatggtaatacaaaatcttctgccgcttcaaaatcataaccagccgcacggcgcgttgcccgctgcggcaaattcaaattggcatcagcatattttttaactactgcaaatccacgttccatatagtttgcccccattttattaaaactatctcaagtatatcgaaaaatgactcaaattaaaaagcacaccggccaaaaaccgagtgctttcaaataagtcttaaccttttgcctgaattttctgatactcaggattcataaagaatgctttgcgggcatatgaacaaaccggtcgcaacgtcaccccagcttcttcagccatcgaaacgacctccgccaacatctgaccagcaataccctgaccacgcaaacttggattcacatacgtgtgatcaattgaccacgtttggccatcattaatttcagggaacaagatttcagcatctaattccccatcagtctcatgaaatagtcgacccggttccttcgtaaattccattgtgtctcccccattaacgcactgacaacaccatatcaggctgccagttgtaatcaatcgtgcgttgcacaactttctccgtcatcaagtcagccgtaatataacgaccaccaccaatgtagatgcccacactggttggcatcattttaccaccccaaaccaacatatcacctaaaattgcttgttcagctggcacttcattgaaaatgtcaatttgcttggtgatatcgccaggcaaagacaaaccataaacgtgattatagaaataaatgtttaaccccgttgcatcaaaaccagttgccagattaataccaccatttcgataaggtacgccaataacccggttgaccaccggccagaagttttgccgtagcttatccataatcatttccatcaacgtttgttggacgcgcgcaccttgcatcttttgtgcaaagaatgaattcgtaatacggaataacgttgcctcgccaggcaatgtgaattgcaattctgcatccactttccccatatcgtttaagtgcttaacgtttgtctctgaaatttcgtatggcataacttacctctcgttttacaaaaaaagagccccaaaagagctctttaacctgtttacttgtggatgaacaagtgacctgcaggtgaaatcgtacgttggtggtacaacattcctggggcgtagttaccttcagaaatcgtgattgtaccatcggcgttaactgattctacgacaccaacgtgaccgtaaactgaaacgccaccaacacctggcgtaaaccagataactgatcctgcacttggcgttgaatcaacgtagtgaccggcgttaacagctgacgttgtccagtcagcagcgttaccccaccagttaccaacccagtccaattgacccttagcgtaccacgtgcattgtccgtatgggtacgtgttgttcgtcgttgaaactgaacctgagtttgtgtagtcgttattgtttgaagcgttgtcgttttgtgatgcagatgaattgttgtcattgtttgatgatgacgcgtcacctgatacacgcaaaatgtcgcctgggtgaatcattgaggttgcttgcaaaccgttcaagttcaacaagtcagtcaatgacataccgtggttgtttgcgattgcccacaatgagtcaccggccttaaccgtgtaagtgccattagtagctggcgcttgtgcatcagcttggttgtcatttgatgcttggttattgttgtcagctgctgcatcaccagacaacttcaacgtgtcgcctgggtggataacagagttcatttgcaagccgttcaatgaaagcaattctgaaagattcatgccgtggttgttagcaataccccacaatgaatcaccggccttaaccgtgtaagtgccagttgctgctgggttagcagccgtgttgttattgttgttagccccgttgtttgaacctggcaattgcaattgttgacctacaaagatcatgttggcatttgacaagccgttagctgaaaccaaatctgcaaccgtcgtgttgtgcgcagcagctagcgcgtacaacgtatcccccgccttaactgtgattgagtcagctgatgcgacaacagctgatcctgccaacgttgctgcggcgccggccgtaactagtaatgtattctttacagatgcattcattcgttagtactccctataagtaagtaatcgtagtcttttttagactttataatgttttctttaactttaatatactaattattctacgcgcgagaagttgcaatccaatgcatttattgttgtcttattatgacttttgttacatttaatttacaccctaacaattcggtcaacccgcgccactaaaggcttacacaggtttttacgcttcgttaaaaaaactaaaatttacatacaataatatggtgttacacatttatcggaccgaagaacaaaaccgttcaaaagacttgttttgactgaattttcatcatgattttgcctgttacacatagaaaaagacttggttctcaccaagcctttcaatacgttatttaaaatacaatcgccagtttaccattaacggcaccagccgaaactttttcttgagcagccagaatattttctgccgtcatgccgttcaacgtttccgtcaatgtagaacgcaatgatcccttatctgccaattgtgccgctagtgccaacgcgtcaccttgagacgccatgtcaacattgtagttagcctttgcgaacatgaactcccaatccaacgaagcagccttgttcttaatcaaaccaactggcattggctcaactgattccacaatcgcgccgatatgtccaaaggcgccgattaactcagctgcttgttcaaagtgtggctctggtgcgtgcaaaattgcaatataaggcactgtatcaaagcctaacatgtgcatctcggcaacgtagtcatcgcggtggttaatgacatgatccgcaccaagtgacttaacccacgcaaccgtttcttcacgtgaagctgacgcaataactgtcatccccatccacttagctaattgaatcatcactgacccaacaccaccagcaccgttaatcacaagcaaagccttgcctgaggcagcgttctcagccacctctagtccaaacttatccgcaagcaattcatatgccgttaagaacgtcagtggtagcgctgacgcctccgcatcagtcatcttttcaggggccagagcagccaaatcttcattgaccgcttggaacgtcgcattagagccaacacgacccaattgtccggcatagaaaattcggtcacccgtcttaaacttcgtggccttttcaccaacggcaacaacttcaccaaccgcgtcaaacccaagtacacgtgtcgcgttgcttgctacggcagcatcacgttgcttagcatcaactgggttaactgcaactgcagccactttgaccagcacatccttctctgccatctccggcactggaatagtcatcaaagccaacggttcattttcattagctgttgtaacaacagcatccataaattcagtcatgatttctctctttgctcccaatattaaattcactcaccgtctattgtacgctacacaacagaaaaagacagatgctagtcgcatctgtctatcattctattaatcttttttgtttccttcagccgcgtgaatcgcgtcatccagaccattcatatcaagctcgtgctcacggaaggcttgattatcaattggcaaatgcaactcataatcagcgaaaaccgttaaatcgcctgacaattcggctgcattaaagtccaacacgtgaccaccaaactcgcggtcatcactcaagaaatgaacgtgccagccggccgcaacaacgccatgatacaactcaggtgagtaataaccgaccagcgttccagacacattgtcacggtcaaacactggttgattttctgccaattccaacaatgatgggaatggttcagatgcctttggtgcaacacgaaccttcacgtgctcaaagtcaccacgcaagacaattgctgagaagttgtttgccaacttacgctcatcaattacgtcgatgtggtccatatcaacattttgcaacgtaatcttttcggttgcatcgttattgttgtgtaccgtcgcgaatggaatcattgcatccatatccgtaatgtgattaaccttccccgtttgatcagcttgataaacttcaccatcaacgatgataacctcaccatcaacaccgtgcaacgtcccaattcccgtgtcaccgtgttcaagcaaatctccagcacgcatcgtaccgcccaaaaggccggccataagcgctgctaatgtactgtgttgaaaaacaactgccattgtatcctccttttttgcaaaaaaggtgcccaagcggacaccttttcaacgattagatttctgattcaatcaattgtgacatcaattcatagttgtgtgagtagtcaactgggacttcaacaacaactggtccttcagtcgcaaatgcttcatccaaaacagcgtccaattgatcaggtgaatctacacgcaatcccttggcaccagctgcttcagcaaacttcacgatatcaatatcagcaatcttaacaccagctgacttaccatcgtacttcatctcttcttggaacttaaccatgtcgtagtggtggttatcttgccaaacaatgtgaaccgtgttcaagttcatttgtacggccgtagccaactcaacaccagagaagaagaagccaccgtcaccagaaacagagacagccttagcgttaggacgaaccattgcggcaaccatagcccatggcaatccaacaccaagcgtttgcataccgtttgaaatcaagaagtgacgagggacgtatgacttaaagtgacgacccaaccacaagtagtgtgatccaatgtctgacgtcaacgtcatttcatccgtcatgtggttttgcaatgacttgataacgttcaatgggtggttcaaaccagcatcagctggcgtgtactttggctcgtctgcggcgcgcaaagcagccttcaactcagccaacttgttttgtgaggcaactggcaactcgtaaccagcgaccttgtccttcaaaactgacaatgtgtcagccaaggcaccaatcaattgacgctctggcgtaaagttgttatcaatttgaacagccgccgtgtccaaagcaacgatgcgcaagtcggcatccttgttccagttacgtggctcgtattcaatggcatcataaccaaccgtgacaaccaaatctgattgtgccaacaattggtcacccacttggttgcggaagaatccgatacgtccaaagaacgtcttctcttccaaatcacgtgagataacaccagcaccttggtacgtctcaacaactggcaaagtcgtttgcgtcaacaattcgtgcaaagcttctgtcgttgcatcgtcagacccgcgggcaccaaccaacaaaacaggcatttctgcttgcttaatttgctcagccaaccaagcaatgtcatcaatcgcagctgaacccatacgagctggggctacttgtggcaaagccttagcatcaaccactgcatcatcaacgtcttgtggcaatgaaacgaaggcagcacctggctttggaccattagcttgtgcaattgcattagacaagatttctgaaatgttgtttgggtcttgaatttcaacagagtaattcgtaattggctcaaacaaagcagctgctggcgtgctttggtgcgtcaaacggtacaagtccttacgtggcacttgaccaccgatggccaaaacaggatcattttcagcgctggccgtcatcaaacctgatgccaagtttccgactccaggacctgacgttgcaataacaacaccagtcttaccagtgatacgggcaaaaccttgggccataaaggcagcgttttgttcgtgacgcgtcacaaccaactttggtgaaactgcgccttcagctgggtgctccaacgtttcaaacaaacggtcgatcttggcacctggaataccaaacaccaaatcaacgccgtggttgttcaaactgtcgacaactaggtcggcaccgtacttcttaatctcagacatgcgtttttgtacctcttcaaataattgcttacatacttaataatttgtattgtacgctttctttttagaaatgagtagtcataaaccttcttgtgaaattaagcataagaaaccagccccagtgtgataacaataggcgttttaaagttttatagtttgtgaaattcctgcaataggatataaaaaatggtgaaccccagcggattcaccatttctaatgattattaattaagcttccaaacgtgcgaagccaccttcagcgacttccttcaacgtcttagctgaagcagccatcttagcagcttcttcttctgacaacgttgcttcaacaacagcttcaacaccgtttgcaccgataacggctggcgttccgatgtagatgtcgttcaaaccgtattgaccgtccatccaagcaccaacaggcaataccatcttctcatcgcggaagattgcacgcgtgatgcgagccaatgacgttccgattccgtagaacgttgcgcccttacggttgatgatttcgtatgccttgtgggcagtctcgtacaagatttgatccaaatcttcgtctgagatacctgcttctgcagcccaaaccttcaatggacgtccaccgatcatagcttcgtcaaagttagcgaactctgagtcaccgtgctcacccaagatgtaagcatcaacggcttctggagatacgttaaacttcttagccaatgccatacgcaaacgcgcagtgtccaatgacgtacctgatccgaatacgcggttctttgggaaaccagagaacttttgtacggccatcgtcaagatgtcaactgggttagcagcaaccaagaagataccgttaaatcctgattcaacgattggtgacacgattgacttgatgatcttcaagttcttgtcaaccaagtccaaacgcgtctcacctggcttttgtggggcaccggccgtaataacaaccaaatcagcgtccttagcatcgtcgtatgaacctgagtaaacgttcttgttgaacgtccaaggagcagcgtcctccaagtccaatgcgtcaccttcagtgcgctccttcataatgtcaacgataaccaattcctcggcgataccttgttgcatcaaagcgaatgcgtatgatgatccaactgcaccgtctccgacaagaacaaccttttggtggtgttgtgccatgattattttcctccacatacctaatataagttttaattcttattcagtttatcacaaacgacaaaggttgtgaatgttttgtgaaaactaggtgtcccgtaaatggtgcggtccaaaatcatgataaaaaagcgcttgtgaaacaattattcacaagcgctttcaagcattaaattgtatttggactgtattccttggcttgattatcttcagatgcccaaaccttgtcgatttcatcgtagtacagattatccgctggcttaaccacaatatgttgtgccttcgtatcaccattcacttggaatgtttcttctacgaagaggcgcttctcgtaaacgtcgtgcaagtgtgccacgcattcttgctcttcgttatcgtacgtaaacatgttcgcattaatttgattgcgaacaatgaaactaacaccaatggtcaacgcaagcattgacaaaataaccgttgccaaattagcaatcagcactggccagtagccgctcactgccaagaagtgatacttagaatttggtgccaatgccaagtaaacttggaacaacagaatcaaaaatggaactgccgtaatcgtccaagctaaaaccatcatcaatgtttgacgcacacgcaaccacgtgcgacgcttcttttctaaaccagtctcttttgtatctttgtctagataagcatcataaaccaacgtcttatcaaagttattcttctctaccatattctcccccttgccgtgcggctgatgtcatcacggataacatcaaccgtctcattcggcttaaaccgatagcggttcacaatcttataaaactgaaaaaccggtgtatcgataattaaatcttcgcgatcatcaactgactgcatgaaatctacgatatcttgcgtcgtcttaaatgccccaacacgaacgttcattaatactgcatcaataattttctcagaagtaattgcacgcattggcaatccttcatttgcgtatatcgcttgaattttcatgatgtaatcgttagacaacttaatatcatcgatcaatgcattcaattcattagcatgcttcgcaagagcatgtcccgaataaattcgggcaatcgggcgaccaatcagataaaggcccaacccgaatcccatgacaccaattgctagcatgatgaccatgttatcttgttttccaagcaacgcatgcatcagagttgtcccccaatacaaatacattgcaataacggcaatcactagcgccaaactatcagccaatcgattagcaacttggctaatgcgatgaacgcggccatccaacacctcacgcatttcttgcgtcgtttgggtgatggtcttattcatcgtcaaaatctgattaaatttttcaatccactgatccatcacttgtcatcctccgtcccgtcaagattcgttcgttcaggtgatgtccaagtaccactacgtccaacaatcaaacggttgatgaaacgcggaatagccagcactgtcgtaactggtgacaaaatccaataggcccagacgtaccaaccagcaaatctgaagtacttattggtatcatccccaagttccgacccgtaattaagtgacaacttcaattgcaacattccgaagataaattggaaaataaccaaagctgaagccaccgttgtgaaaacgtaaagcttctcccatgagaaatccacaaaaatatagaagaatgtgatgatcattgaagccacccaaaatagtgaccaaatggttgaaatgatgttatccaacagcaagaaaatcatcgggaacgtcttgcgtgggtgcgttaaaatcttcaaccagtaagctgttacaacatccatcgaaccgatggcccaacggatacgttgattaaccaattgcttaactgtcgttggcacatccatatatgagaacgtgcttggactataagcgatacgccaaccgcgtgattggatgtcccatgacatggcgatatcttcagcggccatgattgtatcccaatagccagcatcaacaaccgcgtcacgacggtacaaagccgccacaccagaaacggtaaacaaacgaccaatcgttgattgcgcacgcttgataagcccgataattgagttatattcaaccaactgcaacttagccaacattgatgaacgattcatcggcgttggcgcaccggtaacggcaccaacacgatttgctggtgaaaagtctgtgtccaccaacatatatgccatcatgtctttgaggccatccccaataatgaaactgtccgcgtcaattcctaggaagaattcggcatcactgtaaaatgccgcttgtgtaatggcgtgcgccttacccatattttcctgaatttcaactaggcggacacgtggatcttttttcgtccattccaacacaatttcatttgttcggtcagtcgacccgtccgacgcaatgattaactcataatttgggtagtttaagtcgtaaagcatacgacggattgtattatcaatttgtagttcttcattgtgggccgcaaccaaaatcgaaacctttggcaaaaccataccttccggaataaccggtgtgttggttttaatcatgctacgatatttaattgctccaacaatccaaacaatacttccgaaaatcgggtagaaaacgagtagcgaaaccaacaaaacagtcagcgagctatcactaaatgtattttgtataaacatattctctttgccctcctcccttactaaatattatacaatcttccactaactattagttaattgagacttaaagattggtttttatttgtttcgtttttgaaacatttttaatccgatgtgaaattaccgataattggtcacttttttcttatatattggttttatcaccactgagagaaactggagaaaataaatgaaaaaacacgtttcagccatcgtctatggtggcttagatggcattatcacgacgttcgcagtcgttgctggatcggtcggtggtaacgtttcaaacatcgttatcatcattttgggattctcaaacttattagccgatggcttttcaatgggggccggggcctacctgtcagcaacatcggataacaatcaatccaaaagcaaagcattggcagccggtatcgcgacattcatttcgtttaacgtctttggtttaattccactaggcgcctacttaattacaaatgcgctcattcacgacaaagccatcgcctttccaatcgcctttgtcatcgtcggtgtctctttggcgttactaggttgggtgaaggccaacctgtcagagcagaaagtaagaacagaaattctacgcacactttctgtcgggtacgtcgcggcaattgttgcttatggtgttggtagcttactgaattattacctataaagaaaagcgcctggaacgtatatcagttccaggcgctttgtgcataattaaaacttttctacaatcaacgtgcttccaaacggatcatcaattagcaatgctgattcatccaataacttgtgacctgcacgttgcatcagctcgttaaaatatgtctcgtccaccaaaacttgccagtcaacgagaccaatttcattttcttgacgcattttaacaccatttcctaaccatgtattgtatgcatgatgatggtgataatgattgtgtgaatagaaatgcgcgttgtccgtaatcacatacgtggtgtccatattcagcaacttaacaaaaaagtcatccccctttgttaagctatcacccacaaaatggacgtgcccaattatcgacccaactggaaagccggtccacgtgtcatttttatgttcaagcaatgcctgaacatcgacatgcgccgtccccattgtcacaatgccattatcccagcgccaattttcctttggccggtcgtgatacaattcaatgccgttgccatctggatcattcaaatagaatgcctcgctaacgtcatgatcaccagctcccattgggtactgcaaccgaatcaaacggtcaattaaagttgctaaactaccagtgtctggtaatagaatcgcgaaatgatataagccaccacgcttttcagcaggcgccttaccaccaaatacaatagttaaaaacggcatttcgtcagctgtaaatgcatatgaaaattcgttctctgcaacttcctgttcaatcagccccaaaatatcacgataaaacaggcgcattgcctgtttgtttgctccctgcaccgtgagatgcgtaatcttatacgtaacgtctgccatttattttccccttctctaaatgcacgcgtctcgcccttcatcaccaaactaacttaaaataagttgaaaaacaacctaaatcctactgaaatcacgccgaaagcgcaaggtctataatttccgactgcaaaaagaaaacgttgatccgtcgagcaaaaagccgacgtatcaacgttctcaaatttattcaactgggcatactgggtctaaaccaaatagcctaaaaacgcctgtgtaataggcttttgagtaacggataatctcatgagtacaccggcaagtacaccggcacataaaaaacactaaaaaattgaacgctcaactcttcatgtctgaccacttagctaattgttaggtggtcagtttttttgtacctaatcggggatgaacttgctgacagtgccgtaccgttcaaccccaaaaaataataataactgcagcgtgttgaagagacggcactatttgatattcggttacttcctaagcgacgcaggcgggggtataaatgatttaaaatgaacaatcagctaattactgactgagatttaaaacgtctcacacgcgctcctatggcttctcacgcaatatgttactccaaataaaaaggcagcaatctatttgattgctacctagtgtgatccgaaaacactgcattgttcgttcggtaaatgttgaatccgtcaaaaataccgaaggtggacaataaacaaacattaacagttaattttgagtgtaaattaagccattctgagagagagagaattttattaactataccttgtaaaaggcggcttaactcacgaactacaaaatcaattttacacagtagtgatagtaacttgataaagcaaagcagtcaacaaataatttgaattccattgacaatacccttaggtcatcaatcatatagacgcgctacccatgtacagctcttactagaacaattgtagtatttataaaccagcctctttaaaatttcgcttcaccttgtacttctgcttccgtatggctgttggtgttctgtcaaaagtggtgtgtagatcatcaaacgtcattctatctccatacttagctttaaatacattctgatagaaaggcgtaagcgtatcatgcaccacatcatcaacaatctttcgtacccgtttcatatcgtcatactcagctctgtgcgcttctaaaaaccaacctgacgcctcatagcttgctacatgcttgtccagtgtaccgttgaaatagtcagttaataacttatcgtatctttcagccattattcaactctgcagcgtcactgtgaaatcatacgtatcacgaaaagcgatagcaaactctatcaacccctcttgcattatttcctgtgatcgcctagacgaaagatgagtatcacaactaatagctccgtgagtttcttttaaaatgtatttacgccatatcaacacacgctttagcttgtctaaactcataagggcttctattaagctgtttgcatatccaaccacatcatcagttgacgatctccccgtcatcggaaccctgttaagctgttcggggtctgcctgataaacatcaaactgggaaatgaacaaaattctaattgcctccgactttaaaaagtccctaacctcttttgctgttgctgcgttatctaccgtttcaatcaattttgccatatactcacctcatcctttttacgtctgcaaattatatctatattattgtacaacgtgttcaataactctaaattgtccactcgtggggaaaactagccaagtacgggcatgaaaacacccaattcagcaagtcaaaaccttaatacaccagtacatcatgtttccattgcccccctattaaaaatttttcacacccaacatttttgtaagatgacagcaatgtgtgtgcttttcttttgccggtcatggggcgggattatatccaataatggcgatacttccaaccaatcaactagcctaaaataaagcgcgctcaaacaggcttatatggcttctgacagcgtgtgttcctgctgcgcttgtaagatgtctatctgactatccaaatcaaagacagtccataatcaagtatgctgaccaacaccctgcgtggtatttatgcgcgctacttcaaaaaaagtgtagcaagtgtagccaaacaccctttagcccttgctatgactagtctcgtgacggctacatatggtgtagctccagtgtagcaaaaacgtagctaagtaatataaacccttgatatgactgactttctactcggctacacaaaaaagcggctaacctaagtcaaccgccctaaaatcatcaattcaacatctgtccaattatccaaacatcacacgcaatccattccaaccataaaccagtattacatgttatcccaatctttattattcatgatcttacatctcccaatcgttataaatgtcatctgcctttgtcatcgcctgctggtcattggacttgatacccttacccttgattcgactacggcgcttggtgtcgtaatcatcaaccagttcagcgtctactggtatagctttcattggctttctggacaactgtaagccgtggttaatcagtgacttgcgtaaatctcgctcattcataacatcattggctggtacaccgtcactcattagaaacgctttaaacaaatcatgaacataagaaactgttacaccgttagtaccttggatgtccacaaaatactctttcatgaactggcttaacaaatcatcactagtcaaccagtcagccgttcgttgcttagctgcgtctgtaatggtcagcttacggcgctcaatggcttgcttagcctgtgtaatggcgtaatagatgaacttgggtaactctgctactaactgatcttcatgatacttagacatgtacgcttcacgttctgcgtcatccatatcagtaataggcttagcaccagcactcaacaacaccaatcggcgactgtattctttctggtctggaaatgtcggtaaattgaaattagctgaaatcaaaaacttggcatgtaccttaaaactatacgtatctcgtcctttggggtttgctgtcagtgggtctcctgacgcaatctttttaaggatgtctaacccgtcagttgaaatggtgctatctgattcagtcaaaatattggcatacataccagctagttgctccatgtatcgtgaactatccttaccagcaagctgtgagaaactgatagatccaccaaatcgctcaataccgaatgcgcttagcaatacctttaatagcgtgcttttaccgttaccaccttgcccttggataaaaacaatatgctgtaagctgtcgtcattcagaaagaacatgtacccaaaccactcaataagtgtctgggcgtcatccccaagcaaataacgcgcgtattcagcaaccagcccaccgtcattgctttcaataatcttagccggtaacaatgatgtcagataatcttcttcacggtactcatgtaattgcattgtttttaagtccagcgtaccgttctcaaagctaactagatcttcgctgttaaacacttgataacttggctctggtatcaacgtttgcgccaattcaatcatgtcactgcgcttctgcctagaaactttatcaaacacacggtacttattcagcaacttaatcgaatcacctttaatgacctttaatagcggttgttgcttggtgaacttatcccagtatttaccgttccaatatagcccgtctgggtgtgtgtcattcacaacaataatatgacggcgctccttgatgtcatccacaaacaagttaatgtccagcacccaaacagataatttacctgacttatcaatatcatgcactaaccaatggggtgacttctcattaagccgtgacttcacatctgccgtcagctcttcccacgtataagaacgttcagggtcaaatggcatccccttataagtggcggtatcgtcatcaattcgtttacccttaatctgccaccagttgcgtaacgtcatgtaatcagcacggcgttccgcttcggtctgcttgctagtatcatgcttagccacttggtcagctagtccagttgtttcttcgtcatctaataatgtctccattctttcatctccaatctactcaatacgtccaacgattcacccaacttttaaactttgcttttagatcatctggggcaatcgggtcactacccaatgcgtttacagttgcgacaatatcaccagtcagtttgatgtcaccatgtgtctgccggtacacccaaccacctacgtctgtcagcatgttatcccaaccaccaaatgcttggtaactgttctctgggtcaaacatggctagtaacatctttctagcaacaagtgcatactttggggtgttactaatatcaacaggtgtctgactatgtgcttgtttatccagtggctggtacttgttagggttattgttaaacaactcaatcagcacgtctgtgttcagcccaaccccgtcagtctcaataattggcttgttagcggcgttctggtcagtcggtacataaataccctgtaactgtgcaaaattgcttttagccccccgctggtcagccttaatgcgtgtctgtccagtaacaactaaccaagtcttgatatagtcgtcttgattcagtgatttatctaactgaataccagcacgcaaccttgtcccgtccttgataccgttgctaatagtcggatagatgacataattagcgctcatagcgttcaagaaactagccaagtggttagctacatcttcataggtgccactatcatcaacatcaataaacatcacgctacgttctagtacttcatttttagcgcgctccatattgtcattagcaagtgttccgtaaagaacataaggggcgtttacctgtttaaaactagccaactgttgctctgtgtgtcggtatgccgttgtcttagggcttgctacgttcccagccaagtgagaaaaatcatcttcatccccaaacaccggcgtgtattctttcttattcagccctttttgctcgtagatcatagtgactactccttagttggcaacgtcatctaacaattcatataaagtcattagtacatctcctttaaaacatccaacatcaaacgcaacacgtacagcttggcttgcttgctaagttcactgtggctcactgtttgactagccgccttgataccagctaagaaaccagcttctaattgcttgctactgttatctaaatcactcatacttaaatagtcctttctatttggggatgtcgcactggcattgggtcgccaaactttcaaccagtggacttagtaagtcggttacatgctatgtagccggctttttactttgtcataccaacctaagcaatcaatcgctgtcagtcgttggtcatacctgttagctgacatctgtaagtcactcggtgtcctgattaaaaagaaccgataaccaacacccacggcatagccaactggtacaccaaggtcaataaggtcatttaccgctgtaatcacagccttacgttgctctgtctcactttctgccaacatcaaaccggcatatgtaccaagtgatacccaaccaactgggttactgactgtcccgcgttcaagcgctgcaatcatgctgaccaccgtgtcattatcaagtgtcattaaagttgtttgctccataaattacagccctttcactgctagatctaactcatctcggttgtatcgttcaaacgcgataccgtacttagccccgctgtgtgccttaaacacaccttggtcagctagtttcttaaaagtcttgtaattcatgtgaacataggcgctcgcttctttttgcgtcatccatggactaggctgaaatgtaccaagcgattcaatcaccgcctgctttaaaacggtaatcagcttgtcatctgctaaaatagggttatccattaaaaaagcacttcctttcttttgaatcgtagtgtctgggcgctccgttagttactgaccaaggtaaaggctaacggggctttttgtttgcgctgtgagttgggcgctcgtctttatagcaatcagtaagccggcaaaacaaactgacactatgattcaggtatcaaattaagtagtttatcgacttgcttgggtcacattatgtacaccagccaccacatacaaagcgctggcacggtaataactaataaagttgtcctttaatagtgttgttgtatgtatggggtggctcaaaattgtgctaccccttaaaatcaattcaaaccagcttctaacgatgtgatgtcagtattgttgttgatgtccaatagtgccgctttaattgctagtatcttgtcactgggcgttacgtacttatccatgatgttgcctaagtaagtgtcatggttagcacgggtaactttgccctgctgcattaagatgtcaccgtattccatactgtccaacagttcagcaatcggtaatgattcagctagtaagctaatcactgacaaaatggtttgcttacgccaattttcaccttctctaatcacgttaggatcatagcgcacgttatccaatgtaatacgcaccatatcaactgccgtctgccactgcttgggtgattcagatatggcttcaataaaatcttcattctctgggctttcaaacttacccgtgtacttgttacgcttggtcatctgtccattctcctaaaatcaaatcaacgttaaaaaatgcactacgtggcttgctttggtctggcaactcaaccaaaccagaaaatctattgaacttgtaagccgttcctgtaacactggtcagcaccaacttgtacttattagctactggcgttccgtcatcattcaatactgctgcgtaaacatcaccgttatagtcagttacggtctcaaactcatccccaaatgacttaatcgtttcaatctcgtcatcagtggctagtaccaagccttggtatttattgaatacgtaccagtggttacggctatccaccaagccaagtaaataatctacctgtggttcaacttgataacgcgcccttgggtcactatcaacaaatatgaccattggctgtaagttcgtgtcgctagtcgtctcatcttcaaatggcttgctatcgttccacgggtctaaaccgtcttggatcatcttcattttttccgtcaattcaagaacttcaccgctcaccatatcaatggctgaaactcgtgacgtgttagcgtcaaaaccagcagcgtctgacaactcttgatatgattcaatcatcaaaccaatagccttgtaacgggcattttctgctgtctctcggtcaatagcttccttatccataatcaatactccttccgccaattgtggcgtacatctgttataagtggctcgttttttcatccaaaataaggcatagtgctttactttgttcaatatcttccataaatagctgttcaatgcgttttaaatcgttctttgtatatatgtattcatttgtcaaactatttagaaatgccgtcgtatcgtcaaattcgcttaaacgtccacatataacaccgtgctcaattaaaaaagcacccaccatatacttatcagctttaacccgccctcgtgccttaataaattgctcaatctgtgcatttgcttcggctggtgtgcagtacattgtcaaatctgtcatgttataattctcctgttaatttaaagcccccaatgcggggcaactgaataaccattagtccaacgggtgcaaccgctgggcttatttttttgctgtcatttggctagttctgaaatcagccaatcgttcacagcggtaaacgtcttagcactaaccgttagcggcgtttctgaatctagtaccgctctaaccgtctcccgtgataaaccaagcacatcagataactctgtacgattcaaacgctcttgtccttgctttcgtaacaaggcaatctgttggtctttactaatagtcgctttcataaagccaccgcctttctgtcaaaatgaatgaaccttgcatgtttatattctgtcgtatcgacagaatattgtcaatggtctttcttgcaaaatgacagaaaagtgtgttttaattctcctataagcaaagaaagggttagtcatgaaaaaccgtataaaacaagttcgaaaagaacgaaaagaaacacttcaacaagttgctgacgctgttggtctatccaacggtactattgccaactatgaaaacggaaagcgtgaaccaaacttagaaacatggataaaactggccaatcactttggcgtttctgttggttatctacaaggggtagataaatatttagacaaaccacattctgatgagttccgcaaattcatggaatctaatagagaagctactccgggagcttttgcactatggcatttacaagaaatcgataacgcttttaatcttgggtttgaaccttacaaatttttgaataatgaccaaatctgggaagctgtatatactgttgaaaattcctattacatgtggtcattattgttaaaccctgacgaaaacggaaatattccagactcgtttgacgcacaacaattagccgcaaacttcgcaagactggtagaactgatttatctaataacagcgtcaaacttaactggtgataaactagacgacttatccctttcagaacttaatgacatgatagaaaagtttaatgtcgctttatcaagtcacatgaaacacgtaagcgcacgtacattcttccgtggaaacggcacagaaaaagacgccaaccaatcggatgacgtctaatgcacacactactgcgctctatttaattgttacttttattttaacacggctagatctaaccactgattcagggatgaactctgaccatgatgacatctaaccagtgtgacatcccctatttatgtagccaatgctacaccattgctacacttactgtagccaaacaaaaccagtcatatcaagggtttataccatttggctacacttgctacacttttttctaacatttataaaaaactttcaagcacatatacaacatggttagccgatacatagaagagttgggcgctcgtcaggtaaaggtattaaacatgagtattaagaaagaatctaatggcacttggttcgtccgtgtgtcataccgtgacagccttggcaagcgtcatgaaaagaaaggacacttcccaactaagacactggctagtcagtttgaacgtcaggtaaaggttgctattgataatggtgagtttgagacggtcagcgtcaacatgacaactaaccaactatttaaccagtggtttgatgactacaagcggtcagtaaagccggtatcatatgccaaggtacagaaactgtttgaacatcacatactaacgtcagcatggtttgacggtgtgaaaattaaagacatcaagaaacgtgacattcagcgctgggttaatgcaatggctaagaataacactacctacaagcgacaaatcaactactttaagaaaatgttggctatggcggtgtctttggaactaatggacagcaacccgtttgacacggtgttatatcccaaggctaaggctaagcccgtttatactgaccgtgtggacttctatgaccgccaacagttagcagcgttctggtcagctgtacatgataaatacgataaccttgaatcaatgcacaaactggcttatctgcgaactctggcatggactggtatgcgtaacggtgaacttagggctattacatggtcagatgtccacttagacggtgccaacccttatattgatgttaataagactatgagtgaagttactggtcagggtgtggttattgatacacctaagactgacgctggtaagcgtactataaagctagatctacgcactgctggttatctaaaaaagtggcgtgctatccaagcacagaaactcatggctaagggacaaaaagctgacgctgtatggactaacaaaattatgactaagcgtatatcagctaaccaaccgcggtgctggctattagctgcaatcaaagggactgacgtgccacctatcaacatccacggtctgcgccacacatatatcacgttatcggtacaggctggtatggacattaaaacgctgcaagcacaggtcggtcatgatgatattcaaaccacacttaacatctacgcgtctgttactgatgaaatgcgcgcaaatacggctgaaacgttcacatcattggtaaacttctaacaacaacacaaaacgcccttatacagtctgctatggcttgtacaagggcgtttattattttgagttcagtacaccgctcggtacaccggcaagtacaccagcggttaaaactctatgaaatctaatacaatctaatggtgtaccggttggtgtacttcataagaaaaaccttgatatgccaagctcaaacgcccgtatatcaaggtttaacaaatcatataactgggcatactggattcgaaccagtgcatgacggtaccagaaaccgttgccttaccgcttggctaatgcccaaaatcaacttctatatcatacaacacacactctatcgatttcaagtccaaaaagaaaacgaccaagtcccctcaaacctggtcgttttcgtcttaacgctcgtctaaattgcgcgctttaatcttggcctttgtctttgacacgaccttatcatcgaattgacgaataaacgccaataccttgtgggcttgctcttccccaaaagcttgtacccaaccatcgaaacgattctcaacacgcttcgttacgattgcttcaacttcacgacccgtcactgttaaatgcaacaacatccggcgtcgatcagctgtatccggttcctggtagatgaactccttcttaagtaacatcttgatttgtcgtgacacagccgcacgggtcacatggcgacgttcaacgacatccgtcaacgtcaggccatcttgttgtgcaatgctatgcataatcaagtattgttcgaatgatagtccgtaatccgccgctggctcagaaacaacttcatccaagtatttcagagtcgacaaatacgcgtcgatatactcgcttaaaagctccattactgcctcccaaaaaatatcccaaagatttttataacgctaactattgtacagtaaagcacatgcattgtcagccgaaaaagaggatatgaaaaaagagaaccgctaaaactagcaattctcttttaatctttattaacgaacaatcatcactgtgattggggcattattagccacatagcttgattgcgaaccgaagtacttctcagcacccttttgtgagtgtgatccaatcacaaccatgtcggggttaattgaaggaatcacatccttgacgataacctcacctggctcaccttcagacaaaagcgtctcaatgtttggaacaccggcatcaactgccacttggcggtaacgctccaatgcctgttcaacatcttcgcgagctgctgcgttcttttcctttgaaaagtaatcgaacacattcatttgatcagcttcaaatactgacaaaatcgtcaacttagaaccatcttcttgcgcttggtgaattgcgttcaccaaggccaattgaccaagttctgagtcatcgacagctgccaatacgtgcttgaaatgctttgcttctaccataagtttcgtctcctattacttaaatagcggtgcgaccgtgttgaaaatcaattgaatgttcaatcccgtcaagataaccgaaatcgcatatcccaaccacgttgcccacttaggatttacaaactcacccatgtacttcttagatgacgtaaagtaaatcaatgggaacattgagaatggcaaagccactgacaagaagacctgtgagtaaactaacagcttatccaaggcaccttcagttgctccgaacacaattgcgaagataacaatcggaatcaacgcaattccacgggttagcaaacgttgcaaccacattggcaagtgccagtgcgtgtaaccttccatgatgatttgaccagtcaacgttccagtaatcgttgagttttgtcctgatgccaacaaggcaaccgcgaacaacatactcaagacaggactcgcaatggcaccaacgatttccttgttgttcaaggcgttgaacaaatcaccaaaggcttccaaatctgatccatgaccgaagaacaaagctgctccgacgatcaatagcaatgaattaacgacgaacgctcccgtcaattggatatttgaatcccaagtcgtaaagcgaatcgcttccttaatactcttatttgatgaacggtcaatcttacgtgtttgtgagattgatgagtgcaagtacaagttgtgtggcataaccgtggcaccaacgataccaagagccaacatcaattgtccgtgcttcaagatgtcactgtgtggcaccaagttcacggcaacttcacccatatcaggcttagccaagaccgccatgtataggaagacaagcaagataaccgcaatcaacgtgacaacgattgcttcaatcttacggaaccctaacttcatcaatagcaataatagcaaaacgtctagggcagtaatgatgacaccccatagcaatggcaaaccgaacagcaagtggatggcaatcgctgcaccgataacttcggccatttcagtcgccatgattgcaagttcagtcataatccatagaatatatccaacgaattgattagtagagtcacgtgtcatttgggccaggtctttctgagccacaattcctagtttagccgccatatactgcaacaacatcgcaattaaactagacactaagatcacagacatcaataggtagtggtattgtgcaccaccaacgattgatgtaatccaattacctgggtccatgtaacccacagcaaccaacgctcctggcccactccaggccatcaacttacgcaaaaatccgccgccttgtggaacttccactgtgctgttgatttccgccaaacttggaccaccagacgcttgtgcgtttacgtctgccggatcctttactgaattttcgctcatcagtaaatatgcctccttgttttttggtacgactcattatcttactaaaagtatcttttgtaaaccgtcaaagcccgaaatgacgcggtttgaacaaattgtgaactttccgtgttttgggtatgaccccttgacaacttccaaaaaataatgtaatttagaacagttgaaaaaataatcgattattaataaacactgcctactttctacacggcggtgtaagggaggatatatctatggcagttcctgcacgtaagacttcaaagaacgcaaagcgctcacgtcgcggtggtcaaggcggacttaagacgcctgctatccacatgaacgaaaacggtgtttacgtacgtaaccaccacgtggccgctgatggttcatacaagggtaagcaagttgtttcacctaagtaattagcgacaaaaagacctctaggattcgtcctagaggtctttttttgtttcattttctaaacagtcgttgcaacaacgagcgatgcggctctatcggctcaacgccaagcagcgttgcttcatgggtttcttcagggtccgtcaccccatcccccagctgatcaacaacgacatcatatacatcagctactcgtgggcctattacaacctgatattgccgtagcggttcgttatagacagctcctgctactttatcaagtttcatcaaagcgcccgtattcgccatgctagggtcctttaaatagaagcgaagtcgtgtgacacagtgaataaccttattaacgtttcctgcaccacccacgttgcgaataatcgctgtcgctaatgaatcatacttctccatgtcacctttcatccttccaattatctacttccattttagccttagcatttgattaactcacgcaagaagcattgtcagaatgtgggtgaaatatgcaaaaaaatgccacgcatttcgaatcgagatgcgtggcattaattatttatgattacatttcttgctcaaagtctgatggtgagtacaacttcaagatcttagtaaacaagaagtcgactacgaaaccagcaatagctggcacgatgaaccaaacaatcaagaattgaacaaagttgattgtgtgcttaacgatttcagcttcagcagcgtcaaacgtaaacattgattgcaatggtgaaaccattccaatccaaccgaatccggctgaagttggcgttccttgaacgttgaacaaagcaactgggatagccgtaattgctgcggcaaccaagaaggccaaaatcataactggcttcttaaatactgaaggcatcatacccttcatagcacccaagaagatagcaaccgtcgttcccttcttgttaaccttccatgagttgatcaacaagataaccgtcgttgcaacaacaccggctccggcagcaccagcacccaaacctgacaacgtgattgccaaggcaataccaaccgttgagattggcgtgatgatgatgaatgagaaggccattgcaatggcaattgacattggcaatggttgcaagtcagtagccaaacgaacagcgtcaccaacccaagtcgtgatgtaagcaacgtaaggtgcgatagcgcgaccgaacaaagcaacaccaccaccgattacgattgggctcaagatgatagcaactgaaccaaatccggctaggtaacgtgataccaaccagattaccaatactgcaaccgcagcaacgataatggcgttgataacgtcaccggcaccagcagcaatgtaaacattaccaacttgtggggcacccgtaattgggtttacgaagccctttggtgcaacagcccacttgattgatcctgaagcagcaccaaccgcaatggccataacaccaacatcaagcgccttcatacggaattgcatagcaattgcgacaccaatcaacaatggaatgaatgatgagaacagcgtcaaaatagctgacaaatcaagcgcccattgtgccgttccgaacatcttcaagatgtacttcataacggctgatggcaaaacaccaatcaagataccttgggctgaaccagaaagtaccttgaagaagaaatcctttaactttagctcgtatgagccgtcaaaaaattcgctcgtcataatattaaattatacctttcaaaccaaacgtctctcgcaccaaatagttactcacttagcgaatctcacaacgtcaaatgagttatttgaaggaggataaacaataaaataatttcttacttaaagtaagttatcacgattagtattcaactgcaatagcaggtgtctcaccgttaatgaatgccaatgaagcgtccattgattggtgaaccatttctagaacagccttagtcgtgtagaatgccgtgtgtggtgtaaccaatacgttctcacgagcaatcaaatcagcaatctttgcgtcagggaattccttgtctgaccagtcaacgttgaacaaaccaacttcttcttcgtaaacgtccattgcgaagtctgaaatcttacctgagttcaaaccatcgataacagcgtcgatgtccatcaagttaccacgtgaaacgttaaccaagacaacaccgtccttcatctttgcgattgaatcagcattgatcatgtggtggttagcaggaacacctggtacgtacaatgagataacatcagcttgtgcgtacaactcgtccaaagtatcaacgtagatgccttcagcttccaattctgcgttacggtatagatcgtaagcaataacctttgcgccgaagcccttcaagatgttgatagcaacacgtccgatgtgaccagttccgataacaccaactgtttgcatgcgaacttcacgtccgattgttggtgcccaacgcaagtcgtgctttgcaatctttgcatccaaagcctttgcgcgacgcaacaaacgtgacatttgaatcattgagtgctcagcaatagcgtttggtgagtaaactggcacgtttgagattgagaagtcaaactcgcgtgcagcatcgaaatcgatgttgtcagtaccaacgttacgcaatgacatcttgttgatgcccaactcgtgcaaagcagtcaacgtctcgcgtgtgtagtccaattgttggtaaacgttaacagcgtcggctccctctgccaactttgctgtctcagggtccaacaacttatcagtgtagcccacttcaacttctgggtgagctgcaatccactcgttcaatgatggcttttcgtcttcgcgaataccgtaagcaaaaatcttcatgcttttttcctccaaagcgtttcttaacacttattcattataaggtaacttgtgaagaagtcaacatgttttgtggactacggcaaaacgattatcccgcattcggtactccatactttttgtgtaccggtataccactactctttattaaggaaaccgcctcacaaattttttccaaaaacccatgaacttttattcacaaaggcgtaaatattttccagaaaagcaaaaaggcgcctccacaaaacgggaggcgccttccttctaaaaagaggcagtattacttttgctcgttggcgctcgtcatgatcttatcgaccaagccgtactcaagtgactcatcagcatctagccagtgatcacgttccgtatcacgctccaattgctcgtaaggctttcctgtattgcttgctaaaatttcgttcaacttcttgcgagtcttcaaaatctcttctgctgcgatagcaatttcagtttgttgtccttgtgcaccacctgatggttggtgaatcatgaattgtgagttaggcaacatgaaacgcttgcccttagcacctgaagatgccaaaacagacgccattgatgctgccaaaccaataacaatcgtttgaacatcagccttgataaagttcattgtgtcgtagatggccataccggcattaacttctccaccaggagagttaatgtacatgtaaatatccttatctggatcttgcgcatccaagaatagcaattgggcaataattgccgttgccatttgtgattcaattggtccactgaccatgataatacgatcaatcaacaaacgtgagaagatgtcgtatgaacgctccccgcgtgatgattgttcgataacgtatggaattggtaacattatttattttcctcctgatgttcagaatcagaacatacccctattgtagacagttcgtcaaacatggtcaaacgatatgagccatcctatgaaattcctttaggaagcgcgcctgttgtgcgcaaatcgtcagccattttcgtcaacttacgtaggcggtggttaaccccagactttgaaatttcacccgatggcacatacttaccaagctctgacaatggctcttcacgatgtgccaagcgaacttccgcaatctcacgtagcttttcgggcaaacgggccaaaccaatctcgttatccaaaaactcgatgtcatcgatttgtttttgactggcgttaaccgtcttatccaagttcgcgttttcagcattcactaaacggttaaccgaattacgcatatcacgaataatacgcacgtcttccatcttaagcatggcattcgtcgccccaatgaccatcagcatatcaccgattttttccgcttccttcagataaacgatataacccgagcgacgttcaactaccttggcattcaagtcaaagcggttcatcagctcttccaattggtgagcttgctcttcatatagagaataaatctctaggtgatagcgacttgtctctggattgttaacagaaccggccgccaaaaaggcaccgcgcaagtaagaacgagccttaccttcatcagccagccattcatcaggaaccgttggcaataattcaaaatcctcaaagatgtgcaaatcatcaagcagctcatttacaccttgcacaattcgcacgacgtacaaattgttcttcttcaatttcatttgacgacgcaccgaaatttcagatggcaattgataaaattgttgcagcaatcccaaaatacgacgagctgtcgccgcattttcagtttgcacattcaaggtaaatcgcatgtttgataggcccaacgagccattcatgcgtaacaaggcggacaactctgcctttgcattgtccggattattaatttccagcatcgtcaattcttttttgacatcactcgcaaatgacataagtttcctcccttctacaattctttcgcgtcagcaatttgcataatcaattgggccacgatgtcaccatcgtgaaaggctccatcgtcacgcaattcaagcaggtcacccaaaacagggattgcaccttcgtgacgcacttcttctggatcaaaggccacttgatgtgaaacctcattccactttttccaatcaatatagtcatctggcacaataccagtattcataatgacggcatcaaccacattatcaccaacatgcttattcaaagcccgcaaatgatctgcatcagagaaatcatccgtttcacccttttgcgtcataatgttagcaatgtataccactttggcacgtgtcgcctttaatgcttcagcaacgtttgggacaaccaagttaggtaagatgctcgtaaacaaacttcctggtccgagtacgatgacatccgcattcaaaattgcgttaataacctcacttggcgcttgggcaacctcattcacagaatcaggttgtggcgtcacccaaatgtgatcaatctgcttgtgggcagccgtaatttctgcttcacctgacagttccgtaccgtctttaaacttagcgtgcaaaatcaacggttcattagctaccgggtatacgtgtccttggatgcccataaacttcgtcaacaactgcacacctgcaaagatgtcatgttccttttcagccatagcagcaataatcagatttcctagcgcatgattggccagcatttcatcattttcatggaagcgatattgaaaaatatcgataatctcttgtggcaatgtcgatagcgtcgccatgacgttacgaatatccccaggtggcacgatgttcaaatagtcgcgcaatgtccctgatgaaccaccatcatctgccaccgtaatgaccgctgtcaaatccgcgtcgaacttcttcaaaccacgcaaaataaccggttggcctgaaccaccaccgatgacaacaatcttcggtgtcgttttaaccgtaaattcttctgtcatgatcggttactgctttccttgcgacggttgatgtcacggtgatactcattaaccttccagtcgttagccaaatcttggctcaaacggtgtgcaaaggcaactgagcggtgttgaccacccgtgcaaccgaaggcaatcgtcaaagtgctcttaccttctgccttgtacttggggagcaaccacttaatcaagctactctcgcgttggtagaattcttctgcatcttcacttgaccagacgtaatcccagacttctttatccaaaccggtttgctcacgcaaggccgtaatatagtacggattcttcaaaaagcgtacatcgataagcaagtcagcatcgacaggtacaccatacttaaagccgaaactcatgacttgcaccgcaaacgtgccttcacggtcttcatctgagccgaagtgttccaagatgtagttacgcaattgacgtggcgcaaaatcatctgtatgaatcacttcacttgccatatcgtgaatttcagtcaaacggtgacgctcagtttgaattccgtacagcgtgcccttgtcgcctgacaaaggatgtgaacggcgggtttccttatagcgtgccaccaactcttcgtcagtcgcatcaatgtacacaatcttcaaatcatagtaatcattgttgtcggctgacatcttcttaatttcatcatccaaatcatcaaagaaactttgtgatcgcaagtcaatcattaccgctgcacgttggatgttatcttcatcagaaatcatctgccagaactttggcaacattgcaggtggtaggttttgcacagtaaagtagcccaagtcttcaaaggcctgaatcgcaacagttttacccgaaccactcattcctgtgacaataaccaattctttcttagccatggtttccgtcctccgtttttatcgtcctaacattataccatttattggacacgcccggctatgtggttaatcatttcgcaaacaacggcacaaaaaaaccagtccaccgcggtgaactggtttctttgattacttcttgttgcttgctgccttgcgtgcatcgtgcaatgccttcaaagcgcgcttgcgagtcttaatgtttgggctcttcatcttacgacgagctgatgccacatccaacttttcagccatgatgtttacctcactttttgttttatatattcgaataaatagaacttacaaaaagaaagtatacacggttacccgcatatcggcaaccaaaaagggcgattttattgtaccgctgctgcacgggcgcgatcacggtccataattgggccaagatattgaccagtgtatgactctggtactgctgcgatgtcttctggtgtaccagtcgcaagaaccgttccaccgccttctccaccttctggacccatgtcgatcaaccagtcagccgtcttaatgacatccaaattgtgttcgataaccaaaacagtgttaccaccatcaacaaggcgttgcaaaacttctagcaaacgtgaaatgtcatccacgtgcaaaccagtcgttggctcatccaagatgtagaatgtcttaccggttgacttacgttgcaactctgatgccaacttcatacgctgtgcttcaccaccagacaaagtcgtggctgattgaccaagcgttacatacccaagaccaacatcaacaatcgtttgcaacttgcgacgaatctttggaattggtgcaaagaattcaactgcttgttcagccgtcaagttcaacacatcagcaatcgtcaaaccgcggtaagtcacttccaacgtctctgagttgtaacgcgtaccgccacaaacttcacacgtcacgtaaacgtccggcaagaagttcatttcaatcttgatgacaccgtcacccttacatgcctcacaacgaccacccttggtattgaatgagaaacgtcccttgttgtagccacgcaacttggcctcgtttgtttgtgcgaacaaggtacgaatatcgtcaaagacacccgtgtacgttgctgggttagaacgtggcgtacgaccgattgggctttggtcaatatcgacaatcttgtcaacattctcaaagccagtcatcttcttgtacttaccaggcttttcagaattgttgttcaattccatcttcaacgcacgcttcaaaatcgaattaaccagcgttgactttcctgaaccagacacacctgtcacggccacaaacttacccaatgggaagtcgaccttaacgttcttcaagttattttcagccgcgccagtgatggtaatcttttgaccattaccttcacggcgtgtttcgggaactggaataaacttctttcctgataggtattgtcccgtcaatgaattttcattggcttcgatttcttcaggcgttccagtagccataatctcaccaccgtgatcaccagcaccaggtccgacgtcgataatgtaatcggctgccttcatggtatcttcatcgtgttcaacaacaatcaacgtgttacccaaatcacgcatttgcttcaacgaattgatcaaacggtcattatcgcgttggtgcaacccaattgatggttcatccaaaacatacataacccctgataggtttgaaccaatttgtgttgccaaacgaatacgttgggcttcaccaccagaaagcgtacgagcagaacgagacaacgttagatagtccaacccaacgttcttcaagaagctcaaacggtccgtaatttccttgacgattggctcagcaatttgtgaatcttgctcaccgaacttaacatccttgaagaaatccaattcttggtcaacaggcatttctgaaatttggccgatgtgcttgtcgccaaccttaactgacaaagcagctgggttcaaacggtaaccaccacaagcagagcaagttaattcgtccatgtaaccgcgcatttgctcacgcgtaaagtcagagtttgactcacggtaacgacggtcaatgttattcatgacaccttcgaatggcaaatcaacgtcacgcacaccaccaaagtcattttcatagtggaagtggaatggcttcaaacgagaaccgtacaaaaccatatcttgttgatcagcagtcaattcctcaaacggcacatccattggaatgccaaattgctcagcaaattgacgcaacatttctgggtagtatgaagaagagattgggttccaggcaacgatagcgccatcagccaatgtctttgacttatctggaataacacggtcaacgtcgacctcaagtgtcatccccaatccaccacagatttcacacgctcccatgggtgcgttgaatgagaaaagttgtggttccaacttaccaactgcgaaatccttaagagcgcccgtgtagtgatcagaaaatgtgattggctcgccaccaatgacatccaccgtcaccacaccatcggccatgcgcattgctgattcaaatgattcgaacaaacgggcacgtgaaccgtcacgcaaaataatacgatcgaccacgattgagatgtcgtggtacttgttcttatccaagtcgaattcatcggtcacttcatgcatctcaccgtcaacgacgacacgcacgaaaccttctttttgaatacgctcaaaagctgacgcgtgtgaaccacgcttgtgacgaacgattggtgacaagacttgcatacgtgagccttcgtcgagagtatctgtcaaatagttcaacatttgatcaattgacgtcttgacgatggtgccgtcctcagctggatctggttgacccacgcgggcgaataacaaacgatagtaatcgttaatttcagtcaccgtaccaaccgttgaacgtgggttctttgaggtcgtcttttggtcgattgaaatcgcaggactcaacccttcaatcgcatccacatcaggcttatccatttgacccaaaaattgacgggcataggcagacaaactttcaacgtaacgacgttgtccttcggcatacagggtatcaaaagctagcgaactttttcctgatcccgacaaaccggtcattaccacaaatttatcacggggaatcgccacgtccacatttttcaaattgtgagcgcgcgcaccgtgaatgttaatccagtcgttggccatatatttgcggcctccttcatgtagttttagttagttcttattataccctgaaagtcaaaaaggtgttagttataacctaacacctttctatatctattaaatttaaataagtaattattctgtatatggtttgtcattacacaagaagattttgaaccaaacgaagttcaacaaccctagcacaagcataaacaggaatacattgcgggccccaactgcggtttggtgcgccacgctcgcatgatcagttggattcacgcgcatcaacaatgatgcaattgtcgttccaattgcccctgcgaattgttgtgcagtgttaaagatggcattaccatccgcgcgctctggcaatgacaattgtgccaacccggctgtcattgatgttccaaaagccaagttacgccccaatgtcatcaacaagtagaaaattgtcattgagataactgttgcattcaacgtcattgctgaccaaactgccatgacgacaacaaacaaaaagtttccaagcaacaatggcatcttagctccgcgggtgtcgtaaagacgaccgtagattggattcaacaacgcgccggccaatgaacctggcatcaaagcaaacccggcaatcatcgtacttgcaccaagcgtcaattgtacaaacgtcggcaccgcaaagttaaccatcaagttggtaaacatgtacgtcacataaccgagcatcgcaaagcgcaaggcctttaccttaaagataccaaggttcaagaattgcttattgctgtgctttgagcgatacaagaaaccagcaaacgccgctaccgccaaaacgaatagcccgaacatgatgacatttactgaaccgtgctctagttggctcaatgcccacaagaaactcgtgaaggctaccgccagcaaagcaaaactcaaataatcgaacttaaacgcatcgttacgcgtatgatccgttggaatagtcttatacgtaatcaccagcgacaagaaagcaaccggcaaaactaacaagaaaatctcacgccaacccaaataataagcaaccactcctccaaagattggtccaaaggcaggcgccaaagagagaatcatcgtcccgaagcccatgtacttaccaatttgtgacatcggcacattttccaaaatgatattgaacaccaatggcgtaatcacgccagtcccaatcccctgaataatgcgtccaaccagtaacaaggaaaatgagtgtgacaagattgccacaatatccccaatcaaaaacgcaataatggcaatcataaaaatcatacggggattgaattttgctttcaagaacgccgacgttgtcatgaccaatgacaccatgagcagataggctgtggttagccactgcacaacgctaagtgaaatgccaaattgtttcattaaatccgggaacgtaacgttcattgacgtttccgtcaaaatacccgtaaacgccagaattcccgttccaacaattgcccaaataatctttgggtcaactgcttgtgtgtcttttttcatatatctactcccatcaatacaatacgtttagtttgtcatatttacccactcggtacaaggttccttttcaaaaccgtccgaattcacgtataatagaaatattgaaatttagttggagggaaacaggcatgcatcatccagtcgcaaagccatggtcaatcaagtggattgcccagcacatcgcatcattcattttgcttaccggtgccgtgttagcggcagcaattgctttgacagccttaattattggtatcgaagaactgattgccttagttgttgtacaacgtccaatcaacacttacacaaacgtttacggtaacgctctccaaaccgttttgtggcacttcttgattgtgttctcattggtttccttctggtcagccgtggatacattcattccggcaccacctaaaaaataagattaaaaacccgttcctgaaccacatgtgttcaagaacgggttttcattttactttagtttttgcggttgcaatacaactgtcgtggcagtcaacatcaccaccaagccaaggaacaaaccagccgtcacatcacttggataatgtacgcctagataaacacgactgattggtaacaatacaatctccgctgccaataccagcatgacaagcgtttttagccaacgccggcgcaagtagaaaaacgccaacactaacagagcgccatagaacgccacggcattaaccgaatgtcctgatggaaaagaaaaaccactctcaggaataatccgatcaaccgttgggcgtggacgttggacaatcgtcttaatgattttcattaacacggttgagccaatcacacttgttgcgatatacgctgcaatacgccaacgacgacgcagtgcggcaataatcaccacaattgctgtcaaaacaaccccagtcgccggttgcgcgaagaacgtcaccgccttaaaaagtgcggtctttgttgcactaaagtggcgaatcaatgccacgccactttcatcataagccgttacccagcttgcatgttgcatgacacccaccgtcaaaacaacaaataagaccgccgcaagcacgctaatgcctgttgcaagtttcttgtgccacatctctataatcctctctagaaaaaccttggtgaggcggtgcgatgttgcatctcaggaatcatcatgacgtgcaattcatgcgccggcacataatttatcccgctcaaaatagcttcacccacgccttgctcggcaatccgctttgccattgggacgaggcttggcaaattcgccacatcatccatcgtattcaatcgatgaatcaaataattaccaaactgacctaataattgggccggcaaatccaaagggctttgcgtcgtcagcatcaaatacaggccagccttgcgtccctcgcgcgcgacacggaaaataccatcactcgctaaatccgcctcactcaaataacgatgcgcctcgtcaatcaacactgttaccggtaaggtgtttgataacgtttgattaaggcgcaaaagagccgtcatcaataatgacacaataaccttacccaaacctaaatcatcggcgtaatcagaaacgtcaatcaccaaaaacttatgtgagctccgttgtgtgctgaacaactgcattaagtacatcacatcagttcgcatcgccaccgaagtgtcacgctcgcgttgtggtagattcagcaatttttgaaaacgggcatccgccaccaagcgggtcatgcgacgcacgattggcaacaacttacgaaatgcctcatggtcaacttcttgaccaattaaatcaaagtcatcaaccggcactgcaaattcttgttgtaattgcgctggcaaaagtgtcatatcagccggttgtggatagtgatacaacttgcccagcaattgttcatgcacagtccactcgcgaccgactttgccgtaaatgccgggttgcttcacaacattcatctgcaacttcaaactttgccaagcgtctgccaccttttcgacatcactcgcctcagttgccccgaaaaagctcgccaattcagttcccgtcaaccgttcataatcaatgaacgcattacgccccaacttcgcaacaacggcattgggcagcgtcgtatactcccctgtcggatcaatgataatcgttgattgatttgcgtctaacaagccatgcaaaattgtcacggcactggttgatttaccactaccagttgcccctgtaatcaataaatgttggcgtaaaagattgtcagctggggttgagaattcacttgtcagttgaatatctaccatcagaatgcctacttcttagcctttttgaaatatggtgcgaccgcttggacaagcgtaatccacacgacggcgaaaactaccaagccaatcaacaccccaacggtttgaccgaactcagtaaaggccagttgtgaagccaacataattggcaataattcaataattagtaacacgaaacgattcataatcataacccctcaatatctatctgtcgtagtaccagtatacaagaaaagacgccctaagatggacgccttttggaaactctttacttcacacccagcacaatcgccgtatatggtggcaattggaaacgatgaccatgttgcgtcaccttacctgctttgcacagcacttcgcccggttgcgtgagtgacacgcggtttggcttctcgctcaagttgatgacaaccgtcaacaagcgtccacccagacgacgctggtaagcaatgacatcagccggcatccccgacaatggatagaactcgcctgacacaatcaagtcacgccaaagtggattctggcgcaattgccccagcgcttggtaataatgaagcactgagtctgagttagctagttccgtttgcacatcaacaccgtcacggtcatcccccatcgccaaccaaggtacttggtcagaaaagccaccaaactcatctggcgtccattgcatgggtacacgaccattgtcacgtgacttcttgttaatcacgtctagggcttcagcttcagtcaaaccaccctgcaatgccatctcgtagttgttaattgatgagacatcgttaaagtcatcaatactctcacgattaaagttcttcatccccagttcttgcccttgataaatcaccggcacccctggcaaaaagtagtacatcgtcgctagggttttcgctgccgtttccgtgcggtaagttgcatttgaaatcagctttgacaaaacacgcggttgatcgtggttctccaaaacgttaccgaggtagccctcaatctcatggacctgcttttgcgagttaaacatgcgctcacgcaaatcggtcgtcgtccattctgaacggccacggtaccactcatccgtgttttcaacttcaatgttcatatatgagaagtcaaaaatcattgagaaatagccatctggtccgatatacttatgcaaatcctcatcaggtacaccatacgcctcaccaattgtgaccgcgtcgtacttggcaaacgtttcggccttcaactcacttaaaaagtcatcgatacctgggcggttttgccccttcttaaggaccgacaccaactcgtccggaccgtcacttggcaaacttgcccagtccaaatccttctttaagtgcgtgatagcatcgatacggaacccggcaacgcccatctccaaccaccaattaatcatgtcgtaaatgtcacgacgcatggctgggttttcccagttcaaatcaggttgctctggcgcaaaactgtggaagtagtacgtgccaggttcatcgggcacttcggtccacgttgacccaccaaacagactacgccaattatttggcacttgcccgtcagccggcgtcttgaaaatgtagtaatcacggtacggactctgcttatccgctaacgctgcctggaaccactcatgttcgtctgatgtgtgattcacgaccaagtccatgataattttcataccacgcttgttagcctcggccaataattctttgaaatcagccatcgagccaaattgtggatcaatatcttgataatcagagatgtcataccccatatcgaccatcggtgacttgtaaactggtgagacccaaatcatcgtgccccccaaatcacgaatatagtctaatcgtgaaataatgccgcgaatatcgccaatcccgtcgtggtttgaatcttgaaatgaacgtggatagacttgatacacaacttcgtctaaccaccatggttgctctgccataatactattactcccctaaaaaaatagttatttgcaggtttaatataccgaaccgctacgcattcatgcaacaaatcaccctcattttatgaaaacgtttgcatttagatttaatccgtgcgaaagttaatgtcataggagggactattgcacatgacattaaacattccaacactgacattaaacgacggtcatccactacccgtactcggacttgggacttaccaaatccgcggtggcgaggggatgcaacaaattttggcagccattcaaagcggttaccgcttgattgactcagctaccaactacgacaacgaaggtatcgtgggcgaagcaattcgtcgctcaggtattccccgctctgaatttttcatcacgtcaaagttgcctggtaagtaccacggctacgaagatgctttgatggcggtgcaagaatcattggcacgtatggggcttgattacttcgacttgttcatcattcactggccattacctaagcgtgataagtatgttgaagcttggcaagccttggtcacggcgcaaaagcttggtttgattcgatcaatcggtgtgtctaattttgaaccggagcaccttgaccgcatcattgctgaaactggcgtgacgccagccgttaaccaaatcgaaatccacccctactgggtacaagagcaaaacctactcgaaaatgagaagcgtggtattttggttgaggcttggagtccacttggtcgtggtagcgcgtcaatgcgtgaacaagttgtgattgatatcgccaacaagtatggtaagacaccaagtcaaatcatcacccgttggcatattgaccgtggcatcgtgccaatcttgcgttcaacgaaccctgtgcaccaacgcgaaaacgctgcagtgttcgattttgcgttgaccactgatgaaatcgctgcgattaacgggttgaataagcctgacggtcgtattgatggtcaagatccaaacgaatacgaagaatttgaataacaaacaagccgacctggttataaatcaggtcggcttgttttatttctttaagatatctgcgacacgtttttgtagtgcgggcacgacgtccgtttcaaaccacggattcttggcaagccagatgttgttgagtggggatgggtgtgccaacggcaaataccgtgacccaaaatccgtgaatcgatgcaccacactggttaacgattcactcgctttgattggcaaataatgctgttgcgcatactttccgactagcaaaatcaattcgacatccggcatcgtatcaagtagtcgttggtgccattcacccgccacaaatttgcgtggtggtaaatcaccactcttccccttgcctggaaaatagaaatccatcggcagcacgccaattaaaccagagtcgtagaaggttgtccggtcgatgcccatccactcacgtaatcgatcaccacttttatcattgaacgaaatcccagtttgctcaacaactgcgcccggcgcttggctaataatcaatattttcacagttggcgcaatcatataaattggctcaagtccgcgctctgtaaacgacgcattacgtggatcagccattatttcctgttttaaatccacaaccattacctccaaaaaaatcggtactacatcaattgtagtaccgattcatattaactgtgtttagaaactaaacttgttagcattatcttccttaatgtagattgacttcaatccttcgccttcaaggaactcacggaatggcacaagcgcttcagcttcgtacttttccttgtatgccttgacgacgtcttcgctgtacaagtttgtatcaagcttcaacgtttcaactggaattggacggtccttggtaatcttcgcatccacaacgacaacgcgaccttgcttgtagtaatcaactgcttcttgcataacgcggtcaatgtcttcaatgcggttgactgtcaaaccaatggcaccttgggcttcaccaaccttggcgtaatcaacatctgtaaagtcgaccccgaagttgtactcgttagtgtcttcatacttgttcttgatgaaaccgtactcggtgtttgtaaagataacgttaatcattggcatgtcataacgcacgctcgtaacaacatcaggatacgtcattgagaacgcaccatcaccgatgatgttccaaacttgacggtctggataaatgttcttcgcaccaataccacctggcaaagcaattcccatcgttgcaaataatggtgatgtacgccacatttgcttagggttcatgtgcaagtgacgcgttgacaattgcgttacgtcaccgacatcagttgagaagatggcatcttcatcagccaacttgttgatggcattgtagacttggtaggcttgcaaaggtccttctgtcttttgctccaacttgttcatgtagtcgcgccagttttggacattcttgatgttcgcttgccaccatggtgtatcagctactggttcaaccttggccaacaacgccttcaatgattcacccgcatcagccaagattgcgacatccgtttcgtgacgcttaccaagcatatctgggttcgcatcgatttgaatgaacttcttcacgttacggaacgttccctcaacttctgagaatgggaagttcgttccaatgaacaataccgtatcggcctccaaaacagcttcattagctggcttccaaccaacacggaacgctgaaccagtcaatgcttcaaagtcccagttaaagttatcgaagttctttccagtcgtaatgactggcgccttaatcttgcgtgatagttcctcaactaaatcaccgtgaccttgtgttccgaaaccggcgtagataactggacgttctgaagccttcaaaatttcgactgcttcatcgatttcttccgcttcaggcgctactggcttgtagcgcttgtacttagttcctgaagagtacaaaggtgttgagtaaattgactcagcatccaactcagcgaaaccaaagtcagctggtacttcaagcactgccacaccgcgctttgaaatggcggtacgaattgcatcgtccaccaagtgaggcaattgctcagccgtcgctacacgacggttgtacaccgcaatgtggtcgtacattggattttggttcaattcttggaatgaatccatgttcaattcacgcactggctttgatcccaaaatggctagcacggggatgtgatccatgtacgcatcgtacaacccgttaatcaagtgcgtagcacctggtccaccagacccaaccgttaccgcaatatttcccccgaacttatattgcataaccgcagccatcgcaccaatttcttcgtgcttaacttggataaacttcaccttgttttctggatttcccatcgcattcatcaaaccacttagcgtaccagaaggaataccatacatggtatcaatcccccagccttccatgaccttcaatgctgctaatccggcagaaatcttcttatctgacatctttcataaacccccatacgcatattcttgtaagcgctttcttgagtttattctagtcttttaatttatacaaagtcaaattatatatttcaacggcgcgttaaatttcatgcaatacagccattgttatcaatgatacttcccccaccaagtaataccaagccagccaatagtcaatccagacacaatgctacccacagccgcgacaacaatcttctctgtcgagttttgtggttcagcttcagttggtgctggctgtgatttcgtaacaacagttggttcttttaccgtttgcggaattgtcgccgcttgtatagccggcttgtcatcagctttcgtcaccacagccggcgccttgcttgctacgactcctgccgcaacgattggtgcctgtgtgaccagattttctgatttggttgcctgcgttactttcacaggtgtagttctaaccacctgtgctttaatttgcttttggggtgcttccggtcgcataatcccttcagttaacttcactaccgttgtatcccccacaggtgtctccttaaccggtggtagtgacacagcgcctggcatgccttctaatcggaaagtcacgtcataccaattgtcgtagacaaaacttcccgttcgaaaatcgacgtgcatattttcaatgaacagcggcttcgcaacttgctcagcggttaaatcgaattcgtaggtcataatatattcagatccaaccagattagctgataattgtcgcccactcgtaaacgtaatgctgttaggaccgtaatcggctggcactttagccgtaatcgtcaaaatacccgtgccgtctttaccaggctcgaacgttgctgccgagttaatgtagttacttgccacagaggtcaagttgctaccatcccccttcaacacggccaacgtcaccggcaaacgactcgattgcgcaacttccgttttaaccgtgaacggttgttctactgtgccactaaaacgtttgttaataccacttgctgccttgttatcccaagaaaaataagtagaactatctggtttaaccccttgcaacgtcacctgaccatttaccgttttaattggcgcaccgtcttgttgcaagtcaattgcgttacccgccgtgtctttgactgacaatggcactgttgctgttgtctcaccgttcttcaatccaatggctgcattggtgactgattgaaatttcgcattcagataagacagatcctgtaagttttgcaacgggctcaaatctgaaacgtggttacgcaacatattcaacgacgtcagcttcgttaatcctgccagcggcgccaaatttgcaacttgtgcatttgaaaaactcaggtcagtcaaatttgtcatctgcttcagtggtgttaaatcagcgactcggtccttgctaaagttcaaactttgcaactggcgcaatccagccaatggcgttaaatcagaaatttgatcgttaaaatcaattgataacgtcaccagcttcggcatgtaagaaaagatttgtaccgcattattcgttagccccatttgtgaaaatgttgcttcttccagatttaccaacgaccgtagcattgaaatatcgttactgcggttattcccaatcgacaacgttgttaggttcgtcagtgatgcaatcggcgtgtaatcggttagctgatttgatcctaccttcagctcggtcagttgtcgcatccccgccaatgcttgaacagaggtcaacttattaccagcaagtcccagatacctcagtttgggcaatcccgtcaccggtggtaccgtggtcaaatcattgttctgcatttctaattcttcaagcgacgttaattgtgccaacccagccatcttgtctggctgcgtgccataatcatccgcaaccaaattcaacgacttaactggcgtaccagctaacagactcaaatccggcataatctttgctttattcattcgcaaactaaggttggtcaggttgtgcaaattctgcaacggtgtaatatccgcgatagtattgcctgttaaatcaagcgcctgcaagttggttgcaaactcaagccccgttaaatcagtaatgccatcatacgttaaattaagttgcgtaattgtcgcaacatttgccttcgtcaaaggcgtccctttacccaaggcagcttgcagtgccccacgcaatgctgcatcaggcacccaacttgcgacatcatcagttgctgtgtttgctaatgttgtgtccgcctgcaccggcatattacttgtggttatcccaacaatgctaccaagcagtatcccactaataacaacagcatgttttattcgttcgattgttccttaccttcacattcccataaacttattctgcgtaagtccagtttactggaatgtgagatgctgaacaaaaccaatttttaacgtcacgtaaaacgttgcccgaagtttgggacaaaaatagccgttcgaatcatcggactcgaacggctaaagcaattaataacgtttcagaagttgtgcaacaccgattgccaaaataccaatcagtgccccaacaataggaagtgtttgtagtcccgcatgtaccatcaccatgttaccgacaaacgatccgccggcaataccgaagttcaatgccgacacattcagcgcagaagcgacatcagtatgcgctggcgctaattcagtagtcgtgatgataatgcgactttgcaatgatgcattacccatgaacgccactaacccaagtagtgcaacaccaagcaaataccagccagccttaggcagtaatgccaattggatgctttgaacgaccgcttgcgctaagaacacgcccatcagaatgtgtagtgactggcggttagctaatcgaccaccaatcacatttccaattgtgacaaagacaccatacaatactagcacccaaacaacactagtcgttgaaatgcccgttacttgttggagatatgggcgaatgtacgtgtacaacacaaaggtcgccccgaacccaagcgttgccatcaagagtgttagcgaaattcgtggttgtcgaataacggtaagaattcccaacaattgattgtccgtaacagtcggcgctgccgactttggcacttggattaacacacccagccaaccaattaagcccatgatgccgaccaccgcaaaagttgcacgccagccgacgacatcacctaagtacgtgccaaatggtacaccaaagacagttgcaacagtcagaccgccaaataaccacgacgctgcttcgccttttttatctagtggtgccatgtttgttagatacactgatgctgtcgcaaagaacacaccgtgcacaaccgcagtcaatgcgcgtgtcaccaacaaaagaccgtacgaaggcgcgatagcagaagcgacattcaatactgcaaacgcaaacatcaaccacgtaaacaagcgacgccgagctacccggccaacaaaactcgttgcgattggtgcgccgacagcctgtgcaatcgcatagccagttactaacaagccaatcatccccgtcgagacgtgcatatccttagcaatatctgtcagcatccctactggcacaaattcagtggttccaattgcaaaggtcgaaacagccaacgcaatcgcaattttataatatttagtcatctcaaaaacacctcacataaagtagactggaaatgtcggaggtttaaaacctccgacgtgaccaagtcgcccttatcaggtgcgtacttggtcttgattcctggctaaggccaggggtcttagaccaatagttgctgtggtaaagtaaccactttaccgcattttccagcataacaccactctgcaacaaaaaaagacagcattcacaactgtcttttctcgtaaatcttaaatcgtcactaactgaccagatccattcgtcgcatcaaacacatacgtttggtgcgtctcttgattggttgcttgaccaccctttaattgtgaaccatcagcaccaaagtaacgtagttcaccgttaatcgtttgcaaaccagtcaccatgcgaccattctcgtcaaagtaataccacttgccattgtgataagcataatcatttttgacctcagcgccgttggttccgttgaagtagtgcaccccatcagcatcataaacaaagtcatccttcacttggtgattttgatcatcgaagtacagcgtatcttggttaattgtcgtcatgccacgtgccagattaccattttggtcagcgtacaaccagtggccatctgtatccaaaataaattggcgcttaatcatatttccattaccagccgcatagtaatgagcctgaccgttggcatcacgcactaattgggccttcgcttggacaccattcgaaccaaagtattgatcattaccatcaaccgtcaaagcttggcttcgaatcacattcccatcagcatccacgcggaatgcatttgcttggtgatcagtcacatattgattaacgaccagcttaccgttcttatcgtagtattgcatgttcccatcttcagcctcaacaaacgcatccgtcaacgcaataccatttggcaagaagaagtattgactaccatggcgggtttgcttgcctgtgaccattacaccattctcatcaaagtagtacaactcaccattgtcatccttgataaacgcatctgttgccgctgacccgctcagtgtttcgaagtgataaccatccgctaacttgtggaaaccagtcatcacaggcttgcctagcatttggttcggcaaattcgtgttacccgtattagccgttacgcgataatagctattattacctgcgtcacgtagcacatagcccgcgccacggccttggattgccgtaccattaagatacttagcggaccattctttaatcttcactgagtcatcaatcggcttacccgttgaaacttggtttgtcgtaaacaaatcatggtacaattcacgcaacttagtcaagaactcaccaccatattgcttttggtactcaccaccaccacgagtgcttgtgacatacatcaagtgttggatttctgaattcttgtctggttcacccatattattcgttcgagttacttgaaccaattccttgcctggcaaggcgtaaagctggtccggcacaaagtcagccatcacttgaataccatttgcgtggagtgccttaatcacatcacgcaaatcattgtcatcaccgtacttagttggcgttccaaatcccaggtcatagcggtccgtaaaggcatatccgttttgaataattgaatccaagaatgtgccgtccgttgatgaacgatattgtggtgccaattgaactgatgttacgccccaatcagtcaacagatcggcatgcttagccaaaacgacatttgtgtattcatcgtgagtcgttggcatcgcttggaagtttgagaatccttcaaaaatcacctggctatctagcgcagcatttgaatggtaagctgatccatcagtcgtcgcttcggtgcttgcagctgttcgggcatcttgtgttgcgctagcgccaacgggtacccacattgccaagaaccctgatacttgtggattcaggacaccgtaaacgtctttgtttgtgaaaatcaaatcaccattcgcatccgtgtaacgaattggcgcgttatcatcgttgtaaactgccaaaccagttgccgttgtcataataacggcacggaatgcttggttcgcgtgcgcgattcccatgtgcaaaacaacctggtcactatcagccatcttcaaatcgtgattattactgataatcaatccgacaccttccgtacgggtttcagcggttccagcatcgttaaccgtcatcgcccccttaccaaaacgaacactcgtcaggacatcattcttgtcgaccgccatggtttgtccaccagccacatacttggtacgtgctttcaacaaggcatcaatggcatcaaagtatggtgacttagtagccatgtattgaccatcgtctgtgtacaaatcaccatagtacacgcgtggaatcacatctttattcgtcagcaacatcgcgtaagcagacggcatgttgtagtgcgtgtattccttaaccgccttcttttgatcagcattgtaaatcttaaacgcttcatccatctgagcctgggtcggcatcaacccattaccggcttcagggtgcaacttagtcacaatttcagcaatcaccgtttgtacttcactgtcgtgagcacgcacaaacgagtaactaggctgagcttcgttttcagtgttgtcattagcgcgatttgttaagtagaaatccaagaagcgatccatcttgccacgttgtgcatctgactttgttaatgaccaaatcaattgggtatgcatgtaatcatccatcgtcaattggtcgttaccgtggtcattcatgtaggctgggtcgttatgactccaatcttccaaaattgacaagtgctgatttgatgttgcatcatttgtcgccataccgtacgcttcacggaaatattgtgcggccaattgcaataggtcagcatcaacgttatcgacagcgtcaacacgaatggcatcaaaattagcatccggatcgttagccgtgattgaaccaaaattcatcaaatagtatagccagttaagttgctcagcttgtacctgtggatttgagttatccacgtcattggctaatagtaattcgtagccacccaacgaatcatcaatgtggtacaaacggtcgccagtttgattagttggcgtacggttcatcaaacggtaatcggagttagcatctgtatctgaattattttcaaatgacagcgcaccaccttgtaagtgatcatcattttcgtcttcactactcttattccattgcggttgcgtggcaacgaatgctgccatcaattcatgtagccagtccgttgattgcttgaccgtaatctgacgctcaatagccgcttgaatggcatcagctgcagcggttagggtagcttccgaatcggctgcacttacagacttagttgatacctgcaaggcatcattcatgtaattcacataatctgcttgtgtttgcttcgttggccaccacgtttcaatcaatggacggtactcggtcggcgtcgattcacgccacgttacaccgttatccaaaatatcatttggacgataccatgtatcagctgtcaaatagcccgccatgttgtcaaagtcttcaggcgttgtcccatgcgctgcattgtgttgtgcattctcagttggtaccggttccaattcagggctaaatgtaggatcagacgtcggtgtcgccacacctgtctgatcatcaaagtacatcatcgtaccgtttacttctgccgcaagaccttttagcatgcgaccttggtcatcgaaattatacgtttggccatcaattacttgaatacccgtgacgcaattcccgtcgttatcaaaatagtacgtgtctcggtttgatgtttgaccaaaaccatttgtgatttcatagccgtcggcatcaaagccacgcacaaccccgtcgactacttgcgtctcagttagtgcacgtccttcttgaccatcgtagtaagcttgcttgccatcagtttctcgccaatcacctttcacttggtggccatctttgtcgaagtagacgttaaacgtgtcaatcagttggcgtcccgttagctttttaccgttacggtagtaaacccagttgccaccttcatcatgataaccatcagtggtagttgcggcgattgatgctgacgccgaactagcggcagacaacatcgtggcggagcttgctactgatgatgacactgaactagtttgtgatgatacctcactagccgatgatgatatggccacattgttactatcaactgacgccatcgatgactgtccaaccactgtagaatcactcagactagtaacactatcaggtgcctgactatctgttgtcgtttcattctgtgtgacctcgaccgattccgtcggctgcaggtttgtttgatcagcttgaaccggtccagccataatcatcccgataaacatggcaccggctgctacccaaaacttacctgccttgtacatcttttttctaaacttcgttgtgtcgtattccaaaacaatgtccccatattctatttgataatccccaaggccttggttctagggatagaccttaacgccaaatcaaataccctgtcaattttttcacaagttgaagatagaccactcccatttcatttatatcgttaaccaatatctaatgaaaaactactcaccccttaattctagcaatctcaacccacatgcatcttgagttattaattacaaattaattggttttgtattttttatttatttttaaaacattcatcaagttcacaaacaaaacaaaaaaagtgatgacaactcatttgccgtcaccacttcctacgtcattggttttacttaattcgaccgccaataattggcacgttcttcaagccatctgttccaaccaaagccagaacgaagataactgcactcacggcgtagtgaacccaagttacactgtggccgaatggcataagcgacaaccctagtaccacaacaatcatcttccagccccaataattgaggccgatgtcgttgaaacgtcgtaccatcaatgaaagtgatggtactgcaatggcaagtactgataccaagaacaatacgccaacagcagtaagacctgtgttatctacactcgctgatagatgtaccaataagttgttgctgaatagtgccaaaagcaacgcaatcattccaagccaaacagcctgccacaacacattcaagaaataatccttacgtgttgtgcgacccttaaagtcaaagatgtgcttccaaaacccttggaatgctgctgtcatagtcgtcattgttaaacccctccaacaatctaaaaacgaatagttttgatcatcaaggtggaaactcccttatctccatctgacacagtaagtatattccttcacaattagtcctccaaataataagtcttatatttcagacttttcatgttttcatgataatcgccaagaatgcaacaaaaaaacgcgttcgcaatcgaaattgcaaacgcgttttttgtttttggattcgtttccaatccagaaagtgaaaatcgaaagattaacgctttgagaattgtgaagccttacgggccttcttcaaacctggcttcttacgctccttcatacgagcgtcacgagtcaacaatccagccttcttcaaagctgcacggaagtcaggatccacttgcaacaaagcacgtgagataccgtgacggatggcaccagattgacctgagaaaccaccaccgtttacgttaaccaaaacatcgtagtttcctagagtttcagtaacgttgaatggttgtaccataacctcacgcaagttagcgaaaggaatgtattgttcagctgaacgaccgttgatcgtgattgcaccgttaccaggtaccaaacgtacgcgggcaacagagttcttacgacggccagttccgtagtattgtacttgagccataattaactattctcctttcgttaaattaaataaggttagtgatatccaacacttcagggttttgtgctgcgtgtgtgtgctctgaaccagcaaacacgtgcaacttcaaaccttgttggcgaccaagagtaccctttggcaacatgccgtgaactgaaagctcgatcaaacgttgtgggttcttctctcgcaagtcaccagcttgacgctccttcaaaccacctgggtggtttgagtggtggtagtaaatcttgtccgtagccttcttacccgtcaaagcgaccttttcggcgttgataacgataacgttatcaccagtgtcgacgttaggcgtgaaagtaggcttgttcttaccacgcaagattgatgctacgacagttgacaaacgtcccaatgcaatatcagttgcatcgatgacgtaccacttgcgatcgatctcacctggctttgccatataagttgtacgcatggaaaattcctccaatattctgtttgtttactttaccaataattaaaaaagtcgtaccaggacattcccattgcggtgtggtaaacaataccgagatttatcttaccttttttctgaccaaacgtcaacggcaatagccctcggatttagcaaattcgttagtttttggccaatctgattaataatcaaccgacatcaagtaaagaccttgagctggggccgtgaatcgcgcttgttgacgatccttcaccgcaaataagcgttgaatatcatccaccggccgtgagccattaccaatctccaacaacacgccgaccatgatacgaatttgattgtacaagaacccattacctgagaactcaaaccaaatttcatcttcttccggcttctcccacatcttagcggagtaaaccgtgcggactgtcgttttttgttggaaccccgaggccacaaaactcaaccaatcatgttcaccaacataatcgccgatggcttgctgcatcaagctcgtatcgatacgacggtgccagtgaccagtgtagttacgcttaaacggatcgatgaattcagtcgttgaaagacgatataggtacgtcttgttgtgggcgctaaattgtgcgtggaaagactcatccaccttttcaactgacttgataccaatgtcataagggagcatcgttgaaagccccttacgcaccgcctcattcggaatatcaaaaggcaaatcaaaatgtacgacttgccccttggcgtgaacgcgcgcatcagtacgccctgatccttggacacgaatatgctcggtcggatctttagccatcttgttaacgactttttccatctcaagttgcacagttcgcttgccaggctgaacctgccaaccataaaattctgtgccatcatacgaaattgttgctttgtatcgtggcatctcttctcttctttctaaatccagcgcgttgcaattaagacaacggcaaatacgataaatccaatgactgcaaccgtatcttgcttgccccaagtcaaaacacggtacttcgttcggtgatcaccaccacggtaaccacgggcttccatggcatccccaagttcaattgcgcgcttaatcgcattaatgaacaatggaattagcaatggtacaaacgccttaatgcgactaacgatgttaccttcgttaaactcgacgccacgcgcacgttgcgcattcataatcgtctcagcttcatccatcaacgttggcacaaaacgcagtgcaattgatagcatcaacgccaattcagcaacggggaagcctaccttcttcaaaggtgccagcaaattctccattgcgtccgcaactgctagtggttgtgttgtgagtgtcaaaatggttgaaaacatgataatcaagacgaaacgcacgaacacttcgatactgttaatcacaccgtccgtggtaatcgtgataatccaccagtgccagagcacgtgaccagtttgaacaaagaataattgcaaaagcgttgtgataaacatcaagaacaacaatggtcgtacaccgcgcaagaagacacccacacccaatccagttagggtaatggccatcaatgtgaagattgctgccacaacatagccagccacattattggcaaagaaaatcacaaaaataaacgcgatacttaagactaactttgtgcgggcatccaaacggtgaacccatgattcacctggcatataacgtccaatcaagaggttattaaacatgcgcttcccctcctaattttgtggccaattgatcagccaattggtcaatatccaagacattctcaagttgcaaccccttatcagcaagttgatctgcaaactgcttagcaatcggcacatcaagctgcttttcatgaagccaatcaacatccgcaaagacttcagtcggcgtcccttccttcacgacagttccaccttcaaaaatgaccacgtgatcagcgtactgggcaacatactccatctggtgcgtaatcaaaataaccgtcatgtcacgttccttttgcaaacgcgcaaacaacgtcatcagctcttcttgcccggctggatctagtccggccgttggctcatcaagaatcaacaagtccggttccattgccaaaacgccagcaatggcgacacgtcgcatttgaccaccagacaattcaaacggtgaacgctcatcgaatcgttcagccatccccaccgtacgtaaggcacgttgggcagcttctttcgcttcagcttccgacttaccaaagttctttgggccgaacattacgtctttcaagacggtttgttcaaacaattgcgcttcagggaattggaaaacaagtcctacgtgagcacgcatttggttcagctctttcggctttgttgttggcacgatgcgctgttcaccaatcgtaatttcaccagccgttggaattaccaagccgtctaagtgttgcaccatggtcgacttacctgaaccagtgtgaccaattaccgccgtaaactttccttctggcatggtgaagttaacatcatgcaaaccaggcgtcgcgaatggcgtgtttaattggtacgtaaaacctacttggttgaaattgattgccatagccaatccaccatcccttcagtcgttaagtatgagtcgggaacatcaattccacgttcacgcaacttttcctttagttgttctgcaaaaggcaccgccaaaccgaattcacgcaacttttcagcgttggcaaaaacatcctctggcgtacccgtttgcatcaaatcaccgtcgttaatcacgacaacgcggtcagcgctcgccgcttcttcgatatcgtgggtgattgaaagaaccgtcaatgcatcaccaagttgacgcttcaaatcatgtaccagtgcaatcatttcgcgacgacccttgggatcaagcatggctgttgcttcgtccagaattaagatttgtggttgaatcgcaagaacggatgcaatcgcaacgcgttgcttttgacccccagataggcgcgctggttcgcgatccgcgaacttagccatgccaaccttctcaagcgcttccgcgacacgtggcaccatctcctcgcgtggaatcccacggttttccatcccaaatgcgacatcatcagccaccgttgcgccgacaaattgattatctggattttgaaagaccatccccacaaggtcgcgaatcgtccacatattatcttcgttaactggcgtaccggtaatcgtaatttcacctgccgttggcgccaacaaatagttcaatagttttgctaaggtcgacttacccgacccattatgtccaataattgcaatccactcgccttgattaatcgttaatgagagatcgttcaaggctggtgtctcgctgtttggatatgagtacgtcacatgcgacaactcgataattggcgtcatgttcacgccccccttacttattttttgctacttaccataataccaaactcgacctatgttttgtggcgtttggtgcaatttgtcgggtacaatagttttgagaggatttacatatgtcagatatcgatttaagtcgctcagccgactaccgtaacgtcacggacttttttaaaggtcactctgatgacgaaataaaagccgccttagacgaacgtcgtggcgacatgattaccatcatgcaaaacctaagtcatgatttcaacaaagcatctgccgtacgtaacagcaatgcgtttggtatgcgcaaaatcattttcctaaaccccgaaaacccagcgattcctgattcaaccgaaggcatcaagaaatgggatcgtcgtgggtcactaggcacccaaaactacgaacacattgagcatcaccgtgtgaccgactatcaagctttgtttgataacttacacgcagatggttataccatttacgccgtggataatacacctggctacgatccgcaatcagtgtatgatgtgcaattcccaacgaagtctgctttcctatttggtgaagaaaaacttggcttagcagatgacttaattgccgcagctgatgccatgatttacatcccacagtatggtagcgtgcgttcaattaacgtcagtgtcgcccatggtattatttcagcattctatgcttcacagcatatgtaaaagagagcacgatgaatttactcatcgtgctctcttttcgtttactattacttcttcaagtcgttgtaacgtgactcgtgcttaccgtacaagctacgtccaagcgtcttctccaagaatggtgttacccagtagtccaaaccgaacgtgcgacctgaaccgttcataacagccaatgaagcgaacgtcaacaaaaccattgacgttgtcgctgaaccagcaaaaatcaataccaagcccaacacaaaggcaacgaaaccagcaattgacgtcaaaagaccaaaggcaatcaaccaaccaacaaccgtggcaatcataccaatcgtgcctgaaactgatgaacccgcagaaatccacaagataccaacaacaatacgtagtggcacagtccacaaaacgttacccatacgtgacgtccaaccgtagaatggcgtacgaccatttggcgtacggaagaactcgtccatcaagtagtggaagatgtggtaaccactcgtgatttgcgcaaagaagtacaagttaatcacgtgcttgaacatgttggcaaagaagccagacaatggcaaaccgttcttaccaagctttacgctaccaagttgctcagcgattccaaccgtgtagtgtgcaccgattgaaacagcatatccttggtagtgacccttaaaggccttacgtgaacccttacccaacaaatcgaagatgatgttaggaacagccgtgttagcagctgattctccaccttcaaccgtttgtggcgtccaacctgaacgtgggttgtcaggaatcgtacgagcaggctcttggtaggccgccacgtcaccaacaacataaatgtcttcctcacccttggcgcgtgagtagtcatcggccataaagcgaccagcaggtccttgttccaagccccactttgagccttgctcctttgccttaacaccagccgtccaaaccaatgtttcagtaggaatttccgtaccgtccttcaaaacggcagcgtgttccttaacctcaacaacaccagcagacttgcgcatgttaacgccgtgcttgatcatgtattgctcgcccttgtcagcaagcttacggttcgtcaacatgttcaaaattgttggtgcagcttcgatcacgtcaatcttaatttctgattcgtccaagttgttagcttcagcaagctcacgacgttgctcaatcaattcaccggccaattcaacacccgtaaatcctgaaccaacaaccgcaatgcgcaacttagcttcgcgctttgcaggatccaactccatggcaccttcacgaatgacttcttcgatgtgcgcacgtaggcgaaccgcttcttcaaatgaccacaacgtgtagccgtactcctcaacacctggcgtaccaaatgtattagtcgtaccaccagttgccaagaccaacttctcgtaaggaatatctccttcagaagtcttaacaatctttgcttccttgtcaatcgtatcaaccgtggcagtcacaatcttaacgtttggttggcgcacgaacaacgtacgcaaatcaaattggatgtgctttggctcaacacgcttcgttgcaacttcatgcaactccgtcatgtacgtaaagaatgaatggcggtctaccaaaacaatttggtaatccgtgcccttcaatcgcttagccaacttgcgcgcagtaaatacaccagaataaccggcacccactacgacgatgtttttattagccatatgaaaaaatctcctcagtatcccacaaaaaatgtaattaaaaataaatcctcaaataattttagacctgcaaagtggatttgtaaatgaattcactatttttttgtaaataaaaaatccgctatatcacgcctttcacagacattataccaatcaatcccttgttattcgtgcatttatgctcaactatttgtgcgaaatataagacttttaatagcttctttaaggtacaaagacgtgtcccgaaaaacgggacacgtctttgttttttaattattcaaccatcataccagcatgaatcttatcgatattccacttaaccatgtcgtagtaagtgtcaccctgtgttcccttcttagccaaagaatccgtataaatcttttcgtagattggcaaaccagtttccttagaaaccttctccattgacttaggtgaaacagaactttcaacgaatagtgacttcacgtcagactcgttaatcttcgccaacacttgcttcatttgctcaggcgttccctgtgattcagtgttaatttcccaaataaacgccggcttgatgccgtaagcctttgagaagtacttgaaagcaccttcagacgtcaccaacaaacgcttatcttctggtacatccgcgaacttacgttgggcttcctcgtgcaaggccaacagcttcttttgatatgctgctgagcgcttttcaaaagcagctgcgtgttcaggatctttttccttaagaacagccgtaatcgtttgcacgtacttgataccgttactcaaatccaaccatgcgtgtggatcagtttcttgttccttaccggcagccgttagatacattggctgcactagctttgatgccgcaaatacttctttgccatcacgcttgttagccgtttccgtcaacttcgtaaaccagccatttccaccagtttctagattcaacccattgtggaaaataacattagcttctgtcgttgctgtaatatcggcggtcttaggttcgtattcgtgcgggtcagtaccacgcttgacgatgctgtataccttaacgtcatcaccaccaacttgctcaaccatgtcttccaaaatcgaattagttgttacaattcgcaactcaccactagcctcagccttttgatcatcacgttgtgagacgaaccacgccagtcctcccgccacaacccccaatgcacctacagtaatcgcaatcttcttaaacactttgcttcccccacttagtcaaaaatccttgtttcggcgacacgacaaacgatactaaaaacataattgctgccatcaacacaatagctggcccagatgcccaattcattgtgtatgacaggtacaaaccaataactgatgcaacagccccaactgatgccgcaataactagcatccattgcaaacggttagtccacaagaatgcggtggctgctggcgtgattaacatagcaacaatcaggataatcccaactgtttgcaatgctgaaaccgtaaccagcgtcagcaccaacatcaaaccatagtgtagatacgccgtttgcaagccatacgtctttgcaaacgtttcatcaaatgatgtaatcaatagctctttataaaaaatgacaacaaacagtacaacaatgaccaacacagccaccgttgacatcaaatcacgatcagacaccgcaaggacgtttccaaacaaaatatgatgcaggttcgttgatgattccgccatcgaaatcaagatgaaccctagtgcgaagaatgctgagaagacaatcccgattgcggtatcatttttcagcttactattcgcagcgactgcgccaatcaataacgccgcaatgacaccaaatgctgctgcaccaaccatcagattaatacccaacatgtaggcgactgcgactcctggtaggacactgtgtgaaatggcgtcacccatcaacgacataccccgtaaaataatgaaactaccaataatccccgacatgacgccaaccataacagacgccaacaaagcgctctgcaaaaagttatagtgccccagtgccgctaaaaattctccaatgctggccatccgttacgccccctcagatttattaaacaaaattgcacccaaatctgctgaaaatgctttttgaacgttagcttggttgtaaacttcagcaaccggcccgtgcgcaattaccccgtgattcataatcagcagttcatcaaagtatttcgcaaccttattcaaatcgtggtgcaccacaataattgttttgccgttatcacgccacccctttagtacacgcatgatatcctcttcggatttcatgtcgataccaacaaacggttcatccaaaataacaacttctgcttgttgcacaattgcgcgtgccacgaacacacgttgcaactgtccacccgacaattccccaatttgtcgattcttgaattcagtcaaatgtacctgtgctagggcttcatcgaccaattcacgttctttctgcccagggcttttgaataatcctaacttgccatacgtacccgttaagaccacctcaaaaacgctgatcggaaacgttaaatccagcgccgcacgttgctcaacatacgcaactttacgacgtaccattttaattggccgactatcgattgatgcgctccccgtacgacgtaccaatccaagcgcccccttaattaaggttgatttacctgcaccgttcggaccgataatacctgtaatcttgcctgggctaaacgcaacagacaaattttgaaaaactggggttgctgtgtaagcaaccgttaagttatcaatatgcaacatcttgttccctcctcattcaatgttgttcagatgagtttgcatctcatcaacctcacaagattatccgattaatcggaacaagacaatagtttttctgcgattgaaaatttttagtaatagaataacaatattttgtcatgataaaaagttaactatcaacaccctgaacaaagtaaaaaacggccctgctaatgcaggaccgtttcgttaattattcaaatatgcataagtggtttttgccaatttttctactaaggcaatccccgcctgttcgctggtattgccactcgttaataccgcaataacgtagtcactgttgtttgatttaacatgcccaatcgaattaataatccagccattagaatcttccagccaaccattctttaatgacaccgttgcatcactaccaacgccggcgcttacaccccagttttgacttgaagcgacattgctcattaaatcagcaatatatgactgacctgcatctggcagaactgagctgtcataaaatatgttacgcaataatgtcacttgatcagatgccgtggttaaactatagccccaagctgattcatccattgcagaatctgccatgcctaacttgttgaacaacttatccggtgctttatacccgccctcatcttctaacaaagccgttgttgcatcattatcgctatcttcaatcattgccgtcgctaacgttttttcattaatcgacatgttcgtttgatcactcgtatgttgcgcaatcaaattggataacacagctaccttaacaacactggcagttttaaactggctgcgtccagatgttgtataagtggccgtcacgcctgttttcttatcatagatggcaattgtcgcgtctgcattggtagactgcgtgtcagtcgcccacttcgcttctaagtcacttgcttcacttgaggcagtccgcttcaccgcaccgatagcggtcgtcacacgccgtataacgccactaacggacatcgaatgcccgtccattgtcatgccaatcaatgatccccctatcatgatagccgccaccaaaagcgaaacccaaattctgcgtctgcgctggcttcgccttttatctgaccgatccataatttttccttctctctatatcaaagctgctaaggcaaacagctactgtgataactgcaattttaaaccgtcagacttaatttaaactttcaacagcgcaaaaaaagacgtgataccgaagtatcacgtcttttttaagaagggcgttaattacttaacagtaacaacggcaccagcttcttccaacttagccttcaattcgttagcttcgtcttctgaaacgccttccttgatagctgaaggagcgttgtctaccaagtccttagcttccttcaagcccaaaccagttgcttcgcgaactgccttgataacttgaaccttagctgaaccagctgaagtcaactcaacgtcaaattcagtcttggctgcttcggcaccaccagctgcaccagcaactgcaacaggggcagcagctgaaacaccaaactcttcttcaatagctgaaaccaagtcagccaagtccaaaatcgtagcttccttcaatgaagcgatgattgaatccttatcaaatgccatgataattaatctcctcgtttatttgcctatgcggcgattttatttgtttgggcaatgcccgggtaaacctgcgtaacgccaagcggatgcttaggcttcagcagcttcttcctttgcgtctgacacagccttaactgcgtatgcaaagttgcgaacaggtgcttgcaacgttgacaacaacattgacaacaaaccgtcgcggtctggcaaagctgcgtacttgttgatatcttcaacagatgcaacttgaccgtcaacaacaccacccttgatttccaaggcttcgatgttatcagcaaacttcttcaaaatgcgtgaaggagcgattgcgtcctcgttagagaatgcaacggctgatggtccgacaaacaagtcgttcaagtcagtcaattcagcggcttcagcagcacgcgtcaagatcttgttcttgataaccttcaactcaacgccttctgaacgcaattctgaacgcaagttgttggcttgttcaaccgtcaacccacgcacgtcaacaacaactgcagatgcggctgacttaaacttgtcagcaacttcttcaacttgttgtgccttcaaagcaatagttgcttcactcatggtaatgttcctcctgttaagattttgattcgtaccaaaagacccccagcacatactgcaccgggggtcaaaagtcgcttacgcgtttttcacttcctcggcgggttattaagtcttacgacacctgcgtcttaggtagaatcgatttattactcgaactactttatcaggtagtcgaggaagtgtcaacatgaaaagctaactttgatctagaaaaattctaaattacaaagaagcgatatcgatgttaacagcaggtccgaacgttgaagcgattgatacgtgctttacgtatgcacccttaacagcggcaggacgagccttcaagataacgtctgacaatgacttgatgtttccagcaagcttgtcggcgtcaaatgataccttaccaactggtacagcaacgtttccgtcacggtcagtacggtaagtaaccttacctgacttagcatcagtaacggccttagctacgtcaaacgtaacagttcccgtcttagggttaggcatcaatcccttaggacccaatgcacgtccaacacgaccaacttgggccatcatgtcaggcgtagcaatggcaacgtcaaagtccaaccaaccgtcagaaatgcgttgaaccaagtcagcagcaccaactacgtcagcaccagcttcttcagcttccttagccttatcaccttgagcaaagaccacaacagtttggtccttaccagtaccgttaggcaaaacaacggcaccacgcaattgttggtcagcttgacgagtgtcaacgttcaagttgaacgcgatttcaacagttgcatcaaacttggcaaagtcgatatcctttaccaattgggcagcttcttcaacagtgtacaacttagcactgtcaatcttttcagcggctgccaaatacttcttaccatacttcttagccatggtagctattcctccttgcaaatgcggtcaaacggtcattgacctcccgcttgatcatgcttagtttcctacgcgatccgtacggaacccgttaattagccttcaacagtgaagcccattgaacgagcagtaccttcgatcatgcgaacagctgcatcaacgtcagccgcgtttagatcttgcatcttagtttctgcaatttcacgtacttgtgctgcagtaaccgtagcgaccttcttcgtgttaggctcaccagaacccttttcaacaccggctgccttcttcaacaaaactgctgctggaggcgtcttagtgatgaactcgaatgaacgatcttcatatacagtaataactactgggatcaacaaaccaccttggtcggcagtgcgagcgttaaactcctttgcgaatcccatgatgttaacaccagcttgacccaaagcaggtccaactggaggtgcaggggtagccttaccggctggaatctgcaacttaacaatgcttgaaactttcttagccacgattgtttcctccttcgtgtttgtggtgtaatggcgcgtttcgatttacgcctcccacatatgcgtgttgccacacataccagattataataacaaaacgcctgacttttgacaagtcaggcgttcactaaatattcttaattttcgctgtttcccattaaatcaatggttgcacatcgttaaatgagatttcagttggcgtttcacgacccaagaaatcaaccaaaaccgttacttcttgcttgtcgttatcgatagccgtcacttcaccttgcatacctgcaaatgaaccagcaacgatcttaaccgtctcgccaacttcaacgttaagctcagttaccttacgttcaacgatgttcatacgttgtagcatgtcgtcaacttcatcaggcaacaatgaaactggctttgaaccaccaccgtgagaacccaagaaaccagtaacacctggtgtgttacggacaacgtaccaagcctcgtcggtcataatcatctcaaccaaggcataacctgggaaatcattttccttgatgatcttcgtctcgccgtccttctcaacttcaacttcttgctcaggcacgataacgcggaagatgtagtcagtcatccccatcgtttcgatacgtgattccaagttggccttaaccttgttctcgtaaccagcgtatgtgtgcaaaacgtaccattgcttatcgtatgactcaactgccatgattgcctcctcaggttatacctgtattttttgtaaattaaaaaccctcatgactgagggttttattatctgcgtttcgatatttttattatatcgcaaccggcttacttagacaaccaagtaaccccttgctcaaatacccagtcagcgccaccgaacaaaacggcgaaaaacaaaccagtcatcaaaacaattgacgtgtcacggacgttttcactcaaagtaggccaagtaaccttcttcatttccgcaacaacactagccaaaaacttcatgtcatgtactcctgtatccagaacggtttagccgacctggtgcttacatcgtctcgcggtgcattgtgtgttgtccgcagaacttgcaaaacttcataacttcaagacgctcaagacgatttggcttcttcgttaccatatagtttcgtgatccacagacactgcacgctaaagcgactttctttgctgccataatgtgtctccgctctatctattttctcatttaatctattgttaactataccacaatcactaaactcagtcatcatacaactcgacggaaagtttaatctgaatctggcggcgcatcaaatacccccatgattttgatcgacacaacatctccgcgcattcctccaccttgtaacctgataaccataactgcaaaaattgctgttctttcggtgttaattttgatgctattgcttgcaatgatgctttaatatgctgtgattcttcataataaagcagcgtagtctcttctaatcgaccaccatttgcatgcttttcatcttccagcgcaatagtctcaagcgatgaatcaactcgatactcaagtcgccacacttgttgcgcatggtgacgaagtgccttttcgtaataggcaatcagcgtcggccacgtgaaaattcgtaacgatgccaacgcccgatataaaacgtactgtgcttccgaatgccagtcgttcggctttatctgggtatcttggcgtgtatattcgcgccaaatcagaccacttagttgcccactcaacgtttgcatggcaattgtgtcgccgtccttcgctgatttcatgatgtcttctatattgtccggcactcgcttcaccatcatcaagtcctccttgtgggttaccttatctcatacaatgccacaagttggttggtatgccatgattatgcaaaaaaggtactatctcggttcatcgagatagtacctttacacataatctttattttaaagtgggttccggctattaaatgcttgatagatgagcaaactagctgctacggatgcattcaaactttgcacgtgtccaaccattggaatcgtcaacgtctcatcaaccgtcttcttcaacaatggtgagatgcccttaccctcattaccgatgataagtgcagttggtccagcagcgtcccaacgacggtagtccttaccatccatatccgtgccaaagacccacaaaccacgttccttcaattgttcaaccgtttgaaccaagttggtcacacgcgcaactggcacgtgctcaatcgcaccagtggacgtcttcgctacaaccgaggtcaattgcacagcacgacgctttggaatgatgataccgtgtacaccggccgcatcagccgttcgcaagattgaacccaagttgtggggatcttcaattgaatccagtaccaagaagaaaggtgcttcgtccttttcagctgccttagcaaacaagtcgtcaatcgttgcatatgcatatgcagcaattgataacacgacaccttggtggttttgaccgtccgtcaattcatcaagcttagccttgggcgcatcttggatgaccaagccacgcttcttagctagcgtcatgacttcatttcgaatcttgtctgtcaaaccagtttgtagccaaaccttgttaatttccgtttcacccttcaatgcttcaacagaagcgtggtgaccaaacacaaattcagtttgtgctgcaatatcctcttggtctgactctggtcgttctgcacgctttgcacgtggttggcggtcacggtcattaaaacggcgatccgccccacgacggttattattgcgctctggcttaccgccacgatcgcgcttgtttcggttattactttgttgtgccatttgctctcgttcgtccactttctacttgttcataaacccaggcaataatctcatccaaacgggcttgttggtcgcttgctgccaagtagccaattagtgcctcaaatccagttgaaatgcggtacgtaaccacgtccgtattctttgccttcgtatgtgaatttgcattacgcccacgcttaaagtaggccatctcttcttccgtcaataggtcatccgtttccatcaacgcaaacaaagctgcgtgcgccttagctgacacgtagttctttgattcacgttgcaaacgggctggcttggtaatccctttggctagcaaatgttgacgaatgtacacttcgtacaccgcatccccataataagccaaatccaagccattcaattgctcataattaatcttctcgttcatgcttactataataacagaaaaaccaggccaatgacctggttttacttattatgcttctacaacatgacgaacaaacggatcatctgacaatccttgctccaagataatcgctgcccaagccttagctgagtgaaggctgtggtccttgaaattaccgcactcacgaatcgtggttgcgggcacatcatcccaagtaatctcatcacgaatcttgcgcaaaacgcgggtgaatgtttccgcaagttgtgttggcgtatatgtttgccaactgatgacatgaaagccggtacgacatccgaatggtgaaatatcaataatgccatccaactcatcacgaactaggctcgcaaacaggtgttccaatgtgtgaataccagctgtttcaatcgacgtttcatttggttgtaccaagcgcaaatcataatttgcaatggccccaccagctggaccggcttgttcttcaatcaagcgcacatatggcgctttaacttgtgtgtgatcgagtgtaaaactttcaacttctgccatgttattttccctccaaataagatacaggcttcttcacttcaacctttgtgccgtggtattggttcttaatccacttttgtactgctgggtcgcgatatagcgccaccagtttcttgtacgttttgttgttggcctgtgattcacgcgttgccaaaatgttgatgttaccaatcgtgcctgaattgattgactcatgataaattgaatccttcaaaacattcaaaccaccggcttgtgaaactgaattcgaaatcagtaccgccgccactgagtcatcttgcttaactaacgacaccccggttgtatcatcaatttccttgaatttgaaatgatgtggattatcagcgatatcagccacacctgacaaggctgagaagttcgccttcaacttaatcaaaccagcgttagcaagcaagcgtaacccacgggccgcgttggcattatcgcgcgcaatcgcaatcgtgctgccatccggaatatcactaaccttgtgataatcctttgagtacacacccatcggctcaatataagtcgtgccaagtgcggctaacttctccgtatcggtctgtttattgaacgcatggaaataatcatatgattggaaggcattcacatcgacttcacctgaagccgtcgccttatttaaggttcccccatccgtgaactctttcaccttaatttgcacatgcgcctttttcgccgccgatgaatcagcaatatgacgccaaatttcagcatctccagtgactgatccaaccgtcacctttttaaccgtcgccgcctgaattgacgtcgttgtcgctaacaccgtcccagtcactacgaccccagcaatcacaattcccaatctcttaaccatttcgcctacccccaaacttcatccgcaatgtgcttgatgaatgataacttcgtccactcttcttgttccgtcaacgcgtttccctcttccgttgaggcaaagccacactgcgtcgatagtgctaagttttctagtggcactaacttcgctgcctcggcaatgcgattcttaattgcctcggccgactcaagcttaggagacttacttgtcaccaatcccaacacaatcgtgacgtcttcgcgaccttgccagatttcaggtaacggctcaaagtcacctgagcgggcatcatcgtactccaagaagtaggtgtcataatgcaattggccaaggtactttgctaccggggcataaccaccttcgaatagatacgttgacttgaagttgcctcggcaaatgtgcgttgagattttaaaatcttctggcaagtcatccaacgccttgttgatgacataaacactgtccgttgcaatcttttcatacttagcacgctcagccggatcattcctgaactcgttcaacttgctaatcaagaaggcccaggtcgtatcatctagttggacgtagcgactgcccaaatcataatagtgttgcaacgtgtcatggtacgcttgcgccaagtcatctagataggcttcccagctgtcataaaactctaaggcccggtctgaacgaccatcgcggaagagcaacgttggcgctggaatcgttgacttaggttcagtcccttctggcgcaactgacttcaggtaggcgaagtcttcaaagaatgggtgttctgggttaaaagcaatcttgccagtcaattggacgttatccgttcgcgttttttcgccgtagaatttgtatgaatcttcctgtgtgtagcgctcaacaccggtaaggccccacaaaaagtcgaggtgccaccatgaacgagcaaactcaccatccgtgacatccttcagtccgacttcatgttggtgaaccaccaagtcatgaatttcgtcatgttgcacttgaataagcgtttcgtggtcgattgtcccagctgcataatctgcgcgtgcttgcttcaatgctgctggacgtagatatgatccaacctggtcaaagtgataacgcgccttagttcctactgtcataatgtttaatctcctgttgtttaaaacttaatctgtcgtaactgtcatttttgtctggcccgctgccagttccaaaaatcacattcgactttgaccaagcccctcaccaacaaaaagacatcggtgagcggtgacacatagatattgcatcgttccttcctcactttcttcaactatccgtaaacaaaaaacgtcccgtagccactacagctacgggacgttttcacgtgttaccacccgggttcaatggtcctcaaaaataggaaccatcctctttcagtacggtcgtatgccgacgatacctaagcgcaataacgggcgcacccgagtgacgctcacactttgctcacgtcattaagactccaagaccattttccaattcgcgcgtccgttaattcacaccaaccattaactctctgggcgacgcttgaaaagtacttatctcttcctagtcgatgtttgtatcttaaaactaaaattagaaaacgtcaatatttttattaaaaataaattagagaaattccataccgccatcaaccatgatagattgaccagtaatataagctgctgctggtgacgcaaaccaggcgacaacttcagcaacatcagccggtgtcgcttctcgtcccaaggcaatttcagttaaaacgtttgcttgttgttcaggcaccgtcacctgcttaatcgccgccgttcgctcatcaatcgcatcccgcaatggtgtgcgtactacgccggggttgtaggcgttaactgtaatttgatccgccgccaattccttagcagccgattgtgttaagccacgaataccaaactttgatgccgaataggcgctttgcaacgctgatgcctccacaccagccagcgaggcagcgttcacaatgcgcccaccatgtccttgctccttaaagcgcgtcgccgcggcctgaatcccccagtaagtgccctttaggttcacatcaagaatccgttcaacatcaaccggatcagcatcaacaaacgcatcaatcactgcaatcccggcattattcacatacacagccaactcacctaagtcagacactgcctggtcaaccagttggaacacctcatcccggtgcgctacatcgacttgataaaacttagcttcatagcctgcctaaaccagtgcgtgggcaacttcttctccagtaacgctattaatgtctgcaacaccaatcgcaaaaccatcttttgccaatctgaaggcaatactttcaccaattccctgaccagcacctgttacaatcgccaatttcgtcataataaattccccctccgcatgcgtacacaataaccccacgcacgcaaaagttcaatagttttattaaaaatcaattagaaaaacactcaacaaaaaacagccacccagcaataagccaagtgactgttccaaaaacaattaattatgcacgacgccagcgggttccttgtggcgtatcttctaggataatgccacgagcagccaactcgtcacggatttcgtctgaacgagcaaagtttgatgtctcacgggcagcatcacgttccttgatcaatgcatcaacatctgcatccaacaaaggtgcttgctccaaaccgtcaacaccgaacacgttcatcaagtccttgatttgcttcaagacaaagttgaccgtgtcagtctttacttcttcagcttgtgagtacaagtttgccaattcaatcaactcgtaaaccgccgtcatagcgttttgtgcgttgaagtcatcgtccatggcctcgacaaaggcatcaaccttttcttgtgcctttgcttcgatatctgcatctgaaccttcaactgctgatcccaaacggaattgcaagttgcggtaaccagtgcggatacgctccaagttacgggcagccaagtccatgttcttttgtgagtaagcaattggacgacggtattgcgtcgtagccatgaagaaacgcaaaaccattgggtcatcaatttgttgcaacaattcgtgcaccgtcgtgaagtttcccaaagactttgacatcttttcattttcgtcaccaaccgtaacgaaaccattgtgcaaccacttctcaacgaacttctcaccagtgtgagcttcagtttgcgcaatttcgttcgtgtggtgtgggaaggccaagtcaattccaccaccgtggatatccaagtggtttcccaagtacttcgttgacatcactgagcactcgatgtgccatccaggacgtcccttaccccaaggtgagttccaagcaatggcaccatcgccgttctcacccttccagacagcaaagtccattgggtcttccttacgtgccaattcaccgtcatccaaacgaccagcggcgttagattccatttcagccaagtcttggtgagccaagataccgtatcccttgaacttcttagcacggaagtaaacgtcaccttcagactcgtaagcgtaacccttcttgatcaagtcctcaacgaactcgataatctcaggaatgtgctcagttgcgcgagggcgaacagttgcaggcttaatgttcaatggtgctgtgtcttcgttaaaggcatcgatgtacttgtcggccaattcaggaaccgtaattccttgctcagctgcggcagcaatcatcttgtcatcgacgtcagtaaagttagaaacatagttaacttcgtatccgcggtactcgaagtagcgacggatggtgtcaaatgcaatcgcagaacgtgcgttaccgatgtggatgtagttgtagacagtaggtccgcaaacgtacatgttgatcgtcttctcgttgatgggcttgaaatcttccttttgcaagctcatcgtgttgaacgtcttcatcattgtgatttaccccttttagtttgtataagccaatggtaacatgacgacaaaaaatccctaaacaatatgcttatagtcaggtgaacaggtaaccatttaattatcatattctcctaatgcatcacacttattttatcatagtaagtcaagttttttgcggtaacttttgatacatcgtcattatccgagaaaacggatgaaacagcgctatgacgcacataaacgtcgtcacacaatgcgcaaaatcaaacgataatccggccaaccaataactccaaattgtgggccaattaaatccaccaaataagaatggtgcttgcaagattgtcgtccaaaatccgtaagttaaacagaagactaggccaacaatcaatgccatgcttttttcatcagcaacatgccgactaccactggtaatcaataccaaaccggcatacaaaatcagttgcaccattaccaccgggtgcatccccaacaacaatcccgttaaaatcacagcaagacttgccgctggcaaggcaatgcgccagccaaaataccaagcaacaaggatgaccaaggcggtgaacggggtcacatttggccatggatgcacgaacaggcgcgcgacaaccatcacggccgtcaacacgcctgtcatcgccacccaatgtagcgtttttgtcattagaactgcttcaactcaaaggtaatacgatcaccagaatgcaacttcaaatcagcgggcgcttcactggtctgctttccatttaccgtataaacccagtattggttcttcacttgattctgtgcacgaccatcgatttcagtaataaacccatcggccgtgactgacatctttggctcacgcttctcgttttgggccaaatccaaaagcgtttcaccctttttcaacgtcactttgaacgtcttctctttaccatcatgcttcacaaccattgtcacatgacgttctgctttcgattgcgttgtttgggcatctgtgcggctttgccagtgttgcataccaaacagtgtcccaccaataatcaaaaccaacgcaatcaacaacatcaaaactttattaattactcgcatctctctgctcctgcgttacttaattgggcatgcacccgtttcacaatcacttgaatcaaccaagtccatcaacttatcttcgctgtgtagcgcttcatagactgcttgcacatcgccgaatactgatactgaacgttcagcataatcttcagctgaaattggttcctttggtgcttgcgcaaagccgtgtcctgagtaaggcaacattgacgttgacttaatttgtggggcatattgacgcaacatcttagccaacaaaggcttttcatcctcttggaacgtaatcgtgcagctaaccgaattgtcagcccagtacttttgcaagaacgcttggttagccaattgctcggcaacgctcacttcacctgctgacttaaagccagggtaatcagctgaagcagccttaactgggaactcaacaaccattgtgttttctgagtaaacatccggttcgatgtggtagcgagccgcttgcaacgccttcaacaacggatccgtatcttggaaacgaatacgttgaatcaagtgatcagcatagttaaagtgcattccttctgaaacacccgtcaactttgagaccgtacctgatggcttaaccgtcgtgcacttcactgatgggttgcagtgcaacgttgctgagtattgtgcatcagcttccttaactgcttggtacaaacggtcaacttcattaatcaactcttggttgtagattggtgtgtctccatcccagcccgtcacaacaggtgcaccgaatgacgtcaaaacccaatcttgaatacctgacaaagacaccccgatacgacgattcttgttgataatttgacgtgaaatctcccaatcatatgggctaaatgttacacgcttagcaaaacgcgctcccaatgcaacgatgcgggcagggtcaaaaccttgttccatcgcaacgtttgggaagacctcaaacaggttgcaggcttcaccgtttgccaaagaaatttcaccacatgggttcgttccttcaacatcggcatcaatccctggttgctcaccatcagccaaacggccgtagttacgcaacaaatccaagttaacaaccccaggttcaccattttcagcaatggctgcggcgatgtcatcgtattgagccgtgtcatcagccgttacgaaaacagaattgttagatgcccaacggtggtggtagagcttttccttgtcttgcttcatcgcaacgaaggctgcatcatcggcatccccaagcgcaatttcagcagaacggcgtacaccaccagaaacaactgtcttaccaatcaagttcgcaatgtccgtgcaatcaactgatgacaagtgctcacccaacgtgtcgttcaacaagtcgttcacatcttgaatcaactcaatcaatggcgctggaccagaagcaacaccaccaaagcccttaatcttggcacccttggcacggatagctgaaacatcataaacaaccgcacgcttcatgtcttggcggaagtgacgatcaatcaaatcagccgtcatcaagacccaaccttcacgtgtgtcaggaaccgtcacaacatcggcatccccaaccatgatttcagttgcgttatctgctcctgcaatacgggcttcttcatacgcatcagcctcagggttaatcacaatagctgcatcaaccgtttgggcaaccgctggcatttgagcgacattcttttgcgtcacagaaacaccaacaccgccccccttcatcaattggtcgaacaagaaggcaaatggcattgatgccatgatttcttgcttgtctgcatatggtggcacaatgtggctctcaccatatgcttgtggacgcatggccacaaaccagcaattgttcaacgcatcaccgtgcgcctcttgataaggcgtccctgaaatccacaagttacgaccagatggcgttgcagacaatgagtaaatcgcacggaacaattcctcggcttcgatttgtagcgcatcaatatcagcaactgacgctgtaccttcttgcaaacgcggatccaagttgatgtttccttcgattacacgcttaaccgtctcatgccattcttctgtacgtcccgctgcatcattccatcgtgcatacgtacgcttgtaggttacccagcccaacgttccccagtgtggcttaatgttcgcaattgtttcggcgacaaacgcgtctgataacttaatagaccccatttcaatacccctttttagtaacatttcgttagtatacgaacattactcgttctttgttgtgtctattatcggaaaaataaacacaaacgtcaaatgtataaatattcctaactattagtgaatgacgcgcataatatgcctatatagtgtcgttttgttaatttatatacaaatgtttggacgcaaatttattcctatacattcgtaaccgataacctaacgttctgttacattaaggttttatcattttgtcgattgtcaaaatatacacaatacattttcgttacaaaaaaagacctgtttccaatcaggaaacaggtctcgtttcttataacgttttacttccaccactcatcaaaaacggtcactggtgattggcgcttgtgctcagttgtcgtaaacaacttttcgatttggatggcatccttttcagcaacatccttaccttctaggtagtcatcaattgcatcgtaagtcacgcccaatgccacttcatctggcaatgctggacggtcttcttccaagtcagccgttggcgtcttttggtacaagtgttcaggggcacccaagtaagccaagatttgacgaccttggcgcttgttcaaacggtacaacggcgtaatgtcagccgcaccgtcaccaaacttcgtgtagaagccagccaacgcttcagctgcgtggtcagttccgacgacaacaccgtgcatcgcaccggcaacaccgtattgcgcgatcatacgctcacgggccttgatgttacccttgttaaagtctgacaccgtcacaccagctgcttcaagttgcttgaccacaccttgcacagagtcttcgatgtttacacgaatcgtttggtcagcttgttgccaagcaattgaatccaaggcatcttgctcatcggcttgggcgttgtatggcaaacgcatggccacaaacttgtagtccgcatcccccgtctcagcacgcaactcttcagctgccgtttgtgacatcttaccggcaagcgttgaatcttgaccacctgagattcccaaaaccaatgtcttcatcccagtcttcttaaggtaagccttcaacaagtcaactgaacggcggaattccgtttcagggtcaatggttgcttgaacacccaacgtatcaataatcttcttttgcaaatcacgcatgatgacgctcctaattctcttcgtattcttttgcgacttcagagacgtattcacggagctccttaatcaaattcatcttgtgatcccaagcggcttgtgacaagtcaactgggtattcttgtgggttcagatcacgacggtactcagaccatagtgattcaatatgctcagctgtgtaatcgcgaatatcattcaaagctggtaagtcataaaccaattcgccatccacaaatatatcttgcaagattggacgggccgtataatcaacaaccgtcttattcaagtatgggtagtttgggtggaacatgtacaaaccgtctggcaactcacgtggatcttcatcccaaagggcaacataatcaccttgtgacttaccatcagaattacgtgtaatacgccaaacttgcttcttacctgggtttgaaatcttctcagcagttcctgaaatcttgatggtatcgaccatctcaccgttttcattttccactgaaacaaccttataaacaccacctaatgcaggttggtcataagccgtaatcaacttcgtaccgataccccaagtatcaatcttggccccttgcaacttcaaacttgtaatcgtttcttcatccaagtcattcgatgccacaatctttgcatctgggaaacctgcttcatcaagcatcttgcggacaccctttgaaacgtaagccaagtcacctgaatcgatgcggacaccgataaagttaatcttgtcacgcatttccttagcaacgcggattgctgatggcacacctgaacgcaatgtatcatacgtatccactaggaatacgacgtccttgtgcgtctcagcatatgccttaaaggcctcgtaatcattacggtaaacttgcaccaaactgtgggcatgcgtaccagagattggaataccaaatagcttaccggcacgcacgtttgacgttgcgttaaagccaccgatataagcagcacgcgttccccatagggccgcgtccatttcttgggcacgacgagttccgaattccatcagcgtttgatcaccgacaactgaacgaatacgtgatgccttcgtggcaatcaacgtttggtagttaacgatgttcaatagtggtgtttccaccaattgcgcatcaaaaacgcttccctcaacttgcaagattggctcgttgttgaagacaacttcaccttcacgcggtgcacgaaccgtcgccttgaaacgccaatccttcaagtagtccatgaagtcttcatcgaactcaccggtctcacgtaggtacgcgatgtcgctttctgaaaaatgaagtcctttcaagtattcaaccaaacgttctagtccagcgaaaaccgcataaccattttcaaaaggcatcttgcggaagtacatttcgtaaaccgccttgcgctcatgaatgcccttcttaaaatacgtttgcatcatcgatagttggtaagcatctgtgtgcagtgccaaactatcatccggaaatgccattgtcatgacgttcgtctccctaactttcgtaagtatatatgccctatattttaccacaattcacccacctaaacgccagcacacttttttagcactgctcgaaagtaagttgtatactgttatgtggaattatttaattttaataagaagaaagctggtgaaattgttcatggcagaacaaaagtttccttataaggagtctctccgtgtaggtatgttgctagccggtacagccggttacatcgactcatataccttcgcctttcacgataaccgctttgcaagtttccaaagtggtaatctgttgcaacttggtattaatgttgcgtcaggtaagtggcacactgctagtttgtttttctggccagtaatcgcattcttcgttggcgcggttttgaaccaaatcatcaagaaggcgtcatttaagaatgaagtgcaatgggaagaacgttcagtcttcatcgagttgctcggtgtcctatttgtggccttcctggagttagcccacgtgaactcattgattgtgctcagtgtcttggccatcttcatggcgatgcaagctgatacgttcagtaagttgcgcggtatgccttacgcgaccgttttgagtactggtaacttgaagacgttcggtgcaacgttggctaacggtttcttgaaccacgacaagtcacaatttattaagacacacaatgttggtttggttatcgcctcattcttgggggctgcgatcatcgcccacttccttggtttgatgattggtgactacacgttattcggtgccccaatcctattggcattcgtttggttcttcgttcgtcaagaccgtttggaaacaaagtaacttttcctgttgacacgtttctcagaatcagttaatatacaaatcaagcattttataagttttaaacaagttgagcaggaaagtaagttacctgaagcatcaaagagagacaacgttcggtgtgagttgttatgtggattgtttctgaaaatggcctgtgattggcgttggtgagcagcaagtctgtaagctaacgacggattggtctacgttacaagacacacgaatcggcaaagcatcatctcgctcactgcccgctcgttgttaaggtctggagtggcaacgctccagatgaagtagaatggtaacacgaagactcgtttctatttgatcatcaatttatttgaatggtcatttggaaacgagttttttctttttctactcacctgtttaaaacaaacacattattgatatgggacatgaactataattatttgggagatttatttatgaacaaggtatttaagactggtgttgcggtagctgccgcagcgttgactgcatctgttgttttgcctgctacggctgtttcagctgattcaaagactgtaacggttggtatcgtcggcacgtcagacaagggcgtttgggaagaagttgccaagacggctaagaagaagtacggcatcacgattaagacaaaggtcttcacagactacaaccaacctaacaaggccgttgcggatggttcattggacttgaactcattccaacactactacttcttggaaaactggaacaagtcaaacaagaactcagttaaggccattggtaagactttcatcacacctatccgtttgtactcagagaagtacaagtcagttaagaagttcaagaagggtgatgcaattgccgttcctaacgacgcaactaacgaagcccgtgctttgacgttgttgcaatcagctggcttgattaccttgaagaagggtgttgatatgccaacagttaaggatatcaagacaaacaagttggacttggatatcaaggaagttgctgctgaccaaacaccttcatcattgaagtcagttgatggcgcagttatcaacacgaactacgcacaacaagctaagttgaagttgagctcagctatctacgttgagcctgttaacaaggactcaaagaagtggatcaacattattgctgcttctaagaagaacgctaacaagaagatctacaagcaagttgttaaggcttaccaaacaaaggctactaaggactacttgaagaagacttggggtcaagctgaaattccagcttgggacatcacattgaagtaatcaacttcaccccaccgctttcacgagcggtgatacatattgagattaataaggagagattttcatggctgttattcaactaactgatgtcaacgtgacatttaagcaaaagaaacgagaaattgtggcggttcaaaacgaatcaatcacaattgaaaaaggtgatatttacggaatcgttggttattctggggctggtaagtcaacgctagtgcgtacgattaacttgttgcaacgtccaacttcaggttctgttttggtgaacggcactgaaatgacgacgttgagccctgcccaattgcgtgacgagcgtaagaagattgggatgattttccaacactttaacttgatgagcgaattgacggtgtttgggaacgttgcccaaccattgaagcactctaacctatcaaaggctgagaaggccgctaaggttaatgaattgcttgaattggttggcttggctgaccgcgctgagaactacccttctcaactttctggtggtcaaaagcaacgtgttgccatcgcgcgtgccttggctaacgaccctgaaattttgatttctgacgaagccacatcagctttggaccctaagacgaccaaccaaattttggccttgttgaagcaattgaaccaagaacttggtttgaccattgttttgattacgcacgaaatgcaagccgttaaggaagctgctaacaaggtggctgtgatggagaacggagccatcatcgaacgcggttcattacttgaaatcttcacgaacccacaaaagcaattgacgaaggacttcattaacacggccactaaccgtgacgaagcgcttgaaaaggttaacgagcttttggctgagcaaccattgtcagctgatgaagagcttttgcaaatcgattatgttggtgctgatacggcgcaaccattgctatcaacgatttacgctgactacggtgtgacaacaaacttgttgtactcaaacatggagattttgacgaagacgccagttggtttggccatcgccatcttcaagggaactgactcacaacgtgccacggcaaaggcaagctttgctgatcacggtgttaagattgtcgaacttgctaagggaggacaaaactaatgattcaatggattgaaacgacatttccaaatgtttatcaacttggctggagcggtgactacggctggggaattgctatctggcaaactatttacatgacgattggttcagccttcttcggcggcttgcttggtcttgccttcggaactggtttggtcctaacaactgaaaatggtattacgcctaaccgtaccgtattccaaattttggataaggttgtctctgttggccgtgccattccatttatcatcatggtggtggccttctcacctttgacacaattgattgtcggtaccacaatcggtacgacggccgctcttgtgccattgtcattgggtgtcttcccattctacgcgcgccaagtgcaagtcgctttgttgggtgttgatgctggtaaggttgaagccgcgcgttcattcggtgccacgaactgggacatcatcactgatgtttacctacgtgaaggtcgttcagaattgattcgtgtctcaacagttacgttgattagcttggttggtttgacggccatggctggtgctattggtgccggtggacttggaaccactgctatcgttactggttaccaacgtttccaaaacgacgttatgtggttggcaaccatcatcatcttgctccttatcgtgttgatccaattcgttggtgacttcttcgctaagcgtgcacatcacggataataaacttaagcctggtctcacatgtgttgaggccaggcttttttagtgggtaattgccccttctccgtgtacaataagtgcagttaaatacgtaaagaaaggtggctcatattttgaaattcatcgcatttttaaagtggctcatctggcttgtcctcgggttcttcattagtggtgtgattggcattgtcatcgacaaaagcaatctcatgacgaccatatttggaagccttggcacaacgattgggacacaaatcaacgatatctggtggttcctaccactcgcgctacttaacctgctcttcttccactacgccatcggctggtggggtgcaaaagccggccttgcttggctcctcttattgccatacttgctctacgcggttgtcagcaccattgcccaagggattacctggaacatcacggcattggtttacctaatcggcgctttggtggttgggttgaccgaagagtacattttccgtggcgctttgtttgcagccttcaagaaagctggggttggtgagacagcacttatcgttgtatcagccctcatcttcgcggcattccacatggtgaacggtcttgctggtggcaacttaatcgccctggtattccaagtactctttacgttcggcttgggtattttccttggggtcatctacctaaagacaaaggcgctactcccaattgcattcgcacacagtttctacgacttttcagtcctagcaccagggcatgcattgtttaacatgggtggtattaccaacattctcattctaacgattgcgttaattattcttggtattgtgtaccagaagaagatcgcataataaaagggcagctcaaacttgagctgcccttttcgtttacttttgatttgtgtttagaagctgtcctgcgacctttagttcaccaagggcatcaatagctgtattcggtacaataaccgtgttagcggggctcttagcaacgtctctgaaggcatcaatgttctgagcaaccaagtagttcgcatctactgtactcaagatgtcatttgccttttgaatacggtaagcctcagcatccgcggccaaacgcacagctttagcattagcttcagcagttgaaaccaatgcatcattctgagccttcgtcgtcaactcaatcgaacgtgcctcaccttcagcacgcgcaatcgctgcttcacgttcacgcgtggcattgatttgcttgttcattgattcttgaatctcaggcgttggttgaatcgtatcaatattaatacgatcaacatttacaccgtaagcatccgtaattgaaccaagttccttgcttagcgcggcgttaatacgctcggtcccattcaagacctcgttcaaatccatcgtaccaataatgcctcgcaaatgtgcacgtgattgttgcaccattgactttactgagtccgcgttctcaaacgtaaacttatatgggtccgtcacgtgatagttcagcgacaatgaaataataacttcagcgttgtcacgagagatgacactttgctcgctcagacgcaaaggtacttgcgccaagtcaacacggtcaacgcgcgtgataaacggcatcacaacgtgtaatccaggttggatttggcgttgatacttaccaagcacagataccatacccaccatgttctgtggaatgatacgaataccagtaaacacaacaaacgccaatataatcagcaacaacacaattaacacactaaataagatcatcattatcccccatttcaaccaacataaccttattacctattacgtcatcaattataacagtatcacccatactaaactgagacaaattgttaacctgataataaataccgtttagctttagcatgccatctgtataattatcgtcagtcaacgtaatgatttcttgcttaaggcgattatcaaaattataagtcatgttagttattacgctgcaacttttctagtgccacagtaccatcagaaacaccagtgacacgaacagaatccccaatctgcaacccatcaaaacaacggtatggataacgctgtcccttgatccagaccttatcagacgttagactccccggcgtcaaatgaaacgtcatatttaaaatactatcatctacatgtgcgttcataatatattccccctgtaatatcagtaagtttacatacattatagacacatcaatcagtcaggtaaacaaaaagcctttaaatcggatcgaccgacctaaaggcaaaagtatacaaaaaaacctcacacattactggtgcgacacaagtgccattcaacctagacttggcttaaagccatcatcgtagcggtttataccatgtaacatgagagatttcattgttttattaattaaccaatgaaattagtcaaccaattccaagataaccattggtgcagcgtctccacgacgttgtaccgtcttcaagatacgagtgtaaccacccgcacggccctcaaagcgaggtgcaacatcgttgaacaagtgttgcaaagccgtttctaccttaaccttgttatcttcagtcgtttgtacgtctgcaacaacgttacgtacgaaagcagcggccttacggcgtgaagccaagtcaccacgcttacccaacgtaatcatcttctctgcagtacgacgaacttccttagcgcgggcttctgtcgtttgaatgcgaccgttgatcaacaaagcagtcgtcaaatcacgcaacatagccttacgttgtgagctagtacgtcccaacttgcggtatcccatgagtatgtcctcctttacttggaattctatcgtttaatctaatcttccttgcggaaccctaaaccgagcactgccagcttttcctggatttcgtcaagtgatttccgaccgaggtttcgtacagacatcatttgagtctctgtacgctccgtcaactcttgtacagagttgatcccggcccttttgagacaattataagaacgaactgacaagtccaactcttcaataggagtgtcggcatgcttgctagttggtacttcttccttgtctaccatcacttgtgtgttaaccgcgcgttctgacaattcaacaaatgagttcaagtggtctgacatgatacgggctgccaatgaaatagcttcagtagcagtcaatgatccatcagtccagatgtccaaagtcaacttgtcaaagtcatcacgttgtcccacacgagtgttctcaacttgatagtttacgcgttcgattggggtaaagattgaatcaattgctagaacgccaattggcatttcttcatgcaattccttattctggtccgctgacacataaccacgtccgcgttctgcagacaaagtcatgtgcaacgtagccccagccgcaacagtggcaatgtgaagatccttgttcaagatctctacatcactatctccagcgatgtcgccggccgtcacagtagcgggaccggttacgttaacttcgagcgtcttcgcttcatcactatcgatgcgcattgaaaccttcttgaggttcaagatgatttgcgttacatcttcaacgacaccttcgaccgttgaaaactcatgcaaaacgccatcaatttgtactgaattgattgccgcaccaggcaatgaagacaacaatacacggcgtagggagttacccaaagtagttccgtaaccacgttcaagcggctcaaccacaaacttaccgtaattgctatcctcttcaaccagcgtaatctttgggttttcgaattcaagcatactgtttgttacccctttcaaagcattgtgtgaactagttgcaactggcaattagacacgacgacgctttggtggacgtgaaccgttgtgtggtacaggagtaacgtccttaattgacgtaacttccaaaccagcagcggccaacgcacggatagcggcttcacgacctgaaccaggtcccttaacagtgacctcaacagtcttcatgccgttttccatagcacccttggcagcagcctcagcagccatttgcgcagcaaatggtgttgacttacggctacccttaaatccaagagaaccagctgatgaccaagcaacggcgttaccttgaacgtccgtgatcatcacaatcgtgttgttgaacgttgcgtggatgtgtgcaacacctgactcaatattcttctttacacgacgcttacgattagtacgacctgccataatcaagtaatctcctttctttacaaattaagaattacttcttcttacctgcaattgcaacagctgggcccttacgcgtacgggcattgttcttcgtgttttgaccacgaacaggcaagcccttacggtgacggataccacggtatgatgcaatttcttgcaatgccttaatgttcaatgagatttcgcgacgcaagtcaccttccaccttgataccgtctacgacggcacggatggcgtcctcttggtcgggcgtcaaatcacgaacacgtacgtcttcagaaaccttagcttcttccaacaccttcttggcagttgcgttaccgattccatatacatatgtcaatgcgatcacgacacgcttgtcgcgaggcaaatcaacaccagcaatacgagccattacgattacctcctatataagatttaaaaagtttttgtgtcaaaatgcaaattatgcaccttggcgttgcttgtgcttagggtttgctgagcaaatcaccatcacacgaccgttacgcttgataaccttgcagttatcgcacataggcttaacagatggacgaaccttcatggtatttacctcccttggattttttatggttgactacttaaagcggtacgtaatacgtcccttagtcaaatcatatggcgacatttcaaccgtcacacgatcaccaggcaaaatgcggataaagttcttacgaatcttccctgacacgtgagctagaatggcggcgccgttttccaattcaacggtaaacatggcatttggcaaagtttcctttaccacaccagaaatttcaataacatcgttggccacgttgctgcctccttagttgtgacattggagaacgtaacaagtaattataacatgctctcttacaatttaacaagaaagcttcccggaataattacgcgttcttcaaattatcaagtaacgtctttacatcagcgaacactacatcaagctcgcgagcaccatcaatcttgtgcaaaatgcccttttcggcatagaactcagcgataggctcagtaagctttccgttaacgtccaagcgattcttaatcacttcaggcgtatcgtctgcacggccacgggccatcatacgatcaaccaaaacatcagcatcagcagtgaagtaaagaacgccgtccaatgaacgaccatcctttgccaacatctcatccaatgccttagcttggtccaagttacgagggaatccatcaaggatgaatccaaccttcgtatcctcttcagccaagcgctcagcaacgatgccgttagtaacttcgtctgggaccaagttaccagcatccatgaatgactttgccttcataccgagttcagtctcgttagccatggcagcacggaacatgtcgcccgtactgatgtgcggcaagttgtactcttcaacaatcttcgcagcttgggtacccttaccaacacctggcaagcccaatagcatgatattcaaactcattttgcttcgactccttcttgaataaatccaacatattgccgcttcatcatcaatccttcaagttggcgaatcagatcaattgccacaccaatgacaatcaatactgatgttcctgacattccaaggttactatccaacccgaagatgtgtgttgctagaattggtgccaaagcgacaaatcctaggaacaaagcgccgacaactgacaaacgcatcagcaaaccagacaaccacttttcagtggcacgtcctggccagacgcccacaatgtaactaccttgcttctgcaagttctccgcaaccttttcagggttaacctgaacgaatgcatagaagaacgtaaacaagataatcaacaatgtgtaaacaataccaccctgcattgtctgcattgataggtattgcatcaaagtgttgtaccaacctgcgtccgcaaacttacttgcaaatgcttgcaagatagtttgtggcgttaccaacaatgatgaagcgaagataacaggaataacacccgcaacattaatcttcaatggtaggtaagatgagttacctgaaccagttgaacgacgtgtatattgcattggaatcttgcgaatcgcttggttgaaccacgtaacaaacgcgataaccaaaacgaagatcaacaagataccaaccaagaatgcccacccacgcgctgggtcgtcaccttgtaggacgtgttccttgaacagttggtatacacctgctggcacacgcgcaatgataccagcaaaaatcaacattgagacaccttgaccgagtccgcgctcagtaatcatctcacccaaccaaacagcaaacatagttcctgcagttagaatgaaaccgatcaacaagtacgtctccaaatttggtgtcttaaccaaattcacttgactcagttgattgaatccagcggtgattccaatagattggacaaacgctagaacaatagtcaaatagcgggtcacttggttcaacttacgtcgaccaacttcaccttgtttcgaccattcaacaaatcgtggcacaatatccatttgtaggagctgtaccacgatttgagcagtaacgtatggtgaaacacccattgcgaacaatgagtaatttgtaagtccaccaccgctaaacatattcaaaatgctgccgagcccagaatttgctacctcagtaagtgctgccgtgttaatacccggcacagtaatgtaggcacccaatcggtaaacaatcagaatccctaaggtaaagaacaactttttacggatgtccttttccttaagtgagttgagcacggttttcagcattagatcacctcagtcttaccaccggcagcttcaatagccgtaacagcagcggctgagaacttgtttgccttaacagtcaatgacttttccaattgaccgttagccaagatcttaatgccactcaattcgttcttaacgataccagcttcgaccaacaatgctggtgaaacttcagttccgttatcgaattggttcaacacatcaaggttcacaacagcgaattccttgcggttgatgttagtaaatccacgctttggcttacgacggaacaaaggcatttgtccaccttcaaagcccaaacgtaccttaccacgagccttttgacccttttgaccacgtcctgcagtcttaccgtttcctgatgactcaccacgtccgacacggttgcggaccttgcgtgaaccttcagcaacttggagttcattaagcttcattaggttgtacctccttcaaagcaatctatttatgtgcttacttaactacttcaacagtaaccaagtgagcaatcttaaacactgcaccacgcgttgctgcgttgtcaggcaacacgactgatgatgacaccttgttcaaaccaagggccttaacaatcgcacgttgctttggcaaacggtgggcagcactctttacaagagtaatcttaacttgttcagccattttctgcctccttaatctgccaagtgctcaagtgagacctgacgcaattcagcaacttcttcagcgttcttcaatgagttgattgcatcgaaagttgcgcgcacaacgttaattggagttgatgatcccaatgactttgcagtcacgtcggcaacaccagccaattccaaaacggcacgagcagcaccaccggctgccactccagatccttcaacggctggcttaagcaagatgcgaccaccgccaaagacaccatttgcagagtgaggaagggtcgtaccaacagttggaactgcaacgatgttacgctttgcagcttcaacggccttgcggatagcttcaggcacttcttgtgccttaccagtaccaaaaccaacgtgtccgttacggtcaccaacaactaccaaagcggcgaaacgcaaacgacgtccacccttaacaaccttggtaacacggttgatggcaacaacgttttcttcaagctcgccgagcttgtttgcatcgataaaagccatgtttaatttcctccttcccttagaacttcaaaccagcttcacgagcagcttctgccaaagcttgcacacgtccgtggtacaagtaaccaccacggtcgaatacaacaacttcaacacctgcagccttggcgcgttctgcgatcaaagctccaacctttgctgcttgttcagtctttggagcagtctcaactgacttgtccaaagttgaggcactagcaagcgtcacacccgctacgtcatcaatcaattgcgcgtagatgttcttgttagaacggtaaacgttcaagcgtgggcgctcagcagtaccagaaatctttccacgaactcgcgtgtgtcggcgttgacgcaccttgttcttgtctgacttcgtaatcatgttcgtaacctctttttgtatatactcgaaagatataccaataagtaaatcccgagacgttgctcccgggccttaagcaataagcttaagattacttaccagtcttaccttccttacgtgcaacgtattcgttttcgtagcgaattcccttacccttatatggctcaggtgcgcgtacggcacggatctctgcggccaagtcaccaacaaattgcttgttgattccttcaacagtgatcgtagttgaatcaggaacttcaactgtcaagccttcacgggcctcaaactcaactgggtgtgagtaaccaacgttcaagacaagcttgtcgccttgcttagcagcacggtatccaacaccgaccaacttcaaagtcttcttgaagccggctgatacaccttcaaccatgttcgcaacgttagcgcgagtagttccgtgaagtgccttgatacgtccttcgtctgaaggacgagtgaatgatacttcagtaccgtccacagtgaattcgatttctgatgcgatttcgcgagaaatctcacccttaggtcccttaacagtaacgacgttaccttcgcgtgacaattcaacgccagcaggcaaagtcaaaaccttgttaccaatacgactcatcggtagacacctccttgtttagattttatttattaccagacgtaagccaatacctcgccaccaatcttcttggcgcgagcttccttatcggtgataacaccttcggaagttgagatgatagcgatacccaaaccgttcaaaaccttaggtacagcatctgccttgacgtatgaacgcaatcctggctttgaaatacgcttcaaaccagtgataacgcgttgcttgtcggcaccgtacttaaggaagacacggatgacaccttgcttgtcatcttcaatgtattcaacgtcgcgaacaaagccttcgttcttcaagatttcggcgatgtccttcttgatctttgatgcaggtacttcaactgaatcgtggcgaaccatgttcgcgttacgaatgcgagtcaagaaatctgcaattgggtcagtcattgacattgatgtttgcctcctattattaattactgtaaatcagtgttgattactttgagaaaggcatacccaattgagtaagcaattcacgagcttcttcgtcagtgttggccgtcgttacaacaacgatgtccaatccacgaacgcggttaacttgatcgtaatcaatttctgggaaaataagttgctcacgaattcccaacgtgtagtttccacgaccatcaaaggcctttggtgaaactccacggaagtcacgaacacgtggcaatgaaacgttgatcaacttatccaagaagtcgtacatacgctcaccacgcaaagtaaccttagtaccgattgccataccctcacgcaaacggaagccagcgattgacttcttagcgcgagtgataactggcttttgaccagcaatcaattccaattcagcaacagcttcatccaagttctttgagtttgatacggcgtcaccaacacccatgttaagcacgatcttttcgatcttaggtgcttgcatgattgatgagtactcaaacttctcgatcaatgaaggcgttacttcattgacgtacttttccttcaagcgatttgccatgataatgatttcctcctttcacctagaaaattatgccaaagtcgttccagacttcttagcaaaacgtaccttcttaccatcttcaaccttgtaaccaatcttcgttggttcgttagtagaagggtcaagcaattgtacgtttgaaacgtggattggagcttcaagctcaacaattccaccttgtgggtattggttgtttggcttttggtgcttctttacgatgttcacaccttcgacaacaacacggtccttagcagcaatagtcttaacaactactccttccttgcccttgtccttgccggcgataaccttaaccttgtcaccagtcttcacaaacatgcgaggcttcctccttgatttaatgatggtaattacaatacttcaggtgccaatgacacaatacgcatgtaatcattgtcacgcaattcacgcgcaacaggtccgaagatacgagtacctacagggctcttgtcatccttaacgatgactgcagcgttttcatcgaacttgatgtatgaaccatcagcacggtgaactcctgaaacagtacgaacgataacagccttaacgacgtcacccttctttacagtaccaccaggaatagcttgcttaacagttgcgacgatcatgtcaccgataccggcgaacttacgacctgatccacccaaaaccttgatagtcaagatttcacgtgcaccagaattgtcagcaaccttcaaacgactctcttgttgaatcacgattttgtcctccttccgttattggtaagattcgagattaaacgattagataataacggccttctcgacgatttctaccaaacggaagcgctttgtagctgacgttggacgcgtctccatgatgcgtacgatgtcaccttgcttagcttcgttgttttcatcgtgagccttaaacttcttcgtgtacttaacacgcttaccataaacagggtggttcttgtaagtttcgatggcaacagtgattgtcttatccatcttatctgaaaccacgcggccttggtaaaccttacgtgcgttacgagcttcagtcatatcggtctcctctcttagtctacttgttcaattcttgttgacgaatgaccgtcttgatacgtgcaatttgcttacgtacttctgacaatcgagccgtgttctcaagttgaccagtagctaattggaaacgcaagttgaacaattcttccttgtagctcttttccttggcaaccaactcagcttggctgagacccttgatttcgttttgtagatccttgatcttcattattcaccctccacttggcgagtcaagatcttagtcttgactggcaacttgttagatgcaagacgcaaggcttcgcgggcaacctcttcaggaacaccggcaacttcaaacattaccttgccgcgcttaacaggtgcaacccatccgtctggagtacccttaccgttacccatacgaacaccaacacccttagaagtgtatgacaagtgtgggaaaatcttgatccaaacttgaccaccacgcttcatgtgacgcgtcatagcaatacgagcagcctcgatttgacggttagtgatccagtgtgattcagtggcttgcaaaccaaactcaccaaatgtaactgtcttaccacccttggcctcaccgcgcatctttccacggtgtggacggcggtactttacacgctttggtactagcatgttactcgcctccttgcttctttacagacttcttctctggcaaaacatcaccacggtaaatccaagtcttaacacccaattgaccgtaagtagttgttgcctcatcccatgagtagtcgatgtcagcacgcaaagtgtgcaaaggcaccgtaccctcagtgtattgctctacacgagcaatgtcagccccgttgatacgtccagaaacttgcgtcttgatacccttggcaccagcacgcatagcacgttggatagcaccacgcattgcacgacggaatgccacacggcgctccaagtctgatgcaatttgtgaaccaaccaagtgggcgtccaaatcaggcttcttaatctcaatgatgttgatgtggacgcgctcgcccttagcaacaagctttgacaactcgttacgcaatgcatcaacttcagaaccacccttaccaataaccatacctggcttagcagtgtggattgagatgttcacgcggttagcagtacgctcgatctcgatgcgagatacagatgcgtcagccaacttagtctcgatgtacttacgcaacttcaaatcttcgtgcaaagccgttgcgtagtccttcttgttagcgtaccacttagcatcccagtcgcggatgatgccgacacgcataccagttgggttaatcttttgacccatgactcaatcctccttacttttcttttaccacaatcgtgatgtggcttgtacgcttgttgattggtgaagctgaacccttggcacgtggacggaaacgctttagcgttggtccttcgttagcaaaggcttctgcaactaccaaatcttcgcgatctagtgagaagttgttctcagcgttagctacagctgagttcaacaccttgtatacatcttctgagctgtggtttggcaagaattgcaaaattgcaaatgcctctgccacagacttaccacgaacttggtcaagcactaggcggaccttacgtggagcgacacgaacgatcttcgccgtggcgcgtgctgacgtgatttgttcagccattgtattgtcctcctatattacttgcgcttagtcttcttatcgtctgctgcgtgtccgcggaacgtacgcgtagggacgaactctccaagcttgtgaccgaccatgtcttcttgtaccaaaactggcacgtgcttacgtccatcgtaaacagcaaaagtcaatccgataaagctagggaaaatcgttgaacgacgtgaccatgtcttgatgacagcttgcttttctgaagcgttggcttcttcaaccttcttcaacaagtgagcgtcagcaaatggtcccttcttcaggctacgacccattttaaggtcctcctctcgtttgctaaaaacttattaattacggagtgtaagtattgattacttgcccttacgaccgcgaacaatgaacttcgttgaacgagccttcttgttacgcgtcttcttaccggcagtcttcttaccccatggtgacattggacttggacgaccaactggggcctttccttctccaccaccgtgtgggtgatcgttagggttcataactgatccacgaacgtgtgggcgttgacccttccaacgacgacgaccagccttaccccagttgatcaatgagtgttgttcgtttccaacaactccaaccgtggcacggttaacggccaagatcatacgtacttcacctgattgcaagcgaacaagtacgtactttccttccttacccaacaattgtgctgatgcaccggcagaacgggccaattgaccacccttaccaggcttcaactcgatgttgtggatttgagttccgtcaggaatgtttgccaatggcaaagcgtttccgaccttgatgtcggcatcaggacctgattgaacagtcataccaacttccaagcccttaggcgccaagatatatgccttagtaccgtcagtgtattgcaacaaagcgatgttagcagtacggtttggatcgtattcgatcgcaacaaccttggctggaacatcatcctttgtacgcttgaagtcgataatacggtattggcgcttgtgtccaccaccacggtggcgcacagtcatgtgaccgtatgagttacgagcaccagtgtttgactttgattccaacaagctcttttcaggcgtcgtcttagtgatttcagcaaaatctgaagacgtcatgttacgacgaccgttagaggttggcttgtacttcttgatagccacgctaatttcctcctaattagttttcgttgaacaattgaatgtccttagaagcggcagtcaacttaacagttgccttcttacgcttcttagtgtaaccagcgaagcgtccttgacgcttcaacttaccacgtacgttcgccgtgttgatcttttcgatcttaacatcgaaaatttcttcaatagcgcgcttaatttgtggcttagtggcgcgaacatcaacttcaaacgtgtaacgcttttcatccaaaacgctcatcgtttgttcagtgatgaccgggcgcaaaatgatatcgcgtgcgtccattatgccaaaacctcctcaacttgtgccaaagctgattgaactacaaccaacttatcgttgttgattacgtcaagcacgttaacaccctttgcagtcataacagtaacgttttccaagttacgtgctgccaatgctgcgttagcgttatcatcgtccaagacaaccaacgtcttttcgtttacgttcaagttgttcaaaactgccttgaattccttagtcttaggagcgtcgaatgacaatgcatcgacaacaaccaaagctgagtccaaaaccttttgtgacaacactgacttcaatgccaaacggtaaaccttctttggcaacttgtaggcgtatgaacgtggagtaggtccgaagacgataccaccaccacgccattgtggtgaacggattgaaccttgacgggcacgtccagttcccttttgacgccaaggcttcttaccaccacctgaaaccgctgaacggttcttaacggcgtgagtaccttgacgcattgatgcacgttgcatcaaaacagcgtcagtaacaacgttgttgtttggctcgattccgaagattgagtcgttcaactcgatctcaccggcgtttgagccgtcttgcttaaacaaagcaaccttagtcatgttagtttcctcccttcgtccttattacttagccttaacagagtacttaacagtaacaagtgacttgttggcaccaggaacattacccttaaccaagatcacgttgttttctacgtcaacgcgaactacttgcaagttttgtacagtgcgcttgtggttacccatgcgtccaggcaacttcttacccttgaagacgcggttgatgatggcacccaatgaaccaggacgacggtggtaacgagaaccgtgcgccataggaccacgtgattgtccatccttcttgatgttaccttggtaaccatgaccctttgtgattccagttacgtcaacagcttcgccagcagcgaagatatcaaccttaacttcatccccaacattgaattctccctcagcgtcgcggatttcacgaatgtagcgcttaggggccgtgtttgccttggcaacgtgaccttgctcaggcttgttgctcaaaacggcacgcttgtcttggtaacccaattgaactgcgttgtaaccgtcgttttccaaagtcttaacttggagaactacgtttggcgtagcttcaattactgttacggggataagctcaccgttctcagtgaatacctgagtcatgccgaccttgcggcctaagatacccttagtagtcatgactatctcctttgaatagtaaatctaaatttttgatcagttaaatgcttaatcaggcaagttgttgttgctgttgttgcgttgtaaaaattacaacttgatttcgatgtcaacaccgcttggcaattcaagctttgacaaagcatcaaccgtcttagcagttgggttcacgatatcgatcaaacgcttgtgagtgcgcatttcgaattgctcacgtgaatccttgtgcttgtgtggtgaacgcaaaaccgtgtacaacgtacgctcagtaggcaatggaataggacctgaaatttcagcacctgtacgctttgccgtctcaacgatcttttctgctgaagcatccaagatcttgtgctcgtacgccttcaaacggatacgaatcttcttacttgccatgatataaattctcccttcgtccatattggaatatgaaactaactccgtggaaactaccgacgcaccccaaagagctccatggcaatgggccccgtggcaatgctgccgggtgtgtcgcaacctcccacatcatcgcttgtcgatggcacgccaatacgcgggtgcacaatgcaccctgtatttaacgtactagaatataatacagcaggctaaccccgttggcaagccttttgaacaactttcttgaattaatttcttaaccccgttcatgtcgtgttcatattttattccgaaaactataataactgatttacttactaatttccaccgttttggttctatttaaaaaaattcgtaagtccctctcagaattgcatgtgtttattcagggttattcctatataatagtagatagcttattcatatcatgttatgaacacatacatattatagtagataaacaattaaggagttccttagtaatgacgcaatcactcacacaacttcatccgatttggcaagactttcctgctatccaaaaggaactccaagcagtcttgaatcgcattgaagctaatatggatgctaatgatccagaagtcgaagcggctcttttcgatatgtttaacgccggcggtaagttgctccgccctgcgttcacattgttgattggtcgtttctaccctgccgaacgcgagccactattgaatctcgccgctacggttgaaatgctccacacagcttctttagttcacgacgacattatcgatgactcaccaactcgtcgtcacgctgaatcaattcaatcccgctttggtaaggacgttgctgcatacgctggtgactacctattcgctgtaacattccgtaccttagcagacaacacaaataatatcgaaacggttcgcatggcaacccgctacctagaacgcattctatctggggaattgacacaacgtacgaatcactaccgtactgatatgacgatcgcggattatgaagaacaaatttctggtaagacagctgccctattcgtactagcagctaagctaggtatcgcagctagtgatgcgccagatgactttgctgaacttgccagcgacttcgcctacaatgtcggtatggcattccaaattttggatgacatgcttgattatcaatcagatagcacgacccttggtaagccaacattgaacgatgtgcgtgaaggtgtttactctgcaccattgattattgcgatgcaaaacaatgaacgcattcaagccttactcgcaaagcaaaccgaaatcacgactgctgaggctgaagaattagcccaacttgttcgtgactctggtgcgcttgatgaagccggtgatatggcaatgcgttatacagaagctgcattaaactatctagacgatatgccagaacatgaatcaaaagatatcttgttcagcatcagccgttcactactctcacgtaacgactaatatatagtagaaaaggtaccgacaattcattttgtcggtaccttttttgttaatcttctagataatcaaattccaaaccagggttggcatttaagtccaaaccaccacgcttaccatgacgataagcaatatcaccagcagcaccaatcatcgccgcattatcaccggccaacttaattggcactgggataaatgtcgtgtcagggaattcagccatcattgccgttagtccatcacgcaaaccacggttagctgcaacaccaccagcgacgataaatgacttcactggataattctccaaggcacggcgagtcttggttaccaagacatcaacaactgcctcttggaacgacgccgcaaggttaacatgatctaccgtctctccacgttggtcagcattgtgcatcaagttaatcactgcactcttcaaaccagagaatgaaaagtcataacggtcatcgttaatcaaggcacgtggcaaatcataagttggttcaccttcatgcgccatttcatcaatcgtctttccagaggggtattgcaaccccatcgtacgaccgaccttgtcataactctcaccggcagcatcatcacgtgtatccccaattacgaggtaatcatattcctcacgcatcaaaaccaattccgtgtgaccaccagaaaccatcaaggctaatgctggataggcaattggttgcacgaagttcgccgcactgatgtgaccagccaagtgaataaccggtaccaatggcaaattgtgtgcccaagcaatcgttttcgccgccgtaacaccaatcaacagtgccccgaccaaaccaggcccttgcgtcactgcgattgccgtcaagtcatcatacgtcaattgcgcatcttccaaagcagcatcagctaacaccgttacttgttcaatgtggtgacggctagccacttccggtacgataccaccaaatcgttggtgactcttgatttgtgtcgctgtctccaagctcacaatttcggtaccatttttgacaatcgccacacttgtttcatcggcacttgattcaaaggccatgatataacgtgtttcactcatgctattctccttctccacgcaacggcaatgtgacatccatcaagtaggcgtcttccaccgggtcacgatagtaatcttctcgtatgttatagatgataaatcccaagcgttcatataaacgaattgctcgcttgtttcgatgacgcacttccaatagtacccgcgtaccatcctcaaagcgcccaaaccattcacgaagtagtcgttcgccaaggtgttgtccctggaaaccaggcataaccgccacattggtgatttcaagttcatcacctaaatgtgtcccaccaacaaagccaaccgtctcaccgtctgcttcgatcagcaagtattttgtaaacttacctttcaagtcattttgaaaaactttcttcgaccaaggtgatcctttataagcagccttagcaatcgcgtacagctcttcggcgtccgtactatccctgaatgtaaaatccatcactctttctcccgagaatctgcgccatatcaaacgcgtcttccccgttatctccataataattcgttttacgacgaaccgtttgaaaacctagtcgttcgtacaggcgttgtgcattcacattcgatacccgcacttccaatgaaacgcggtggaattgaatttgcttagcaaccgtcatcatatacatgagcaaaaacgttcctaagccacgtccttgccagtgcggtgtcaccgtcacattggtgatatgcacttcatgaataccaggtcggaatgctgcgccaatataagcaaccatcgttcccgtctctggctcacgaacaacaacgtacaaacgctcgcgtgaacggtgtaactcattatggaagatatcttccgaccaaggttcctcaccgtcatacgctgcccgttctagaacaaccatttcttcaacgtctgtgtattgcgctggcattaagtggaactcaaagccgttaaccgcaatcacctgacgaaattctcgtaaactttgtggcaatgggtgcataaaccaatgaacccaattcttaaaccttttccacataaacaccatcacctgcatcagggtgagccttggcccaatcagcctcagcttgcgacaaacgataatagtttggcacaaattggtgaatatctgtcatgtctgttagtacttgtgcatccgtaaccagcggcaacacatttgcggcatgcggcaaattatcagatgcaaattgtgcatctggcaaagcctgtcgcaactcttcctcaaaccgagcccattcaccaacaaaaaccacttgttgattctcctctgccaactgactaatcaaagctggaacattcgtgtgtcgatcagtcgccgtggcaacatacttgccatcacgcaactcatattgaccagcatataagttcgcattacgtgcatccatcactggcacaatcgtcacgccaggtgtcgttacgttcgttgccagcaagcccaagcttgagatgccgaccagttcgatacctagcgtaaaggccaacgtcttggcggttgtaaccgcaatacgcaatcctgtataagaaccaggtccttggctaaccacaacccgttcaagatcagccggcgcccaccctgctgacttcactagttcatcgataaacggtagcaattgcaccgaatgattcttagcgacgtttgtttcacgttgtccgattagcttgtcgtcttcaaacaaggctaccgacaatggttgattagacgtatcaaacgcaataaccttcatgccacactacttcctttactctttagtcatatggtatttatcatacaactttttaccggacttttcattaacataaaatttggcgagtggtttgtgtccgtcctaacggtcggagtgcttggccccttctagggcacgctaacacgcactgaccatgacctgcagggagcgcgaaccacagcaagctgcgtttccctttacctcccgtggctctaagcggtaaaaccgctaagaggccacacctgcgggtcaaggtcagtacgtgtctatacgcgtggcggggccaagcacagcagccaagcaatactccatttgttcgcttgtcatccacgagacaataataggttaaactgttcaccccttttaattttcgtcggacgactaccctagatataaaaaacaactcagttgctaacgcggacactaatcaaataagcactagacaaaaaagcctttagaactattacagctcctaaaggcatctacaatgtttattttgcatctactttctcactcatctaacgctttcagcaactcatccaccgaataaccgaatgtatagtcttcatcacgtccgttagactcccaaatttcggccgcgtcgtagacactgatcgactcttcaaagtcttcatctacttcatcatattccacatcatctgtaacagaagatgagttatctgttaacttatccttcaacttcctaaataaacccatacgtttcacctcgctaattctttttgccaaaactcataaaaaaggaaaataagctagccaaacccccaccatgtttttccttttggttaggtgtcgatctgtaatgttgtcgaacactataaccttttcgttcatgagcatgaacaaaaacccttttctttcctgctttcgtttgtgccataagctcctcccgtattgctcgcccctattcaccttaaagtttagcacccatccgtcaaaaagacttgataccgaactggacactattgttaacgataaattaaccctatcgtttcacggcgtatgaaaatcatacaaatcgagcatcacttggctgctgtgcttggccccgccacgcgtatagacacgtgcagaccttgacccgcaggtgtgggttcttagcggttttaccgcttagagccacgggaggtaaaggcgtacgcgccaatggcgtggactccgctccctgcaggtcatggtctggacgtgttagcgtgcctaaagaaggggccaagcactccggccgttaggacggacactgaccactaaatcccagcgcaaacaaaaaagacagctaccagaaacctgataactgtcttgataatcaaatattagcggtcttcataaccgtttgggtgcttttggtgccaagtccaagccgtcttgatgatttccttaacatcatcgtacttaggtgcccatcccaaaatctcacgtgccttgtctgatgacgcaaccaatgagtcaggatcaccggcacgacgtggaccaacttcggcaggaatttcctgaccagttgcttcacgcgcagcctcaaccatttgcttaactgagaagccgtttgctgaacccaagttaaattggtttgagtcgttacccttagccaagtagtccaaagccaacacgtgcgcgttagccaagtccattacgtgaacgtaatcgcggacgttgaatccatctggtgtgttgtagtcatcaccgtacatcatgatcttctcgcgttgacccaaggccgtttgcaagatgattggtaccaagtgcgtctcaactgggtggtcttcaccgattgaaccgtcagcctttgcaccggcaacgttaaagtaacgcaatgcaacccacttcaagccgtaagcttcatcagcccacttcatgatgtgctccatttgcaactttgactcaccgtatgggttgattgggttttgtggcgtcgtttccttgatagggttttcctcaggaataccgtacgttgcagccgttgatgagaagacaatttgcttaacatcaaactccaacataacttccaacaacgcaatcatacctgccgtgttgttgtcgaagtactttagcggatcagccattgattctggcacgattgatgaagccgcaaagtgaacgacttgctcaatgttttccttctcaaatacttcacgcaaagctgccttatcacgaatatcaacttcgtagaaaggtacacctgcaggcaccgcagcacggtgtcccgtcaacaagttgtcgacaacgacaacatcgcgaccgtctgacaacaatgtgtcaaccatgtgagaaccgatgtatccggctccacctagaaccaaaatggccatgtgttttctccttaaatgactttcttcactaattagtttactttagttttctgacttcgtccaatcaatatgcgcttcggcagacaatgtatcaccagaccaaatgcggtgaatcgtcttatcttccataatttgcgcttcagaacgcacagtatcaccaagcaaaatttcgtgttcgtacttgatgttcaaatgtgttggttcatgagcttcaaggaatgctggtcccagcacatcttgcatccaatcaaagtactttgaattattaacgtggcggtttgaatcaatgtccaaatagcgaacggcatattgttgatcgacatcaactggaatatcaccaatcatgtggtcaggctctggttgacgtggaatcttcttcacgcgttcaggtgcgtaggcatccaccatctcttgtggaatacgcgccatcttacgcttttccatatcaatcattgcgtacaatgcatcgatgctgaccaattcattacctgcttcatcgacaatgcggtacaaacgcttcgcaaagaatgggttaaactccttagccaatgtctccaaggccaccttttcaccaatcttaggacggcgtgtaatatcaacgacgtgttgcaaaataatccaaccaaccccgtttgcgtgtgcataatccggtccgacacccaggtcgacactttgttgcgttgaactcaacacagcaagattaaaaatcatgggcaggctcaacttgcctgtcacgtcagcttcgtagtacaacacctcgtgctgcatactgtaaacttcagccattaattctctccttgatattccaaatacaacgcttggcggtccaagtcacgcgctttggcgacttgcttaaccgcagccgttgcttttagccctgatgcaacaagggcttgtactgcctccacagcagtcatttcagcaagcgggtcgtcatccccgtcagtggttgggttatcatttcccgccaccatcatcacaaattcaccacggacttcgttttcacttgcccaatcaaccaattcttgcgctgacccacgcaagaactcttcataacgcttcgtcaactcacgggccaacacaacttggcgatcaggtccaaacgctttcaccaagttttgcaacgtcttagccaaacggtgtggtgcttcgtagaaaatcattgtttccgtgtgtgaattcaaaccttgcagttctgccaattgctcctttggcttacgcgccaagaaaccgtaaaacataaagggttgtggtgccaagccagacgcaatcaacgccgtaatacccgcacttgcccctggaagtggcacaaccggaatattttgcgcaatcgccgccttaaccaactcatgaccggggtcagaaattgatggcatccccgcatctgacacttgggccacatcttcaccagcagctaagcgtgcaaccaactcaggaatgcgactctctttattgtgttcatggaatgatacttgcttcgtttgaatatcaaactggttgagcaattgttgcgtgtgacgagtgtcctccgccgcaatcacggccacagccttcaatgtatcaattgaacgaatcgtcatatcacccaaattgccaattggcgttgggacaagataaagcgttcccgttgtatgtgttgcaaaacttttctgttgattcatcataaacctgctaacttaaactgactttcaaggacggttgattcgaccgtcgtttgaaaactaatatttttctgtaaacgttgtggtgccgccaatacgatatccaacacttccaacagtttggccgttgtataccgttgtgacaaacgctgccattcaccagcccctgggaaacgaacactcgcatcgccagtacgaccaagcaagatatcacgccatgcctgggccagcatcgctaacagtactcgtgcacgggctggctcaccagctaacggcaccaaagctgtttgcacgtgggtaaaggtggtatcgtcacccttcagtgtaccagtcacgatatcgctgaccgccttctcggctgagttaaaccagtcatcaactagccactcagcggcgctatccacgctatccgtcaacgtacgtgccaattcggcttgtgccggcgtaaagccaactgcctccaatgatgtgcgcatctgttcaggtcccaaagctgggaaatcaatcacctgcgtacgtgacacaaccgtcggcaaaatttgcgcccggttttcagcaatcaaaatggccgtttgttggccaactggttcctcgataaacttcaacagaccgttggcggcactgctagtcatcgtatccgcaccagaaacgataaacaccttttgattaccttcgacggccgtctttgtaaattcatcacgcaagtaacgtacctggtcgaccttgatgctgttaccatctggcgccaattgaatcacgtctgggtgttcgtgtgacgcaatacgttggcattgatcacacatcccgtccggttgtccgtcagccgtaacattacgacacatcaaacgcatcgccaaccaatcagccaccaagtcttgaccacgaccacgtggcccagtaaacaaaaaggcgtgggcaagttgctcacttgccaccgcctgtttgaattgcgcgattaactgcggttgttgtgcatttgcctgtgcaattaattctttcgcgtccatactcgccccttagaagcggtggaattgttcaatatcttgaacaaagaccgttgcaccaccaacttgcacttccattggtgttgaagccgttgattccattgagacatcaagactaaccgctggtgtcatgaattgcttacgggtgtgtgatgtttccttgatcaactcaagcacttcatcgacacgctcgtcttcaataccaatcataaacgttgtgtttcctgaacgaaggaacccacctgacgtcgccaaacgagtggcacgcacattcgccttcacaaattcagttcccaacttgtttgcatctttatcttgaacgattgcgattaccatcttcataaagctgaacctcctagtccttcatccccaaaattggtgccagcgctgcccatgtatcagcaatcacagcatccaattcttgttctgcattaatcatcaaaaagcggtctgggtattgcttagccaattcatggtaagcatctgacacacgttggtggaatgacaacgcttcgacatcgagacgatttacttcatcttgacgcgttgtttgaatacgttgcaacccaacctctggtcgaatatcaaggtagaccgttgcttgaggcataaatccttcaatggcaaaatcattgattgccgccaccgcatcagttcctaattcacggcccccaccttgataagcaattgagctatcgacgtagcgatcagtaatcacaaccttgtcagctgctaaagctggcaaaatcgtttgtaccaagtgttgtcgacgtgaggctgcgtaaagcaacgcttccgttcgttgatccatctctgtattggctggatcaagtactaggtcacgaatcgcttccgcaatcttgttgtcggttccgcccggctcacgggttagcaataagcgctcccccagttctggttgcaaccgtgcgacaatcgcacgcaatactgatgtctttccagctccatctgggccttcaaacgaaataaatgtccctggcattctcgccaccactttctaattgtgttcttaactcttattatagcaaaaagccggcccaggcataacacctgaaccgactttggctaaacgttccagtcgatgttctctggctttacgaaagccaattcgaacaaatagttagaaatgcgcgtttgtgaccacttcttaccgtggtctggcaacaaacgtgaattctcaatgagacgttccttcacccacttagcattggcctctgtccattgcgtgttcttcgcaatcaaagcaccaaattgggcgtttgtataagtcttatcactcattataaacacctcctattctgagctttagtttttaaacctctgggtggacaaaagctgttgaccagtgacccttcatatcacgttgacgcgccacgcgaagtaagaagaaatacttctgacgggccttggctgtttcagccttaatcaaacgtgggtcaatgtcactttcaaacaaagctacttctgacatttttgctttttcaaagtcgaactttgcttgatcaatcgccttgttcagacgttcatcgtaagctgctgtatcaacttttggtcgcttaaacatgttaaacatcagagctttgtccttccttcaaccgctttaatcaacgtaatttcatcagcatagtcgatatcactaccaactgacaatccagtagccaaacgtgaaaccgttagaccggctggcttcaatagtcgtgataggtacatagctgttgcttcaccctctgcgttagcgttcgttgcaacgataacttcttggatggcatcatccttttgcaaacgcgttaccaatgactcaatgttgatgtcatcgggacccttaccagatagtggtgacaacacaccgtgaagcacgtggtacaaaccacggtactcgccagtgttttcgattgccatcaaatccttcacttcttcaacaaccaaaacttggctttggtcacgtgttgggtcagagcaaattgcacaaggatccgtctccgtcagattcccacagattgaacaaaagcgcaaatcacgcttagcagaaatcaatgattgggcaaatcccgtcacatcttcttcttgcatgtcaattgtgtggaaagctaggcgtgtcgctgtcttaattccgataccgggcaacttcgtgtaactatcaataagtttagcaatcggttctggatattgcacgttacagaccttctttctcccaataaaccaaccggcttagaacataccctttggtgcgtattgtcccaaacgcttttgttggtcagcttcgatttgttgcaatgcatcattaactgcaaccaaaatcatatctgccataccgtcgacgtcatcagcgtcaacgatttcaggcttgatttgcaagtccttcaactcacggtttccgttaaacgttgccaaaacaacgtctgaaggcgcgtgaccagtgtagtcagttgctgcaattgcttcttgctcgttttgcatttgctcttgcatcttctttacttgcttcatcattgattgcatgttttgtccgccaaacataatatcaccctcgttttctagtttttgttattaatcatcaatttcttctacgatatcagcgccaaacaaacgttcagcttccgctacaactggtgctggaccagctgcttcggcttgatcatccattgccgttagacttgctaagtcatcatcaacggcagctgccacttgttgcggtacttgctgttgcacagatggcgttgcagccgttccttgacgttgggccacaaacgcagcgcgcatctttggccagtcatcagtcgtgacaaagaccaattggcgctcgttttgagcttgcgtcaacagacggatttgcgtcaccatcgtgtgcaacaattcggcgttgcgcatggcgttggctttaatcacttcaaagtcaaaggccacgaccaagccatctggcgaagcagcaattggcttcgcaacgttcaacattgcttgttgtggcactggcaacatgttaaccatgtcagcccataccgtttgcacacggtctaggtcgccacgggtcgctgcactaagcacgccgaacacagctgattgatcatccgcaacacgtggtgcgacacgcgttggtgccggcgtggctggttgttcagccggtgctgccgatgccactggttcaggttgtgtcgctggttgcgttggtgtctcaacaactggtgctgctgaagcaaccggagctggcgctggctttggtgcagttggtgtcggatcagcaaccacttgtggtgctgacacacgttcaaccgttaccggtgccgtcgtggccatcggttggctcaacttaaccgtcaacacttccaagtaaatgcttgggcggttcgtgaaacgcaattgttgttgcgtgtcattcaagatatcaatcatgcgataccaaacgttagcttgcgtgttcgcggccaagtccgtgaatgtctcatcaggcacaatgctgatcaactcaggcgcttcagtgtgaagcagcaaatcacgggcatagctaatcaagtcttccacaaagcggttagcatccttacctgctgataatacctcagataacttagccaaagcttgctttgtgtcttgcttaaccaccgcatgtacatattcgccaagcaatgtttgcgtcactgaaccagtcacaagcaaggcgttttccaacgtcacgtgaccatccccaaatgacaacgcttggtccaagatactcaacgcatcacgcattccaccatcagcggcgttcgcaatcacgcgaatcgcagcttcatcatacgtgtcgccacgttgatccaagatgtacgtcatacgatcgtatgcggctttggcatcaatacgtttgaagtcgaaacgttgtgtacgggaaataatggttgccggaatcttttgtggttccgtcgtagccaaaataaagataacgtttgctggtggctcttccaatgtcttcaacaaggcgttaaaggcaccagttgaaagcatgtggacctcatcgatgatgtagactttgtacttcgcttgcgttggggcgtagttaacgtcctcacgaatctcacggatttcatcaacaccgttgtttgaagccgcgtccaattcgataatgtcaccaagcgtaccgttatcggctgcttgacacatcgcacatacaccatcaggctccccattaatgggatttaaacagttaatggctttggcaaagattttcgcagcggatgtcttacccgttccacgcggtccgttgaacaaataggcgtgggttgtttgccccgtcataattgcgtttttcaacgtcttggtcacaacttcttgcccaatcatgtcgctaaatttttgcggacgccatgtccggtacaacgcttgatacgccattgtgtgtgacccctttcgatgctgtccattgtgacagcaaagtatgaattttacctactcttatattaccagaaaacagtaaaaaaaacgccaaccgattagttcatcggttagcgattaaagttcataagaagtgaagcacaatgcacggtctccttagtgctgctgccttccgaccctgacacggttcgaagtgcacacttgccccacaaacaatattatagcaggtggattacttttctgcaatctcattcgacaattcttgtgctgccaattcggctgcgcgacgagctttcttttcagccttcttctgcttgcgaatttcgcggaagaagttacgcaataagtcgccactttcttgctcacgaacgccttggtgcacgttcacctggtggttcaaacgttcatcctctaagatgtggtacaaagagtgcaccgccccagcctttggatcctcagcaccataatacacatcactaatacgtgactgttgaataatccctgcgcacataatgcatggttccaatgtcacaaacaattgggcatctggcaaacgccatgacttcaccaaacggttagcctcggtaatggcttgtagttcagcgtgttggctggcatcttccaaccgctcacgtaggttaaaaccgcgtccgatgatttgaccattttgcacgacgaccgctccaatcggtacttcacccaaggcgcccgctttcttggcttccttgatggcctcacccatgaagtagtcaacttgttcaggcgttagcgtcgtcatggtagacactctccaaaatatagtaacccttgttcttggcaatcgttgcagcgttaccaaacgtttcagccatcaacgccttggcagatggtgcaccttgcttcttttgcaaaacaaccgtcagcgtaccgccatcaaccaagtaatccttcgccccagcaatcatatctgacacaatatccttaccggcacgtaccggtggattcgtcaaaatcgccgcaaacttaccgtcaacgccagagtaacggtctgacaataccacgttaatgcggtcgccaaccccgttcttttgggcgttacgcttgaccaattcagctgcacgctcgttgatttcagccgccacgaattcgcggtcaggcatcaccgttgccaatgcaattgaaactggcccgtagccggcacccaaatccaaaatctttccagcgggaatatcttgatcaaacgcatccaacatcgtgcgcgttccaaaatctacggtagacttagagaagacaccggcgtccgttgtgaacgtcaaggtgtggtcaaaaagcgggaacgtccaagtatgctcgtcgtgggcaacacttgggttcgccgtgtaataatgttcagccatgtgaacctctttctattctcaatatcagaatcctgataatcttcaaagttttctatataaaccattgtatgatatagagactaattataaaagcaaagtacttgggggagtatgacatgaaaaagcagacaatcggcgtctttatgggcgcccaatatggtcacctagaagaattccacgaagcagccgctgcgatgggtaaaggtatcgcagcccgtaactgggctttggtctacggtgggtcaaagagcggtttgatgggcgaagtcgcagttaacgccatcgacgccggtgccgaggtgactggcatccgaccaacgagtttcctaccagaagaagctgggcatgatttgaagatggaacacatcgacgtgccggacatggatacccgtaagcgcatgatgtttgaccgcgcggacgccttcgtctttttgcctggtggtatggggacgttggaagagcttggccaagtgatgtcatggacgaagctaggttactatgagaagccaatcgtcttggtaaatatcgatggttattgggatgacatggtggcttggttcgaaacagccatcgaagcagaattcgtcacccgcgaaggtctttcacgcttggccttgattccaacggtagacgaaacattcaaataccttgaaggtgaatttggtgaataacagaaaaatggtgatgatgtcaaaaattgggcatcatcaccattttttatgcaataatatcggtcttttcaaccatccaagcagctgcagccatgaggacaatgagtaccaacaagacaatcaattgaattgtccagctgtgccacaatccaaaaccgtaaccaaacaaagttggcccaaacgcagccaataggtagccgccggattgtgccatacctgatagttcagccgttcgcgttggtgtggttgtcttaactgagaacatcgttaacaagtaagggaacaatgccccacctgagaatcccatcaataagttaacaatcaaccaaaacaaaaaactgtgaccattgaataagatcatccccaccccaacaaatgcaaaggcagagaagcccaccataatccagcgacgttgtttgttattccaacgtgtaaaggcagttggtagtacaaacgtcaatggcaatgtgattagcgtaaagatacctgataggtaaccagccgcttcggccgataacccagcttgttgcgccatcgttggcagccaggccatcgccgtgtagtaatacaatgactgtaacccaccgtatgccaacaaataccacgcccgcttgttacgccaaattgacgactgtgcgccgtcagctggtcggggttctagcacgtgattttgctttgtatttggtagccaaacaaccaaagcaagcacaatcaatactgacaaaatcaaaattaacgtttgccaattagttgctctgacaattggcacggctaaggatgatgccaggatagtcgcaatagtcatcgctagtgaatacgttgacgtataacgaccaatttgcgttggaaaatttgcaacgacggcactggggagcaacacattcaatgttgcaataccgacgccaatcaatacggttcctaaaaacaaaaatggcatcgaaataatgcgtaacaatgacccgactgccattaacaatacgaaaatagcgaacgacttttcaatcccccacttttggccaaatttcggtgccaagggggaaacaatggcaaaactcaaaagtggaatggttgtcaaaatccccaatgaactaactgacacccccaaccctttcgcaacttcactaataactggcggaattgatgtaaacggaatacgtaatatcattcccatcatcacaatgccaggcaccaaaaaaggtgactgattcttgttttgcataatgaactctcctcaatagatgcttcgctatctctctaaaacagcttatccattgtaagttaataaaaagcgctgcacaacaacgtgcaacgcttcactaatgctttttacttaaaatactttgccaagaaatcagcaaccttttgctcatacttagctgggttggttgcgtatgattgcacgtgtgaggcacctgggaccaagtacttttcctttggtccgtttgaggcgtcatacacttggttcaagaacttcgttggcacaaacgtgtcatccccaccgtgaataaacatcattgggcgcgtgttcttttgcaacaacttcaacgcgtcagcttcagcgtagtcgtaaccagccaaaacctttgagtacgttgaaaccactggcaagataatcttagccaaccacattggcaaaccatacatgtcacccgcttggtattccaattcgtcataaactgacgtgtaaccagcatcttcaatgtacgccttaacttgcgctggtgggttcattcctgacaacatcatcgtcgtggcaccacccattgaggcacccatcaccacgatttggctatcttgaccattcttggtaatgaccttactaatccattgcttgtagtccttggcatccaagtaaccgaaaccgatgtacttaccacctgacttacctgacgcacgatcatcgggcatcaacacgttgtagcccatgtcatggaacatttgtccataaggtgccattgccttgtgctccacaccgaatccgtgaatcacaacaaccgtcttgttggtcttcttttcagctggtacataattaccaaccaacttagtcccgtccttcgccgtcaaatgccacgtttgtgaatccaacgctaggaactcttgttgacgtgaatacaatggatccttcttcgtcaacacaccactaccgataaagtccttcttcgcacgcacctcggcgacgtggaagaaatacccaccagcagcaccgagaataactgccaacacaaccacgattgaaactacccaagtgaaaatcttacgtggcgttgaccagcgcttcttttgcttagccatattcgctaacctcttactcttctataaatgtataagtgcaacctgtccattataaggaagaacactagaaaataaaaggtataccccgttaagcaaataacgactacttcatgtgcaacaatgagtcgatcaacttatcgcccattcgatccaagtactgaccttggcgttcccaaagcgacttgccgctcaacgacttctcactttcagccggcaatggttgattttgcgtcgtaatcgccgcaactgccccaacaatccaaacacccaagctgaacaccactagtaatctcactaacttctttcgcatgccacaagtcccccattcctttttgttgtctctcagtctagtcgccaattgtcaggttttagcaggttttcggtcacgattgtgtaaatgttttgttaccaaattcggaacatgcccatcattatttttctcaaaaccagtcgccactgtgctaaactattagaaaactatgagaaatacggagcaccaacatgagctattcattgaactgggatttggatcccatctaccctggtggtatcgaatcacctgagttcgctgccaagctaactttactcgatcaacaaattaagcaattcgcgtctgacgtgactgcttacgaccgtttcacagacacggacttcagcaagttcgtcgctttggtgaacgacgcgcaagtgattcgttcaggtttgggcacggtggcgctattcgtcaacgccctttactcagccgactacacgaacccggtttaccgtccctaccaaacgaaggtctcacacttggaagttgcttaccaagccccattggacgcctttgcgaagttgttgacgtcatttgacgacgagacattcgctaaggtcagcacgttgcctggcatcgctgaagttgccttccacttgaacgagttgcgtgatgacgctgcccgcttgttggatgaccgcgccgaagaattgctcaacaagttgcgtttggatggcttgcaagcctggtcagagcactacgacaccatctcatctggtctttcaatgacgtacacagatgaaaacggcgacgagcaagctttgtctgcgggacaagctttgaaccaattggacggttaccctgacaacaaggtgcgcgccaacatcatggccaactacgaaaagatgtggggcagcgccgaaaacttggccgccgacacaattaaccacttggctggtgcccgtttaacggagcaagctgcccacggttacgaaaaccacttggatcaaccactagagttgaaccgtatgtcacgtgagacattggacgccatgtggcaaatggtcgatgacaacaagcacatgtttaaggcgtacttcgatcgcaagaaggaattacttggtttgacggagctaggttggcaagaccaagtcgcccctatcacagatttgggtgactacaagccaagcacgttgtcatacgatgaggcggctgcgttcattatcaagaacttcggcaagtactcacctaagatggctgcattcgcgcaacatgcatttgagaatcaatggattgaagcggaagaccgccctggtaagacgccaggcgcttggatggaaagtgtgcctgacattcacgagtcacgtatcatcacaacatttacgggttctgtgaatgacgcagcaacgattgcccacgaaattggtcacgggttccactcttcagtcttgacggacttgccagtttggcgtgatggttatgccatgaacgttgctgaaactgcttcaacgtttgctgaaatgttgattgcggatgccaacgtgcaagctgcccaatcagatgcggaaaaggttgtcttgttggatgcgaagatgacgaacccaatcgccatgttcttgaacatccacgcccgcttcatctttgaagacaacttctacacggagcgtaagcaaggcttcgtccctgctgcgcgtttgaatgaattgatggacgaggcacaaaatgtagccttcgatggtcttttggatcaccgtcacccacacttctggtcatcaaagttgcacttcttcattgatgacgtgccattctacaacttcccatacacgttcggttacttgttcagccaaggcatctatgcttgggcccacacgcaagataatttcgaagaggcttacatcgccttgcttcgtgatacggccaacatgtcaacggaagaattggcccaaaagcaccttggtgttgatttgactaagccagacttctggcaagctggtgctgatttggttaagaaggacatcgatgaattcttggctttgtcagagcaatttgtaaagtaatgccaaaaacgcctgcattcaattcagaatgcaggcgttttactatgcttattacttcttatccaaaatcatctttgacgttaggatggcaagtgatactgccaagcccattggcatcaaagcggtgtagtccaagtgactcacttcgaacatcatgaacaaggccatcaatggcgcttgttgtgaggctgctagcaatgccgtggcaccgataacggcggcttgggcaactgatgcacctggcatcatcatgatgtaaccgaagccaaggatggcaccgaatgatccaccaataccaattgatggtgccaacgtaccaccataggcaccggccttcaatgtgaagaccgtaatggcagccttaagcaacatcccaatcaacaagaccccaatcaccttcgtgctcgtgctgttaatggcgaattctgccaaaccacgtccgttccccataatttgtgggaagaagatggcaaccacaccagttacggctgcagccaatggcaattgccacaagacttgcacttgcttagccttggccttaccgccggcccattggaaggccttgcggaagtatgcacccgccacacccatcaatggtccaacgacaatcacgaatggaatcatccccaacgtgaagtgcttatcaggcacaaagtagtatgggtggaacccgtggactgacatgccgacccacatggcaatcgttgacatcgtcaagctgaccgcaactgaacgctttgacacgttcttgtgcaagatttcaacagcgaacaacataccggtgattggcgcgatataaataccggcgaaaccagcacccgcagctgccgcaatcaacaagcgacggtcgtcagccgttagtgaatccatgtgccaacggcgaagtagcttctcccaacgttgggcaagcaaggcacccagttcacgaggtgccaattcacgtccaactgatccaccagttgctacgtagaagacttgcgtcacggcgtgaacaactgaaggccagaatggcatctcatccccatccatcgccttgttgatgccaaccgttggcttcatcttcgtttgcacaatgaaccagacaatcgccgcaataattccaccaatcaatactgataaaaagcgttgtccgccagcaatgtgcgttgaaactggcatcagcgtgttttcttcaaatcccaagaagaagtgctcaaccagttccaagaacaagctgagcaacactgaacttaaccctacaacaatccccaaaataacggtagatagcgccaagacccccatcttgtgacgctcgctgtaagttttctcttccaaaacagtaacctcatctcaaataatcgtttacaaaaagttattataacacctaaaaagcccagtcgaaaaactgggctaatggttacttcactaaatagacacgctcatcaatcaagtcgaatgattgatggtgcgcgttcaatgcgggtacttcttctaactcggcttcgtgccagaagacatccgagtccgttgccccgtccttttcaccaatcacgatgaaatcaaaatcaaagcggtattggttatcacggatgtattgcaacacctgccaatctgcatcggttgtgtctggcgcccaactcataataaccgttgagacattctcaccgtacatatccaacgctgcgatggcatccatgttttccacatccgtcaccggcctagcagacgttggatctggttgtgtgcgccaatcctcgttgtccgtcgcaataatcttttgttccggcgcaatcgccttcaagccggctgagatatacccatgaccagccatcaactccaacaccggttggccgtccgtgtacgctgataagtcacgcacaaagtcacttgagacaaagccgtacatgctgaagtattcgattaacgcatcacgtaaatggcgaagcaagaagtcgatatcttctaatggttccgttaactcaagccagagcgcattcccagcatccgcgttatctgggtattgcgccaagacgtaatgttgcagttctggaatgactgactctggtacttccatcgttggcaatgcagctggcaaataacccgcattcaattgttcaagcgtatcaatcgcttgttgcatgaggttggccatcgtggggatgttttggtaacggtctagatatggcaacagctcaccaagatagtccatctcagtgagctgttggccagacccaaaccgaattgcttggtttgttgtcatgataatatcctttagttagaacaggctttcttggtggttgctacgcacatcatcctccggcgtgtatgataccgggttcaagtatgagttaacatactggaaaatgtcgaaacgttgctggtcagttagtggcttaccgttaaagtcgatttccttacctgacaagaacagcaatgacaagtcagtcttttctgacatggcacggccgaccaagaaatccattgaaacattgaaaaaatccgctagctttcgaacttcaatgtacgaaggcgaacggtcaccacgctcccagtttccgatttgcgcagctgtatttggtttttgccctggttcaaggtgcttattcatctcttcagccaaggtttccaatgtgatgttgcggcctttgcgcaactcacgcagacgatctggaaacatgtgcgtcgttctccgttttcataaagtagattgggcacgctaaaagccctaatatatttctattttaacgaacattaaccgatttttccacacccaaattgtggaaaaccacttattttatccacacgctgtgaattacggcttaactgtcaacacaaccacgttgactgtcacagctggtaatggcgtagcttccgctgccgcttgggcttctggacgtgcgccccagtgcaatggcgtcatgtgtaacagatcaacatacaagtcggcgggaatttgccattggtatgaaatctcggtttgcgtggcgtttggatagttctccatgaagcgatcaaccacttttttgttactgtacgtgtgatttggtgaatccacagggtacaacatttcacgcaattcgtgaagataacctgatgatgggaccaccttcaccaacgttccttcgggcgctaagacacgcttgaattcttcataagcacttggtgagaagaactccacgatactatcaaagctattatcgttaaatggtaggttcgctaagtcggcgaccgcaaagaacgcatccgtgtccaattgcgttgccaagttaacccctgccttagaaatatcgaacccaataccggtatcgatgttgccacgcttggctagcaaacgggcgaacggcgtcccttcaccagttcccacatccatgatgcgttgtgggtcggctggcaattgggccgcaactgcgtccacaatgccatcaaacaagccggccgtcaaaacacgacgacgggccgccaacatagcatcatcatactccgtattaacagcgtggttcaagaaataaagggaacccttcttgttaatgtccaagcggtggttatgcgcacataccaaggtattaccttcaacgtggtcataaggctcgccatctacggtacaacggaacatgtccaagtgttcgctgacgaacttaatccctttttcaatcttcttcatgtgattccttcctcattgctgcccagagcatatcatatagctgttcaaactctgcctcatgttcaaccttgtctgacttctgacgtgcaaacgtgacaatcgaccccaaggccatcgtcatgaatacttggactggcatgtcacgcagttcacctgtcgtaatccccgctgacagcatctcagcaaccacattttgttgctggtcagctggatcagccgccacacgattcaacaccggactgtctggcaactgcttaatttgcgaaactgtcgtcaatgtatctggcctttcaaccgcgatgcgatatagtgtccgcaaccagacacgcaccttcccagccagagtcggctcagccgttattgatgtgaccaacatgtcacgcataactgcttgctcatgttcaaagacttgtgttagcatatcagccttattattaaagtaaatatagatgttggattgcgagataccaacggccttggcgaccttcgttgttgataaactagccgccccttcagtcacgataatctgtatcgctgcctgaataattgtctcatacttcgattcatcttttttcttcatggtactaatataaccggtttattctgaaacgacaacgttgacaaaagataagtttatcttttatactaagtccaccaattaaagataaagttatcttttaagaaatagaggctattaaacatgaagattgcaatgcttggatcacttggtaacgttaaccgcgttgctgtacctgaattacttgacgctggccacgaagttaccctactaacgtcttcagcagatcgtgtcgctgaaatcgaagcgctcggcgcacacgcggtagttggttcaatgaccaacttggatgacctagttgccacattgactggtgccgacgtggcgtacctcatgttgactggtcgtgccacaggcagcctagtcgctcacggggaaatggtcggtaacttgttcaagcaagctatcgagacaactggtatcaagcgcgtcgttaacctcagcagcgttggtgccgatcaaggtcccgaaatcggcgctctttacgtctataacatcattgaaggtttgttggctagtttgccaatcgatattacgtttgttcgtccagtcgccttttacggcaacctaatgggtagcattcaaacgattaaagcacaacatgccatcattaacaatttccctgcttctcatcgtaatgcgtatgtttggcctgccgatatcgctaagacggttgtcgatgctatcttgcacccggttgccggtcaaacggttcgctacgtagtttctgacttattcaccggtgacgaattggttgctgcgctacaagaaacgttggccatgcctgatttgaagtggattgagatttcagatgagcaagccttagcaaatatgacagctaaggggatgccggaagcagttgcgactgaattcgttaagttgggggcttctcaacgtaacgaatctgcatacactgacttaacagcccacatgccagtccttggcgactttaagttggcagacttcttgccaatcttcaaggcagcctacaacaagtaaccctagcaaaaaagcgaatgattgctcattcgcttttttcggctaaatcaatgtcgtacgctacccgattgccggctagttttcctcggtatgtgaaaccacgccgggcgataattgcttgcatctttttatttttttcatgggtatcgatgcgaatgtagtcaaaactatttgcctgggctgtcgcaaataaatgcgtgaacagctctgtcgacaagtggtagccctggtgttggaatgacaccgccatgcgatggataaccgcatagggcttacgcttggtgggatacagccagcgcccgccttgcagacgctgatagttcacatctttttcttgccaaagcgtggccgtggcgacaatttcatcatcgagttgcaagatgtatgcgtaccctttggcgatgtcggctttgatgatttctggggatggataaccattatcccactgcggattatgatcaatagacatgactgccttagcatctgatataatttgccaaattgcgtctgcgtcagccatggtcgcttgtctgtaagttatactggccattagtctacctcacttcaataagcaacattatacgccgttttcggacaataattgtcaacaaaaacgtcatacctggttgcgataataacctcagtcataataaatgatttgcggtgagtcccatcgccgcaccttctttcaccactcggtactccttgccgggtggttttttgttgtccgaaaactaaaaaggacaaagcacaacatgtactttgtccttcagtaggttaattagtcttcaaaaccgtcagtcgtcattgatgcttggtacaaagccacaacatcatcaaccgtcaagttcacgtaaccaccctcgtgatccaaaccaccgatttcaacggctgactcagccatcgcacggaagttcgtctcatcgttgatatcaacaccttgcaaagtcgttggcacttccaatgactttacccagtcgtaagtggcttggatagccttctcagcaacgacttggtcatcggcatcttgaatgtcccaaacattgcgtccgaagcgggcaaacttagcaaccgtagctgctgacaaagcacgcttcatccaacgtggcgtcaagattcccaaaccaacaccgtgggtgatgtcgtagaatgctgacaattcgtgctcgattgggtgaaccgtccagccgttcacgtttcctgaacgtaccaaaccgttcaaagccatcgttgaagcccacatcaagttagcacgggcatcatagttatctggcgttgccaaagcaactggcgcccacttgataacagcacgcatcataccttcaatcataccgtcagaaatatctgtgttctcggcacggtcgaagtattgctcagtcaagtgtgagaagatgtcgattgaaccggcagccgtttgccactttgaaactgagtacgtcaattgtgggtccaagaatgaaacagctggtgtgtttggtccatacgtaccaatcttagcgttcaattctgggtttgaaataactgaacctgggttcatttcagtacccgttgcagccaacgtcaagatgtcgacaactggcaattggtccaactttgagcggtactttacaccgtggtcagcaaccaagtcccaggcatccccatcataaaactttgctgatgcaatcacctttgatgcatcgataactgatccaccaccaacggccaaaatgacgtcgatgtcgttctccttagccaaacgttgaccctcgcgaactgaatcaatctttgggttaggctcgataccgtccaattcagtgacgttcaaaccttccaaagccttcataacacgctcatacaagccagaacgcttgattgaaccaccaccgtacgtcaacaaaacgttttgaccaaattgggccacggcatcgtgcaattctgcatcgatgtggttctttccaaagcgaatatctgtcttatttacaaagcgaaaatcttccataattgtcgtcctccaatgagttgtgcagactactttacttactaaacgtaacatacactatacacctttaggggacgttaaacaaattctcactacgcaaaaaagcacttcaactagattcacatctaagttgaagtgctttttgttatgaactaacagcgattaaccgagattagtcgttgtgcaagttcattgagttttcaatatcagcgattgaaggaatcttcgtaccctcttcagttgatacaacaacaggatctgcaacgaccttgtcttcaacagcttggtattgcttcataccagtaccagctgggatcaacttaccgatgataacgttctccttcaaaccaaccaatggatcgttctttccacggatagcagcgtcagtcaagacacgagtcgtctcttggaatgatgcggctgacaagaatgagttcgtctccaatgatgccttggtaataccaagcaaaactggacgtgctgtggctggcaagccacccttcaacaacgtctcttcgttagcatcacggaattgcgcgatatccatcaacgtacctggcaacaagtccgtctcacccggatccatgacacgcaccttacgaagcatttggcgagccataacttcgatgtgcttgtcagagatctcaacaccttgcatacggtaaaccttttgcacttcacgcacaatgtagttttccgtagccaacgtgtcacgtacttggatgatttccttagggtcagctgaaccttcgttcaacgtctcaccacggtggatttgatcaccttcggccacacgcatgcgtgcagtcattggcaacgtgtaagtacgcgtatccgtctcaccttgaacagtaacttccttagtacgttctgctgggttttcttcaatagaagtaacctcaccagtaacttcagtaatcatagcacgacccttagggttacgtgcttcaaagatttcttgcacacgaggaagtccttgcgtgatatcgtttccggcaacaccaccagtgtggaaagtacgcatagtcaattgcgtaccaggctcaccgattgattgtgcggcaacagtaccaacagcttcaccaacttcaacaacgtcaccagtagccatgttgcgaccgtagtcgtatacgcagacaccgtgttccgtgttgcaagtaaaggctgaacgaatgttaacagtcgttacgccggcgttgacaatagccttagccttgtcttcgtcgatcatttggttgtgagcaacgatgacttcaccagtcttagggtcgataacagccttttgtgcgtaacgtcccaaaatacgctcgtacaatgactcgatgacttcgttaccgttcatgattgcagaaacatccaaaccacgatcagtaccacagtcgatctcacgaatgataacgtcttgcgcaacgtcaaccaaacgacgagtcatgtaacctgagtcggccgtcttcaaggccgtatcagtcatacccttacgagcaccgtgagttgagaagaacatttccaaaactgacaatccctcacggaagttggcgatgataggcaactccatgatacgtccgttaggcgcagccatcaaaccacgcataccggccaattgcgtaaagttagaaatgttaccacgagctcctgaatctgacatcatgaagatgttgttatcaggctcgaagtgctcaataagcttagcagtaatgtcatccttcgcttggttccagatggcaataacacgctcataacgctcatcgtcagtaatcaatccacgacggaattgcttagaaacagtagcgacttgcttgtgagcttcttcgatgattcctggcttttccttcaagtcagtaacgtcggccacaccaaccgtcaaaccagacttagttgactcatcgtaacccaagtccttcatacggtccaatagcaatgacgtttcagtaaccttgtagatcttgtagacttcggcaacgatgtctgacaagaatcccttcttgaatggaggcaagattggcgtctcagcaaagtgtgccttgatgtcagttcctggctccaagaagaagcggtcgtcaatggcgtgcaagttagactcagttggctcgttcaagtatgggaagtcgactggcaagatgtcgttaaagaacaacttaccaacagtcgtcgtcataatacgtgaacgttgctcgtcagtgaatggcttttctgcagggaatgaagacgtttgaactccaatacgcgtgtgcaagtgcacatacttgttttggaatgcagtacgagcttcgttgatatccttgaagaccataccttcaccttcacgaccatcttcttcagtcgtcaagtagtagttaccgataaccatgtcctgtgatggagccacgataggcttaccatccttaggagccaagatgtgtccagcggcaagcatcaacaaacgagcttctgcttgagcttcatctgacaaaggaacgtggatggccatttggtcaccgtcaaagtcggcgttataagcttcagtaaccaatgggtgcaaacgcatagccttacctggcactaggacaggttcgaacgcttgaatacccaaacggtgaagcgttggtgcacggttcaaaagaactgggtgctccttgataacgtcatccaagacgtccataacagcgtcatcacgacggtcgatcatacgctttgcggcacggatgtttccaaccaagtcacgcgcaaccaattccttcatgatgaatgggcggaacaattccatagccattggacgtggcaatcccatttggttcatcttcaagaaaggaccaacgtcgataactgaacgtcctgagtagtcaacacgcttaccaagcaagttttgacggaaacgtccttgcttacccttaagcatgtgtgacaatgacttcaatggacggttaccaggaccagttacaggacgtccacgacgaccgttgtcaaccaacgcgtcgacggcttcttgcaacatacgcttttcgttttgcacgataattccaggtgcgttcaactccaacaaacgcttcaaacggttgttacggttgataacacgacggtacaaatcgttcaagtcagacgttgcaaaacgtccaccttccaattgcaccattggacgcaagtcaggtgggataactggaataacatccataaccatccactctggcttgttacctgacttaacgaaagcttcgataatgtccaaacgacgaacggcgcgaacacgcttttgaccagtggcctcacgcaattctgccttcaacgtctcaacttcggcttccaagtcaacgtttgacaacaacgtttgtacagcttcagcacccatgccagcttcgaatgcgctaccatattcttgcttcaactcgcggtactcgcgttctgacaacaattgcttttcagtcaaaggtgtatcaccggcctttgtaaccacgtaagaagcgaagtagataatctcttccaatgaacgtggtgacatgtccaagaccaatcccatacgtgaagggattcccttgaagtaccagatgtgtgatacaggagcggccaactcaatgtgacccatgcgctcacggcggacctttgaagacgttacttcaacgccgcaacgatcacaaacgattcccttgtaacgaatacgcttgtactttccgcacgcacattcgtaatccttggtaggtccaaagatacgctcgtcgaaaagtccatccttttcaggcttgagcgtacgatagttgattgtctcaggcttcttaacttcaccataagaccagctgcgaatcttgtctgggctagccagtccgatttgcatgctttcaaacttattgacatcaatcaatggtttgacccctttcgtaggttcctatatacaatccaatccagcacttcactaagtccgtgcttaccatgctcgaataatcaaacgcagtaagcacgaacctagcaatgtgctaggttggctaacaatctcttaaaagtagcgcagggctaagaataatctcttattcagcgtcgttcaagttaacgacaccgtcagcctttggagctgatgcttcggcaccgtcggcagcaaattcttgtgccaaacgttgtgcttctgcattagcggcttcgatgttaacgattgaatcgtcatcatccatgtcacgcaattcgatctcacgatcatctgcgtccaagaccttcatgtccaaaccaagagcttgcaattccttaaccaagacacggaatgactccggaacacctggcttagggatttgatcacccttaacgatggcctcgtaagtcttaacacgaccaacaacgtcatctgacttgtacgtcaagatttcttgcaaagtgtgcgcagcaccgtaggcctcaagggcccaaacttccatttcaccgaaacgctgtccaccgaattgcgccttaccaccaagtggttgttgcgtaacaagtgagtaaggtccgattgaacgggcgtgcatcttgtcgtcgaccatgtgggccaacttcatgtagtgcatgattccgacagaaacacgcttgtcgaaggcttcaccagtacgaccgtcatacaaaacagtcttaccatctgatggcaaaccagcttccttcaaagcgtcccagatatccgcgtcacgggcaccgtcaaagacaggtgatgcgatgtggatacccaattcacgagcagccatacccaagtgcaattcaagcacttgtccgatattcatacgagatggcacacccattggtgacaacataatgtcgataggtgttccgtctggcatgaatggcatgtcttctgaaggcacgataacagaaacagttcccttgttaccgtgacgaccggccatcttgtcaccaacttgaatcttacgacgttgtgcgatgtaaacacgaaccatcatgttaacacctggtgccaattcgtcaccgttctcacgcgtaaagatacgaacgtcttgaacgacaccgccaccaccgtgaggaacacgcaatgacgtatcacgaacttcacgggccttctcaccgaagatggcgtgtagcaaacgctcttcagctgacaattcagtaacacccttaggcgtaaccttaccaaccaaaagatcaccgtcttcaacttcagcaccgatacggataattccgcgctcgtccaagttcttcaattgctcttcaccagtgttagggatttcgcgagtgaactcttcagggccaagcttcgtatcacgagcctctgattcgtattcttcaatgtggattgacgtgtaaacatcatcgcggatcaaacgttcgttgatgatgatggcatcttcaaagttatatccttgccaagtcatgaaggcgatcaatgggttttgtcccaaagccaattcaccttgctccattgatggaccatcggccaaaacttcgtcggcatcaactgcatccccaaccttaacgattggacgttggttgtagttcttaccagcgtttgaacgacggaacttcatcaattcgtacttatcaagtgaaccatcttcgcgacgaacgcggatttcgcgaccgtcaacgtactcaaccgtaccagggtacttagcaataatggcaacaccggcgtcgtgggcagccttgtattcgatacccgtaccaatcaatggtgcgtgtggatcgatcaaaggaaccgcttgacgttgcatgttggcacccatcaaggcacggttagagtcatcgttttccaagaaaggaattgcggccgtggcaacggcaacaatttgcttaggagaaacgtccatgtagtcaacttggtcgatagaaacttcgacgttttcctcactcttacgagccaaaacaacgtcagaagcaaatgatccatcttcgttcaaaactgagttaccttgggcaacgatgaagttatcttcttcgtcggccgtcaagtagtcaatcttgtccgtaaccttgtgagtcgtccagtcaacacgacggtatggcgtctcaatgaatccgtaacggttaacacgaccgtacgtagccaatgagttgatcaaaccgatgttaggaccttcaggcgtttcgatagggtccatacgtccgtagtgcgtgtagtgcacgtctcggacttcataaccggcacggtcacgagtcaaaccaccaggtcccaaggcagatagacgacgcttgttcgtcaattctccaagagggttagtttggtccatgaattgtgacaattgtgatgaaccgaagaactccttaacagctgccacaacagggcggatgttaatcaattgttgtggtgtaaccgtatctgggtcttggatagacatacgctcacgaaccacacgctccatacggctcaaaccgatacggaatgtgttttgcaacaattcaccaacacgacggatacgacggttgcccaagtggtcaatgtcgtccgttgcgccgatgcccaatggcaagttcaagaagtagttcataccagcgataatatcagctggttggatcgtacgaacagattcgtcaaattgaccgtttccgatcactggcaaaaccttttcaggatcctctgggttttcaaccaagatagtttgcaacgtcataggcgtcgttacaacaccttcgtctgaaggcgtaaatgtcgtcgtcttaaagtcgtcgcggtcaaggaatggtgccaaagcagccataaccttcttgtcgataaccgttcccttttcggcgataacttcaccagtatcagggtcggccaacgtctcacccaacgtcaagcccatcaaacgcgtcttcaatgacaacttcttgttgatcttgtaacgaccaacaggtgccaaatcgtaacgctttgggtcaaagaagcgagccgtcaacaaggcacgagatgaatcggccgtctttggctcacctggacgtaggcgttcgtagatgtccttcaaggcctcttcgacacgtgagtcgttgatgtccttgtgaacgtccttatccaacgtcaatgagattgaatcgtattggtcacccaagatttgcaaaacctctgaatctgatccgtaacccaaggcacgaaccaattcagtaacaggcaacttacgcgtacgatcgatacgtacgtagctcaatccctttgcgtctgtttcaaattccaaccaagcaccacggcttgggatgaacgtcgtaccgtagttaggacgaccgttcttgtccaattcctcgttgtagtaaacaccaggagagcgaacaagttgtgaaacgataacacgctcagctccgttaatgatgaacgtacctgatggcgtcatcaatgggaagtcaccgaagaacacgtcttgtgacttgatttcaccagtttcttggttcgtcaagcgcaacgttacgtgcaatggtgctgagtaatttgcatcgtggttacgagcttcttctactgtgtacttaggctccatgagcttatagtccacaaattccaatgacaactttccttggaaatcttcaattggcaaaatgtcagtgaacatttcacgcaatccttcatccaagaaccagttgtatgagtccgtttggatctcaatcaagttaggcaaatcaaggacttccttgattcgtgcgtaactgcgacgaacacggtgcttaccgtactttacaagcgttcctaccaagttttccacctcgctttgatttggccaactgcgcacaccagtttctttacagtttgattacaaaatctgttttttaccggtttttgagtgcaaaaaagacaacgacatttccgacttcgaaaacgccactgcccctgctataaaggctttcagggacaatatttcctgtcagccgttgtctatgcacaattaaactaccttatagtatacaagaaaaagcaagcattatcaaggtttgcgtcctttgtcaatactcgctttttcaaataaattatggttattctgtgaccgtctcttttggctcagcctttgccttcacgttaatcgtgatttcgccggccttcgcaccgattgtcacaacatcattcgttgtaatcttgccgctcaacaattcttctgacaagcgatcttcaaccttcgtttgtagcgcacgacgaattggacgggcaccgtattcaggatcgaagccagcttcagccactgcatcaattgcagctggcgtcatcttaacatcgaagccttgttctgaaatgcgcttcaacactgacttggccatcaacttcacgatttggtgtagttctggctttgtcaaagcgtggaagaccaccacttcgtcaatacggttaataaattctggacggaacgtctcacgcaatgtttgacgaacagtcgcattcattgcgtcgtagtccttagacttgtcgaccgcaccgaatccaactgacttctcatcacgcaaacgcgttgcacccaagttagacgtcatgatgataatcgtattacggaaatcaaccttacgtcccttggcatccgttaggtaaccatcgtcaaacacttgcaacatcaagttgtagatgtctggatgagccttttcagcttcatccaacaacacaactgagtatgggttacgacgaaccttttcagtcaattgaccaccttcgtcataaccgacgtaaccaggtgctgacccaaccaaacggcttgctgagtatgcttcacggtattcagacatatcaacacgaatcatgttgtcttctgaaccgaacattgcttcagccaacgccttagccaactcagtcttaccagttccagtaggtcccaagaacataaacgttccaattggacgttgtggatccttcaaacctgaacgagcacgacggatggcacgagcaattgctgaaacggcttcgtcttgaccgatgacacggtcgtgcaaaaccttctccaagttcaacaaacgctcttgctctgacttctccatttgcgttagtggaataccagtttgctctgaaaccacttcagcaacatcgtgcgtcgtgacttccaagtcgtagtttgacgttccttcaggttgctcagcatcacgttctgcgatgtacttatcaaccttcttcttttgcgtcatttccttcttgcgaagttgggctgccaattcgaagtccaaagattcgatagcggcatccttttcagcgcggatagcttgcaacttttcttcaagcttagccaatggcgtcttgtgacctgaacgatcgatacgcaccttagccgcagcttcgtccatgatatcgatggccttgtctggcaagaagcggtccgtgatgtagcggacagacaacttaacggcatcaactaccgcatcatctgaaatggcaacttggtggtgttgctcataacgtgacttcaagcccttcaaaatttcaatggcgtcagcttccgttggctcatcaacttgcacttgggcaaaacgacgctccaaagcagcatcagcttcaatgtacttttggtactcatccaacgttgtcgcaccgattgtttgcaactcgccacgcgccaaagctggcttcaagatgtttgaggcgtcgatggcaccttctgcaccacctgcaccaatcaacgtgtgcaactcatcaatgaacaagatgacgtttccgtcgcgttggatttcgtcgataaccttcttcaaacggtcttcgaactcaccacgatacttcgtgccggcaaccaaagaacccatatcaagcatcatcaaacgcttcttagccatgtcagctggcacatccccagcgacaatcttttgtgccaaaccttcagcaatcgccgtcttaccaacaccaggctcaccaatcaagaccgggttgttcttcgtacgacgtgacaaaatttggatgacacgcttaacttcagcagaacgtccgacaactggatccatgcggtgatcacgcgcttgttgcgtcaaatcacgagccaatgaatcaagcgttggtgttccttcttgtgcttgttggttaccacgacggccaccacgagcatccttcttgcgcgccgtatcattgataccaagcttacgcaaaatcacacgacgcatttcaccaggatttgcatccaatgaaatcaagatacgtgatgacaaaattgagtcgtcggccaacaatgccaacaagatgtgttctgtaccaacacggccttgttgcatgttacgagcttcttcaccggccatttgcaacacttcaccagcctttggtgagtatggcaagtaagcttccttttcagcacgtgacaacgtaccgtaaccagtgaagcgctcaatctcctcacgaatatcatcgtctgagatattaaattgttgcatcaccttgctagcgataccttccttctcgatggccaaagccaacaaaaggtgctcagtaccaactgcttggtgcttaaaatactttgcttgttcttgcgccaaaacaagtacgttcttggcgcttggtgtgtattgattatccatattaattacgctcactttcaaaccgcattcggtttaataattgacgtagcaatcgtccgcgtagacgtccttcaacttgaacatccccaacgtccaacgcttccttcgacaacattgtcagcaacagttcctgctcccgttccgttaataactcatcacgtactaaacttgataagatatcgcgaacctcacgaacactcacttgatcagaaagacttgataacaactcttcaatataacgaggatcagccctcagtggcacccgctcaatgcgaataaagccaccgccaccacgctttgaaatcacatgataaccttgttgaattgaaaaccgtgtcttaatgacatagttgatctgtgaaggcacaacgttgaatcgttccgcaagctctgcgcgccgaatttcaatctgttctgattgctgcaaaatctgtttgagatatgcttcgatatagtctgacatattttgttcagccatcttcgtgcctccttgaccaatgttgacattattatagaacgtgcggttcactaatgccaataattcgtcatgtcgtttctgacttatggtaagtttaccattaaacacaaaaaccaaacaaaaaatttcacacttaatcgattatgtaaatcgtaccaaacaagtttgcctattcagttcgaaatcttgtggtaaaacacgacagaaaaaccaccaagttattacttgatggtttttccaatcgatgggcctagcaggactcgaacctgcaatacccggttcgtagccggggtgtttatccaattagcatataagcccattatttaattatttgatcctataaagaatcagaagcgaacaacgggattcgaacccgcgacctctaccatggcaaggtagcgttctaccaactgaactatattcgcatcaaatgccgactactggattcgaaccagcgaccccttcattactagtgaagtgctctgccagctgagctaagtcggcatgtctatcggtaaaccgataatacggatgacaggaatcgaacctgcacgcccgaaggcactggaacctaaatccagcgcgtctgccagttccgccacatccgcaacagacgtcttttcaagttattcgcttgaaacaacttttatataataacaagtacagaagcaagtgtcaacacttttttcaaactttgttattttggaacgcttggcagcggccccggtaggcatgtcgcctaaccacttgatatataatactcgcctcgctgtcttttggcaatacttttttcatagaaaaagcgcatttcatacaaaaaaggtgaccacccattgtgatcacctttatctctaattacttagttgccgtaatgtcgtagttgctcttgccgaacataccacgccaagtcgttgcgaaccagtttgcacgtgcctcttctgaaactgaaaccaactcaacttcaggggctcccgtcaaccagtcgttggctgccgcaaatgatgattccaattgcgccgttcccaacttctcgttttgcttcaatggtgctgtaaccttcttgctcaacttcacgttgactgcctttgtcgttgctgactcaccagctggcacgaagaatgaagccgttcccttagtcttgtatgaaaccttgccatccttagccgtcaaaactgagaccgtgttcttagctggcttcaaacctgaggccaccttttgcaccttaacagcatcatcagccttcttaaccatcgtcaacgttgcgttaaacttggcagccgcatcagcgttgtcacctgagttcaaaacaactgagacaactgggcggccttgaatcttcgtcacaccgacaaagtttccacctgcattaggcgtcgttcccgtcttcaacccaagccagttcaaatcaaacgtttcgttacccaacaattcattcgtgttgttcatcgtttcagtaccacctgaaaccgcagggaattcaaccgtcttttgttgtgccgtcttcaacacatcagggaaatcaacgaccaaacgacgagccactaccgccaattcacgagctgacatttcgttttcaacatcatcctcagctgatgcatccttaaacttcttcatgtcgccattcgtcaaacctgatggtgagtaaatcttcacgccagcaatgccccagctctccaacttagcttccatcatcttctcaaacttagcttggctaccacccaacaagtttgccaacaacaaagcagcaccgtttgaagatggcaccatcatcgcgtcgatcaattgttgcaccgtgtacgtcttctcagccgtcattggcgtgttagccactgacaagtcttgactgaaggcggcgatgtcctcaggcaccttcaccttttgtgacaatgaaatcttacctgacttgattgcttccttcaccatgtacatcgtgatcaacttagtcgttgaagcgattggcaaacgctccgttccgttttgatcagcaattacttgaccagtttgggcgtcaaccacaacacccgccttcgttgattgtaggcctgggtcaaccaacgctgcactcgcgctcgtcccaactgatgccaacacacccgctgccatcaaacctgccatcatttgcttcgtaaccttacgcatatcttttcctcactcttatcgcgccacagtcatcattccgtaacgcattacttaatatacttattatttacaaataacttatgcattatttgcctgaaatatgaagaaaatgtggtcgtcgggaaaagttagtttgtggttagtgtccgaccttccatgcctcgacgcaacgcgtcgacacaaaccactacaaaaacaaacgccaaacaaaaaagcccaacaaccaaaactgattgttgagctaaatcaatgtttaattttacaacgtgtcttctggcacgatcttgtcggcaccgaagtatggacgcaaaacttcaggaaccgtaaccgttccgtcttcgttttggtagttctccaagatagcagcaaccgtacgtccaaccgccaaacctgaaccgttcaacgtgtgtacgaattgcaacttaccttcttcgtcacggtattggatacgtgcgcgacgtgcttggaaggcttccgtgtttgaaactgatgaaatctcacggtagatgtcttgctcaggcatccaaacttccaagtcataagtcttggcagctgagaatcccatgtctcccgttgacaacgtgatgacgtggtatggcaagttcaacttttgcaagatgttttcagcgttagccgtcatgtcttccaaagcttggtatgattgctcaggcttcgtaaacttaaccatttcaaccttgttgaattggtgcatacgaatcaaaccacgcgtgtcgcgtccagctgaaccagcttcttgacggaatgatggtgaaacagccgtaactgagtatggcaacttgtcagcatcaattacttcttcacggaagtagtttgtcaaaggcacttcggccgttggaatcaacgtcatgtcgtcgttcgttccaacacggtaggcgtcttccatgaacttagggtattgtcccgtaccaaacatagcagcatccttaaccatgtatggcgtgatcatttccttgtagccttccttttggtgctcgtccaacatgaagttgtaaacggcacgctctaggcgggcaccttggccaacgtagtagacaaagcgagcaccggcaaccttagcaccgcgctcccagtccaagataccaaggtcttcaccaatttcgtagtgggcctttggcttgaagtcgaatgaaggaatttctccccaagtacgctcttcacggttagcttcttcgtcagcaccaactggaatcgttgggtttggcaagttagggaagtgcaacatgcggtcttggatagcctcgtcaaccttagcaacttcttcgtccaattccttgatcttagcagatactgcttgcatctcggcgatagtttctgaagcatcttccttgttgcgcttcttcaaaccgatttcgtctgaaaccgtgttacgacgagccttcaactcttcagtttgtaccaacaattcgcgacgcttagcatcatcagcaatcaatgcatcaatttctgatgggtcaacaccacgcgttgccaaacgttccttgacgctttccgtttcgttacggatcaacttcatatctaacatattcttattctcctaattaatcacgcaaacccaattcatcaatcttttcgtcgatcaatgccaaaactgccttggcagcttctgggtcattcacaaagtcgtgcttgtcaccatcgatacttagctttggtgaacggtcataactttcgaaccaagcaatgtagcgttcgttcaacttcttgtagtagtcgtacaatgatggatcgtggtcgatttgctcgaagtcgcgaccacgcttttgaatgcgggccaacatcgtatcgaagctaacatggatgtaaatcaacaaatctggcgtctttacgatggcgtcgtcagaaaaatcaacttgctccatcatgttgttcaacaaatcaccgtagatagcaacttcagtttgcgttgcacgttccaagtcagcgttcaattggaacaacaacaagtcctcaaagattgaacggtcgataacgttcaacttgcttccttgtgcgtccttgatgttatccatacgcttgttcaagaaataattttgtagcaagaacgcgtacttctttggattctcgtagaacaaaggcaaaattgggttgtcatctacggactcataaaatgcttcacttcccaagtgctcagcgagcatcgtcgtcaaactggtcttcccagctccaatagttcccgataatacaatcatcgtgtcgtcctgctttctcaaatcataattaattctattttagcaaattttgcgcgtgcttaaaactcccttatttggttaagcggtcgctatattttgccgtgtactcttcaagtgctgggatgtcatcgctcttagacttgttgtaatcaccaccagcattacctgtgtattgttcaagggagatattttgttccttaataaccttagccgctgtcatgccaacatagcgcatgtgccattcctcgtgagaatagccggttgaactcgttaggtcagctgggtaacggacaatcaaaccatacttgtaagcattgtcacgcaaccacttggccgcagctggatcagaaccaccttctgcaaacaaaccaccgctaccgttacgcaagtcgaacgccaaacctgattggtgttctgagtagccaggtcgcgctgataccgcatcggcttcagcttggccttcagacgcaacgtaaccatcatacaacgtcttttgataatcatagccacggtagccagacactgtatcaccaacatcaaagccagcttgcttcatggccgcaatcagttggtccttggccgtttcagtgcgtggactcaagccgccgttatatggattgtagtcagctggcaatgggtgcttcttattcacaaccatcaacagcgtcgcttcttcgctgcctggcttaagagtcaccggataagccttcttttcactgcttgattgttgctttgctggttgcttagtcgtcgtttgcgtcttctcagctggttgatcttggtgcaataaccaataaccaccaccggccaacgctacgacaaccagaccggtaccaacaagttttccaaatttcattctcgcattcccctcataatatcattgcttctagtgtaccattttgtatacaaaaagggccttgaacaaaatgttcaagacccttaaattcgcaatctattacttctttccagaagcaacgtggatacggttcacggcacgcaacaaagcgacctgtgcacgttccacatcacgagttgagttatcatcagccaaacggcgctcagcgcgttccttggctgactccgcacgagtaatgtcgatgtcagcagcacgctctgcagcgtcagcgacaaccgtcaactcgtttgaagaaaactcggcaaaaccgccactaacggcaaggcgttcttcaacaccattgacgtcatcgacaattttaacttcgctaaccttcaaagcagcgataattggtgcgtggttcgccatgacacccacttcaccgccagtcgtgctaagcacaaccaacgtagcagtctcataatcgaacacgacaccgttcggcgttaccaccttaacatgtaggctgtgttcattcatggcgcgccctcactattgagccatcgtagcagccttttcagctacttgttcgatgacaccaacgttacggaaggcatcttcagggtattggtcgtacttaccttccaagatttccttgaagctacgtacagtttcagcaactggtacgtactcacccttcaaaccagtaaacgtctcagcgactgagaatggttgtgacaagaagaattgaatacgacgagcgcggttaacgatcgtcttctcttcatctgacaactcatccatacccaagattgagatgatgtcttgcaactcacggtagcgttgcaaagtacgttgtacttccgtagccacttcgtagtgttcttgaccaacaatctcaggcgtcaaagcagttgacgttgatgccaatggatccacggctgggtagataccttgttgcgtcaaagcacgctccaagttagtcgtggcatccaagtgggcaaatgtcgtcgcaggagcagggtcagtatagtcatcggcaggcacgtaaacggcttggattgacgtaactgaacccttttgcgttgacgtaatacgctcttgcaattgacccatttcagttgccaacgtaggttggtaaccaacggctgatgggatacgtcccaacaaggctgaaacctctgaaccagcttgcgtgaaacggaagatgttgtcgataaacaacaacacgtcttgtccgttaacatcacggaagtgctcagcgattgtcaaaccagtcaacgcaacacgcatacgtgctccaggaggctcgttcatttgaccataaaccatggccgtttgcttcaaaacgcctgaatcttgcatttcgtggtacatgtcgttaccttcacgggtacgctcaccaacaccagtaaatacagagattccgttgtgaccttgagcgatattgtgaatcaactcttgaatcaaaactgtcttaccaactccggcaccaccaaacaatccgatctttccaccacggatgtaaggtgccaacaaatcgataaccttgataccagtttcaaggatttcagtagatgtggccaattggtcgtaagctggggcctcacggtggatagggtcacgaggaacatcctcacccaactcttcaccaccatcaacggggttacccaaaacgttgaacacacgtcccaacgtagcttcaccgacaggcacactaattggtgcattagtgtcttctacggccattccacgttgcaaaccatcagttgagtccatggcgatcgtacgtacgacaccatcacccaaagccaaagatacttcgaccgtcaacgtaccttgctcacccttatcgatgatcaaagcgttgttgatgtcaggtacttgagttcctgatggaaaggcaacgtcgacgactggaccaatgacttgaacaacacgtccggtactcattgtcgtttccttccttcatttcaaaaggttgttatgacgcttggattaatccaaagcagccataccacctgtaatttctgtaatttccgtcgtaatcgcactttgacgcgcacggttaaattgcaattccaacgtacggataatctccttagcgttatcagttgcagatgacattgcgttggcagaagccgcgtgctcagccgtcttggcatccaagatagcaccgtagaccaaactctcagcatattgtggcaaaaccacaccaagaatttgttctggagaaggatccatttcgtaatccgccttcactgaatcttcagacgttggttccatgtcgtcagtagcaactggcaacatcttctccaaacgcaattcattttgaatacgtgatacgaagtgttggtatgcaacagtcaactcatcaaagacttcgttatcgtacattgtcgtaacggtcttaacgatttcgcgaacctcgttaaaggtaggcacgtcagacacaccacggtattcgtacgcaacgttgtagccacgcttcttgaagaagtctgaggcattaccaccaacggccaaaataaccacttggtcaggcgtcaattgacgctcttcgataatcgccatcatacccttcaatagcgttgagttataaccaccaaccaaaccacgatcagaagagatgaccaagaagccaaccttcttcacatcacgttgttctagcaaagtaccagaaacattgttgatgtgcgcattagataagtgagccacaacgtcgtgcaaggcgttagcatacgttgtgtatgatccaccgtgacgttgaatttggctcaacttagccgttgagaccatttgcatggcactcgtgatttgtcgcgtcttttttgttgaggcaattcggcgttgaatatcttgcaaagaagctgccatttatcgcccctccctaattattgggcacttggcgcaaaggttgccttgaactccgtaatagcggcgttcatagcatctgcatcaggcaagtcctttgtgtcaacaatcgtttgcaacaattcgttgtgtgaagcacgaacagctgcgatcatttctgattcgaagcgttggatatcttcaacagcaacatcgtccataaagccacgagtcaaggcgtacaatgacaaaacttgctcttcaactggcaatggttggtgcaaaggttgcttcaacaactcaaccgtacgacgaccacgggccaacttagcttgcgttgccgcatccaagtcagaaccgaattgtgcgaatgactccaactccttaaatgaagccaagtccaaacgcaacgttccggcaaccttcttcatcgccttaatttgggcgtcaccaccaacacgtgaaacagaagttccggcatcgatggcaggacgaacaccggcgtagaattggtcggcatccaagaagatttgtccgtctgtgattgagataacgttagttgggatgtacgcagaaacgtcacccgcttgcgtttcgataactggcaaagcagtcattgaaccgccacccaattcgtctgacaacttagcagcacgttctagcaaacgtgagtgcaagtagaagacgtcaccagggtaggcttcacgtccaggaggacgacgaagaatcaatgacagctcacggtaagccgtagcttgctttgacaaatcatcgtacacaatcaagacgtgcttgccgttgtacatgaactcttcacccatagctgcaccggcataaggagccaagtacaacataggagctggttctgaaggaccggctgacacaacaatcgtgtaatccaaagcgcccatttgacgcaaagtttcaacttgcgtacgcacagttgaatccttttgtccaatagccacgtagataacgatcatgtcttgatccttttggttcaagattgtatcgatggctacagacgtcttaccagtcttacggtcaccgatgatcaattcacgttgtccacgtccaattggaaccaaagcgtcgacggccttcaaaccagtttgtagtggctcgaaaacagacttacgctccataacacctggggcctttacttcaacaggacgagtgctcgtcgtgttaattggtcccattccgtcgattggttgacccaatgcgttaacaacacgtccgatcaatccctcaccaacaggcacttccatgatacgaccagtgcgcttaacagtatcgccttcgcgaatctcgtcgtacttacccaagataatgataccaacatcattagactcaaggttttgtgccataccaaatacgccgttctcaaactcgaccaattcaccggcaagagcgttctccaaaccggttacacgggcaataccgtcaccaacgtaggtaacagttcccgtttcttgaacagtcaattcgtcttgatagttggccaattggctcttgatgagtgaactgatttcttcagctttgatgctcatttcagcagttcctctttctttaaagtgtgtctattcatcacacacaacatcaatttctactagattttcagattactagcggatgatactctgacgaatagcagctaacttagttgctaatgacccatccaaaatctggttgttcgcttgtacaacaacaccaccaagcaaggcttcgtcgacaacttgtgtcaacttaatctccttagcttcaaagcgctttgcaagttgttccgtcatacgggcagcttgttcgtcgctcaaagcaacagcagtcttaacctcggcatataccacaccttcagacttgttaaccaagtcctcgtaagccgtgataattgcaggtaggtcgctgaaacggcgataatcatacgccatttgcaacaagttcttaaccacttggctagctccatcagatagcgttgctaccatttgttgcttagctgactcaggcacacgcattgattcgatagccttcgtcaattctgggttttccaccaatactgtacgtacttcaaccaattcggccaaagtcgcagcatccgtgttttggtcatgggttaattcgaacaaagcaacggcatatcgcttagcaatcgttgcttgatccaatgccattacttgttacctaacccttcgatgtaggcgtcaatcaacgccttttgatcatctaactttagttccttttggataatcttttgtgcgatcgtcactgacaactcagcaacatcgttcttaacgccagccattgcttcggcacgctcttgctcgatttgagctgaagcttgatccttagtagcttgggcagctgcgtgcgcatccgcaacgatttgatcacgttggtttcctgcagcagtcttagcgtcagcgatgatgccgtttgcttcagtgcgagctgattgcaattgagctgaacgctcagctgcatcggcttcggcttgcttacgggcctcttcagcagagtccaaatcgttagaaaccttttccgcacgcttttccatcatctttactactggaccccaagcgaagtgcttcaaaagaagcatcaacacaaggaatgccactagtacaaacaacatgttacccaaagccaacccttcgctagcacctgctagaacaatttgattaatcataattagttggcctccgcgttactattacttgctcaacaacatgaaggcaatggcgatggcaatgataggcacggcctcgaccaatccaacaccgatgaacatgttagaacgcaacttaccttccaattcaggttggcgagccatacctgagatcatgcttgaaataacaataccgttaccaattccggcaccaattgcggcacccgctgcggcaacaccaacaccaatggttgcaacgtccatttttttaatcctccgattaattaagaaaaaaattactcttcaatctcagtcttttctgaaacgtaaactgtagtcaacgtaacaaagacataagcttgaatacttccgacaaacaaagagaatgcttgccaaatcatcgttagcaagaatgctggaacgaatgatacgacaccggctgattttgccaattcccaaagaagagacaagaccatttcaccggcaaaaatattaccgaacaaacgaagtcccaatgtcaagaaactcgtgaattgttcaataatgttaattggcagcaatgcgctgaatggactcaagtaaactgacttgaagtagtttttgaatccgagcttttgaacacccaagtagtgggacattccgattgcaatcaatgccaaggtcatcgtgaccaacggattagccgttggagaacgcaagaacgttacgtcattgaagtcaaccacgaaggcaacacctaattggttggcaacaaagatgaacatgaacattgagaatgcgaagaactttaaattagttccagttcgatttggaagcgatccatcaacgataccgttggtaaagtcgataatccattcaaggaagttttgctttgatgcaccagctggcttcataaccaacttacgtgacatccaaaacgccaagaagaaaacaatagcgaatgtaacagtcgttgaaataatgatgctccagtcgaacgttagccccgcaatgctaaaggttgcggtcttctcacccacagaaatccacctctttcctttctaaataatcgcggtgatgcgcagaacacagaccgtttaaaacttttaccccctaatattacgccttttaattgcgaattcaacattttaagcttcaacacttttgtcccaaatgtgcaatcagatttagaaatgccgtaaaaccgcggttttaaacattccacttcggaatagttttatatttatatccataatttgatattttagatattataaaaaatagcataatcctaggcgtaccaacgcctattcccgctttttaaaggaaaaaaccgcggtattccatatcggaaaccgcggttttactttgtataattattaactatttctctgaagcagccttttctggcaagaccaaattcaagaaaatccccaaaacagtggcgatggcaacaccagagaattggatgatgtcgttaccctcacctacttgtaggtaagcgttaccgataccgataaccaaaactgatgacgcaatcatcaagttacgcttcaagttgaagtcgatcttgttttcaacgatgatacgcaaacctgacgcagcgataacaccgaacaacaagaatgacacaccacccgtaacagcgccaggaattgattgaatcaaagctgacaacttaccaacgaatgagaacaagatggcgaatacggcggcaccaatcaaaacgtaaactgagtgtaccttcgtaatggccataacaccgatgttttcaccatatgaagtcactgaaggtccaccgaccaatccagcaaagattgaggcagtaccgtcaccagccaacgtacggtgcaaacctgggttgcgcatgaagtcgcgtcccgtcaaatcatccaagaccatcaagtgacccaagtgctccgtgattgttaccaaagccaatggcgccataacgatgattgcgccccagtgcattactggcttgtaatcaacgaatggaatgtcgaagtctggcaaggcgaaccaagcagcgtgcgcaactggtgccaaatcaaccaaaccgaacaagatggcgaagatgtatcccccaacgattcccaacaagattggaatcaaaccaaggaagcccttcaagaacatgttgaagacaatcgtcaatcccaatgtgatcatcgcaactgcgaagacgcgaatgtcgtacttgccgttcaacaacgttgctgattgcgcagctgatgatgacaatgacaaaccgataaccatgatgattgggccgaccacgattggtggcaacaacttttcaatccagtttgtaccgattacggcaacgatggctgccacaatcaagtagacgataccaactgagataacaccagtggcaacaccagggtatcccgtggtcttcatcaaagccaccatcggaatgatgaaggcaaaactagaacccatgtacgctggaatttgcttcttcgtaatcaagatgtggagcaaagtacccacaccagaactgaacaaggcaattccaggattcaaaccaaccaacaacggtaccaaaaccgttgacccaaacattgagaacatgtgttgcaatgacaatccgatccattgcaagaacccaggcttctcattaacgtcaagtacgacgtcacgcttcatatccatgagcaaactcctctttaattcccgtctttatacaaaaaacagccaggacgactatgtcatcccagctgtaaaaaatcttctaacgtacggttgcacgttgacccgaacttgtcagtctcgctgggctgacttaaagacgtcttttcttaacttcacttagtataaactagttaacaaagttagtaaacaagccagctccacgttaaacgtttaaccttttatattaaattgacttaagcgtatccaaggccaacttaatgtcagtttcgccttgacgcattgaaatcacgcggtggaatgtgttctcacacttcaacatttctgacaacaccttagccacgtcggcgattgtgttcttgcctgtaccggcattctttggattcaaatcaaccttgcccgtggctggttcttcaaccaacccaactggttgcaaaatcgtgtagttcaattccgtgtggtccatcaaccagtgatcaccaaagaacttcgcaatgttgtagttcatcatactctcgtcttgccattcggctggtgacgttgagtgccatgatgacaacatgataaagcgcttgatgcccaacttatcagctgccgtttcgagcttcaccgcaccaaaggcatcaatttgcaacaatttcttaccacgtgagccggccacgaagtaaatggcatccaattccaatggacgcaactcaccaaccaacgttgcttcgtctgccaacaaatcaatattcttcacttcaacaccttcaccaaaatcttggtccgtgtgacgcgttcccgcaatcacttggcggccatccgccacaaggttcttaaccaactcttcgccgacgcgcccactagcacctactactaataccttcatcacgtatctcctcaatttctattatcatcttcacaactattatcaaagacaaaaatggagaccgcatgaattaattcttgcagtctccaaattttctttaactaattagtgagtaccgaacaaacggtcacccgcgtcacccaaacctgggatgatgtatccgtgctcgttcaaaccttcgtccaaaccagccgtgtagatatcaacatcagggtgggccttttgtacagtctcaacaccaactggtgcagaaaccaacgtgatcaacttaatcttagttgcaccgcgcttcttcaaagcgtcaatggccatcacagctgaaccaccagtagccaacattggatcaacaaccaaaacttcacgttggtcaatgtcttctggcaacttaacgaagtattcaactggctccaatgattcttcatcacggtacataccaatgtgaccgatacgtgcagctgggatcaacttcatgattccgtcgaccatccccaaaccagcacgcaagattggcacgatggccaacttcttaccagccaattgcttttgcgtcgtcttggcaaccggtgtctcgatttcaacatcttcaactggcaaatcacgtgtgacttcataggccatcaatgaagcaatttcatcaacgatctcacggaattccttcgttccaacattcttatcacgaataatcgtcaacttgtgttggattagtgggtgatcaaaaacagttagcttgctcatgtcatgtactccaattcattttctactattatacaggtaattgttattcagcgtgttcaattccactcaatgggaacttatccgtcaacgtaataacttccttcgcaatcatatcaagaacttcttggttatcgtggttctcaaaggcacgcaaaatcatgtgtgccacttcgcgagcttcatgctccttgaacccacgcgtcgtaattgctggcgttccaatacggatacctgatgtgatgaatgggctacgaggctcatttggaatggcttccttgttggtcgtaatgtgaatgctatccaacaagttttgggcttccttacccgtcaaaccagtggccgtcaaatcaaggttgaacaagtggttgtccgtaccaccagaaatgacgcgaaccaaatctgattggctaaacacttcagccattgccttagcgttggccacgatttgcttaccgtattccttaaagcttggttgcatggcttcgtagaacgcaacagccttaccagcaatcacgtgttccaaaggtccaccttgcgtaccagggaagatagctgagttcaacttcttgcccaactcttccttggccaaaatcataccaccacgaggtccgcgcaatgtcttgtgcgtcgtcgtcgtaaccacatcggcgataccaactggtgatgggtgaaccccagcagcaatcaaaccggcaatgtgcgccatatcaaccatcaagtatgcgccaactgaatcagcgatttgacggaaacggtcaaagtcaatgaaacgtgagtaggctgatgcaccagtcacaatcaacttaggcttaaattcttcagccaaagcttgcacttggtcgtaatcaatcaactcattctcatccaaaccataggcgtggaattggtacgtcttacctgagaagttaaccggagaaccgtgcgtcaagtgaccaccagcgtcgaggtccatccccaacacgtggtccccatgttcaagcaatgccgcataaacagctgcgttggcttgtgaccctgagtgtggttgcacgttggcatagtccgcaccgaacaattccttggcgcgatcaatcgccaattgctcgatttggtcgataaactcagttccaccgtagtaacgcttgccaggataaccttcagcgtaattgttcgtcaaaatgctaccttgcgcagcacgcacccctgctgatgcaatgttttcagatgcaatcaactcgatgttgtgctcttgacggtcagcctcgcggtcaacggcagcccacaactctggatcaaactcacgataatttgtcattcacatgacctcctattaaatccccaaatataaacgatatccccaaaattaatcagctaacagttccgttacccaatgaccgccggaagactttccaagacggttattgtaggcactgttctctggtgtcgatggcatggcagccaccaaaaccgtgcgcacgtccttgcgatcatcaaagtaacgcaaaccggcgaacaattttgctgctgcggtatctccattatccccgagagaccacacaaagtccatgccagccaactggtgttgcataattaaatcattcgtcaacatcaaaccaaccggttccaattgtccttgggcccaaatgatggcttgcgtccagtcttctggtgccaccatgtacacatccttatcaggtgcgtagtggcggtacttcatgcctggtgccttgggtgcttcatcagcatccacgtgacgaatttctgaatcaaccgccacacctagcacatcttcaatttgaccaggtgtaatcttacctggacgcaaaacggctggttggtccgttgataggtcaatgactgttgattcaaccccaatcttcgttgccccatcatccaagataccggcaatcttaccatgcaaatcatggtaaacgtgttgggccgtggttggtgatggcttacctgatgtgttcgctgatgggccaaccaatggtgcatcagcctcacgaatcaacgcacgcgtcaaatcgttatctggcatacgcgctgccaccgtgtccaaaccacccgtcactgtcgttgaaaccgtgccgggcttgactggcaaaatcatcgtcaatggaccaggccaaaaggcgtccatcaacttctttgcccagtcgttcacctcagcaaagcggtcaacttgttctgggtcggaaacgtgcacaatcaatgggttgtcagatggacgaccctttgcagcgtaaaccttaccaacagccgtatcgttaaacgcatccgcgcccaacccatagactgtttcagttgggaatgcaacgagtgacccacgcttaatcgcgcgaaccgctgcgggcaattcatcagctgaccaaatttttgtctctgccatgttatgcctcccgtgacactttaatcatgcgatcatgtccactcatgtcttggcgcaatgatactgagacacctggcaactcgccaaagaccgctagcaaagctggtccttgttgatagccaatctcaaagtatgctgctccttgtggacttagataatttaatagttcggcagccatcttcttgtacaaagccaatccttcgtcgtccgcaaacaacgccaaatctggctcatacataatgactgattcatccatcacgtcgcgctcttgctcactaatgtaaggcgggtttgaaatgatgatgtcgtattgacctgaagccgcactaaacaagtcactctcaatcaattgcacttgcttggcaaattgatcagcgtttgacttggcaacttcaagggcgtcaactgaaatatcagcgcccgtcacatcccaagttgggcgttcagccccgatggttacggcaatggcacctgaacctgtcccaatatcaaggacacgcttaggttcaccactggctttgtaatcattgaggacccattccaccaactcttcagtttcttgacggggaatcaatacacgtcgatcaacgttgaactcgcgcccgtagaaagcagcgtggcccaatgcgtattgcactggttgaccacccttgatggcacgcacggccaccatgaaacgcaagcgcttctcatcttccaagacggtattcaagttattcgccaattgcgcataattccaatccatcatccccgttagtagataatcgatttgtgctagtcgctcttcttcatcgtgaatgtatggctcaagttgccaatcaccccaatcgcgaactgcttgaattgtccattgttcatcaaacattgtgtcttatccttgcttcaattcttccaacttggccgtttggtcagcgataatcaaggcgtcgataatgtcgcccaattcgccattcatgatacggtccaacttgttcaatgacaaaccaatacggtggtccgtcacacggttttgtgggtagttgtacgtacggatacgttctgaacgatcaccagtaccaacggctgtcttacgttgctcagcatactcagcttcgttttgtgaagcgtagtagtcgtagacacgagccttcaagatttccatggccttcgcacggttttgttgctgtgaacgttggtcttgcatggcaaccacgatacccgtaggcaagtgggtcatacgaacggctgatgacgtcttgttgacgtgctgtccaccggcacctgatgaacggtaaacatcgacacgcaaatccttgtcttcgatttcaatgtcaacatcttcgtattcaggcatgacaccaactgtcgccgttgacgtgtgcacacgaccagctgattcagtatcaggcacacgttgcacacggtgcgcaccgttttcaaacttcaactttgagtaaacgttgttaccagtaatcatcaaaacgatttccttgtaaccaccgatttcagtcttgttctcatcgatgacttcaacgttccagccttgcttttcagcatagcgtgcgtacatgtcgtacaagtcaccggcaaacaaagcagcttcgtcaccaccagcagcaccgtggatttccatgatgatgttcttgtcgtcgttagggtccttaggcaaaagcaagatcttcaacttctcttcgatctcttccttctcgcccttcaactccttcaactcttccttggccatctcttccaattcagcgtcgccaagtccctcgttcaacatctcttcgttaccttcgatgccttcgacaacttccttgtaacgcttgaacgtctcaacagtttcacgcaagctaccttcttccttagaaagcgccatgaaacgttgtgtatctgaaatgacatcagggtcagaaatcaattcgctgatttcatcataacggtcaacaaccgcttggaccttctcaaaaatctcatccatgttgattcaaattccttttcttaaatatgtattagttctttgccatacgacgtgcgatagcagccatatcagggtggttgtagtggtaacggcatacaggcatgtaggcttcatccccaccaatttgaacttgtgcaccttcgtaaactggttgtccatcagaaatacgcaaattcatcgttgccttgcgaccgcagaatgaacaaagcgtcttcatttcctcgatcttgtcagcataaatcaatagcgcttctgaacctgggaacaagttattgaaggcatcgttcttcaacccaaaagccagtaccggaatgttcaagtcatcaacaacttgcgtcaactcaagcacttgatccttggtcataaattgggcctcgtcaatcaagactgcggcgacatcgtcttgttgatcttgaatcaacttgaacaagtcatccgcgtcactgattgccaacgctgaacgttgcatcccaatacgtgatgcaatttcaccaacccctgaacggttgtctaaggcacttgttagtagcaacacgtgacgttgttgcgtttcatagttgtgagcgaccttcaaaatttcgatactttttccgctcgccattgcaccgtatctaaaaaacagttgcgccatgtgttgccaccttccttctgccaaatttaaaattagttagtttgacactcatttaacagtataacgaaatttcgcctataaaaaaagaagagaactcgcaacagttctcttcttgaagtttagttggctagattcttgtagctcaaaatcttttggtacatcgtcttatactcagcgttcgtcatcgtagccttgtatggtggaatgtagaaaatcttggcgtgcttatcaaggtagtccattgggttcgtcttagcagaatccatggccttcttccacgtatcacgtgagatgccttgcttgtcagcttgccagtccaaaacaaatgatgccaacgccccgacattatacgtttcagcgtatgcaccactgtctagataagccaaacggttttgcttaaacaacgtccgcaccgccgcatcattttgcttcatcgtcttcaccttatctgggtacccagcgaatagtgatgaacgaatctcatagtagtaagccgttccttccatacgatcgtcctcaaaggttgccttgtagtccttctcgtagttttccttgtagtaacggtacgttgccaacgcttgcgccaatgacttttcagacttattcgtgtaagccgccatcaattgttcttgcaattgcaaacgaatacgacgcgcatcagtgtgcttcatgtactcattttgctctgcattgtagtgcttctttggtgaagcccaaccttcttgttccgttgcgtggaacatttcgtgtgcgtatgtgataaacaaatcgtaggttcccaagtgtgggtaacgtaccaaacgcttggtgtcgtgcaactcctcgttcgtgacggccatgaatgcacctgacttaccgtgcgcattaaacgccatgaaccaacctgatattggttgtgggtaaatgtcataactaagcgcttccttcttagtcatgtctgacacctcaccagtcggcgttaccatccagaacttcttatcatcaacaccattaacaatggcgtattgattaacattcttgttctttggccaaagtgatggcgcaatcttgtggtataccttcacttgattagcaaatgtcttgtgaacgtatgtgtcgacatccttatcggcacgcgcatctgtaattccaaactcagtaccagctgcattggcatgtgcggtcatcagccccaagccagcaacggctgcaatcgctcccaaaacgattgctgatttcttgaactccatcgtacagtcccaccttcaactttttgtttttgattaatacaaacagtttacaaaaagtttgcagaattgtcttttaataagtctgcttaatcccacataaaaagcactcaccattacagtgagtgctttcatttcttatttagaatgattctggctcgatgttggccatcttttctgcccagttcacttcagggtacttgcgctccaatgccgtttgcaaaacgtgcaaagccaagtttccgttacgcgtgaagataggtccgtggaagtacgtaccgtaaacattgcggtaaaccaaaccttcaccgccgtcttcaccgttatttcccttaccttgaagaaccatacccaaaggacgctctccctcacctaggaacgtacgtccttggtggttttcgaaaccgcggtattcgttaccgttaacttcgtccttgatcaacacattaccgataaaacggctgtgttgttggttcaacgtgtagtgatccataactgagataccctcaacacgcgtaccatcagccatcaagaagtagtgacccaacaattggaagccaccgcaaacgcccaacaaaggtccatcagattcgatgtaacgcttgatggcatccgccttaaacttcaaatcttccgcaacgatttgctcttcgtagtcttgaccaccaccgaacaaaacgaagtcgtacttcttatcatcaaactcatcgcccaatgaaatcaattgaacatctacgtcgacaccgatttgtgaagcgtaataacgcatcgccacgatgtttccgtagtcaccgtaagtgttcatcaaatcaccgtacaagtgtgcggtgtgcaaaacgtattctgctgccatgtttcttattctcccataccagtcttgatgaagccttcttgtgccaattgagcacgcaattgcaacatcgcagtgtaggttgccgcaatgtaaacacgctcagtaggcatgctgtcgattgctttaacaatttgcttgaggtcttggtagaccggaagatcaccgtaaccagccatcttcaaacggacgtacaagtccttataacgttcaccaccagtgacaatcttttgcataccagaatcttgcaaagactcgaaatcagtatcccaaatccagcttgtgtcgataccgtcagcatagttggcgttcaacaaagcaatcaatgagaatggttgatcatccgtcttcatcatgtcgataacttggttcgcacccactgggttcttaatcaagacaatcgtcacttccttgccgttcaccttaaccgcttcttggcgaccgaagatttgggcgtttgattcgaaggcgtggtgaatttgttctgtagaaacacctaggtaacgaccaacagcataagctgccaaagcgttgtagatgttgtacatcccaccaatttcgatttggtacgtctcgccatcgatatcaaagtttgagaaacgtggcgtcatctcgttaaccttcgttacggcataatccaactctggacgcttaaaatcgtcggtaactgagaagtagtcaccttggtttccgaacgtcataaagtgatagtgtagcaccgtatcgtcagttggtgacaaaataccgtcagtattgtgtggtgccttcatgtcaccatcagctggcaagtggttgaaaccaaagtaaacctttggatttggcaagttaccacgcataaagattggtgaatccgcattggcgataaccgttgcctcagggaacaaacgaattcccttcaaaatcttgtcgtaggtcgtgtaaatttcaccgaatcggtccaattggtcacggaagatgtttgtcaaaacaaacgccttaggcttcaattgacgcgcaacggcttccacgttggcttcatcaacttccaaaagtgcgattgggcgttgtgacttgtcagtcaccttggccgtcaacatcgttcccgtgattccttgcatcatgtttgaacctgatgggttcgtgataacgtcagggtacttctcacgcaaaacgcgggtcgtcaaagttgtcgtcaacgtctttccgttagttcctgtaatcaaaataacgtcgtagtgttctgccaacgtcgtcataacttcaggatcaatcttcgttgccaactttcctggcaatgatgtaccgccacgacgcaaaatgtcgtgcaataccacgtatgaacttttaccaacaaaagttgccaatgcactcttaaagctcatgtcgtcctcctactgcatcgttaaacgatgtttatctgtcaaattaactaacttacagtttaccattctcccgcataaaaagttagggtaataggtaaacacgcgaaactttatagtacgcaattttggacttactttcaatagggcaagcaaaaggccagccgacgtcgatgcgtcagctggcctatttggtttaattaacgtgattccaagtgccgtttgaaccggttgtaaattggacgagggcgcccaggtatgaaatttgcagaattaacgcatataacaattccggaataatcaggaacgcaaatattctggccttccagccgacgtgccacacggacaccacgcgttcgatgatgaagataatcccaatcacagcccagaatggtgataggaacaagccaaattcagcaaacagaatcgtttgcaaaaccaaaaagcctaaaaaggcggcaatcgaaattgacaacataatctgttggaaaatgtagggttgcatcgttttgttgggcttgcgtgaaaagacctgttgcagcgcacctaaataccagcggcgacgttgcaaatacaaaagtcgcacagatggcatcgtttcggtataacagcggcatgatgctggtgaaatcaactttgcgccgacatccttcaaatccaacgtcatcgtgaagtcttccgtgattgactccgggttataaaaatatcccttctcatcatagattgccttcaactttgacccgcgaatcaatgacgcggttcccgtcaatacaaagaccttttgcttatacaaaatttctttgcagtagcgctcccattcaagcgattggcagtacttcaaaaagccccggttatcatcggcgcgaaaaactgatccaaccgcatcgtatttgccactcgcaattagtgggcgtgcacaggcaacccagccctccgcaatttgggtgtccgcatcacagatgaagaccatcaaatttggagtcgaaaaatcgacatattgtgataacgcttgattaagcgccccagctttgcgcgcggtgttattaaccgtatcaaaagcggtcgcccctctgtttagggcaaccgcttttgtgttgtctgtacaattgtcgcaggccacaatcacttcgtctacttgcttaaagaggctgtctactgtcgccccaattaatgcgccttcgttgtgagctggcacaaccgccacaacgcgcatcttttcatcacctgccatgcctgactacttccaatcttcgtcttcgacaagcttaacagtcaacatacgaacgactgcgattgccgctagcattgcaaaaaacaataccaatgcagactcgacgctaacgaattgttgaaactcaacgcacacaccagcaccagctacggttgctgacttaaaacaatgtcccaaatacataccaacagttccttcctgtaattcgatttattttcctttaataagaaaaacatactgccagtatggttttgttttttaaattgcatttcggatacgctgcgcacaaaaaaagaccggatttttccggcctttaaaatttatttcgatagtggtcctggtgtagacacaataagggttgcgtcgccttgcaatgtccacgcctcaatatcgtttggcaagatgaaactcttacccttttcaaggtgatacgtcaccccgaaaacagtcatgtcgagttcaccatcaatcaccgtacccaacagatagggatcacgggcatccaacgtcgcgcgtccgtccaacgtccacttataaacattgaagtatggtgcttcgaccaacgttgtgacattcaagccagcatattgggctgacttacgttccggttgctcgggtacaaatggcaccgtcgttacattcttggcatcagctaaatgcaactcacgcaattcaccagtcttagcatccacgcggtcaaaatcataaacgcgatacgtcacgtccgatgattgttgcgtttcaagcgctagcaccccagcacccaaagcgtgaagcgtcccggctggcacgtaaaagaaatcgcccgccttaactggcaccttgcgtaacaagttatcccagtcacccgcatcaacagcagcatcgaattctgcctttgtttgcgcattgtgaccgtagtaaatctcagcacctggctcagcagccacaatgtaccaagactccgttttccccaattcgccagcatgctccccagcataatcatcatctgggtgcacttgcactgacaaatcctggtgcgcatccaacagctttactagcagtggaaacggcttgtcaggattcgtgttgccaaacaactgtggttcctcacgccacaattcagctaccgtcttcccagcaaatcgaccattttcacagaacacattcccattcttgtgtcccgaaattaaccaagcttcacccgtggtctctgatggaatatcaaagccaaaaacgtcacgtagcgcagtgccaccccacatcttttcgtgcaatgctggttgcaaaatcaatggttcagtcataataaatctcccccgaaatgtacatgaaactatctatttaattgttgaagtgtaggtaaatacctgacaaccaaccgtgttgtgccacgtgataccaaatgacaccagatggatcatccacgcgttctgtgatatccaccacagccccgtgaacaacgcgaccaatttcgcgtccgtatggttgcgcatacactgccacatccccacctggcaggtaatcaatcgtcgcacgcgccacaaatggctttggtgcccatgttgttggtcggttccattcagaaaccggcttcgtcgtacgaccatcgttatccgttagcttcatcgtttgcatgtcataagccacccaacgtgaatcggccaattgataccagaacttaccgtcgcgcgtcgcaacgcgttccacaaccttcatgtatgaatctgcccaaagcttttggcccagcggcgtcgttgattcaatttcatcaaccggttgcacacttgccagcatgcgtaggtacttaccgtggattttttcagtttccgcaatgtcagcacggcggtaatagaacgtgaccgtgtgcatcgtcttctcatcaaacgtccctgttagcgttccttctgatgagacaaagcgatatcctgcaacatccgccggatcaagcgagaagtgttccccaaccgttccctcgaccaaacgcgatggcgcaatagatgcttttgaatcagcatccttgctatatacccaaacgggcatgccttgtaattcaaagtcagccatctttgctgcctcctagttgtagtttcttaagtatattctaacagggaaaccatgtaaccgcctacatgactgtctttgcttaatgttttgtttaggtgtcaaaattgttcataaacgaatattaaattattctcatttaactagttgacttctcataaaccatccagtatattatatacataccttagcaaaaggaataaatgctctgtagttcagcggtagaataactcactgttaatgaggaggtcgctggttcgatcccagccagagcagtcagtaatttcgcatgtagcgccggttccatttggaaccggcgctatttgtttgcgtccattaaaaaaagatgcgtatcgctacgcatctcaattcattcttctattgtcgacgttggcggtaagccatgccgccactaattagtagcaacatgcctggtacaacccaaaacatcatgacaccacttccgcccacacgggggaagattgacttcacctgttctgctggcacatccaccaaccactcgtctttcgcttcgtcgtatttcagcttatcgccaatcggcacacaatccgccgccatttcagttggcgaaccgtcaataccagtcgctgtcacttcaaagcagtacacctttggatccaccgcaaaccccgttggtgcggcaatttcttccagtgtataaagtccttggctcaatccaggcaatgtttgtcctgtttcgcgcgtcgtaaattcacgaccgtgccccgaactcacacgagttaatcgatacgttgatccggcaagtggcttatttgggtcatcccccaatacaaacttgcggaacacgaggccattcacatcattcgcaaaaatcacttcatgaacatctgacgatcctgaatcagcattcgttggcaaatctaccgtaacatcaccatctaacacggtcacttggtacgtcgtgtcgtcaagccaatagccgttcgctacaccagtttgtcgcaacgtatactcgccatttgtcagaccttcccaaactgttgtgtgactacctgaattttgcttcttcaactgtttaccatctacatcaatcagctcaaattcaccgccaaccaatgaacggtcgccagattgattcatatttttaaccgcaaatgacgccgtgatggcctcactaggcttttcaggttccgttccctttcgctgatgactcaccacgttcgattgctgcgtacgattccacagcacgttatcgaacgtatatgaaactgcggattgttgagtataagtggcatcagtcaaatattcagccaccgaatgacgcacattaacgccaaccgcccaatctgaaccactaaacatcagcttacgcacaccttccttggtcaatgtcaccttaaccttacgatcctcgattgttaccttataatcctctaggtgagtcatcttggcgcggtttccaaccgttgcgtcatcactcgtgcccgccgtgttatatacctggacactatccgctatcgcaccagccaaaataaccgcatccccacctactttaggtagattaacaattgcttcaacggctgttggtgatagcaaataatcttcgccgttcgcgtacgtcgttggatatgtccaataccagaacggcttagtggcatctgccaacaatgtgttattcaaatcattcgtatctttatggacgaatttattaactgatggcttatcgcgcgtccccacagttgtatcaatatcaaatgagaactcctcatcgttaggaactgagatactagaactcaagaacgcgccccaaacgccgttggtcaatgaacccatgcgtaccttcgcggatgtgccttccagcacaaacgaaaccgccgaacgctcaaaattttcaccattcaaatagtcttgccagatatcattacccgtttgaccttgatacgcggcatctgttgttccgatgtacttgccattatgataagtaatcgtcgccccttcaaccgtcacacccttgttttcgtttggaccagcccagccaacaccttctgcatagtcataacgcttttcaatggcagcgtccggtccccaaggatttgtccgtcgattagcattcaatgatgcaaacgttagatacgacatcttcttatccgtcttctgcacatcaatcagatgtttattttcaaaatcaacatactgaaattcgagctggaaatccgagagcttgttatacaacaaccccgaatacaaattattcgacagattcaaatacggatctgcattatcaccatctccacctgtatggccaccaatcgtacctggaataaagtcggataacgtcacgtaggcgcccatcaaatgagtagtccacttaacatcaccgttgctatctacatgcttcgttttataagtcccaacatatgggtaatagattgtaatttcgccccgcttagctcggctcgcaactaactcaattacggaaatcatcaccgagtaattcttgcctggtgattgctcattaaacttttcatagtagtacaaaccgtgatcattttgctctgaattccaccaagtttcaccccacatatttgccagcttactccgcttatcggcgtttaaacgttcctcgataatcaaataatcatcttcgaccgcatcttggttcagatacactttcatcttatttggatcagagtacgcatctgccttaattgttgcactgtatcccttcaacgtctcagtcggaatcaaatcatccggtcgcttcagcgttgcacgttcatcctgttcgtcatacaccgtcattttttgatcatcattcacccaatcactggcaaatgggaaaaacagtacgcccatgtgaatctcacgtggaatgtagttattcacatgtccatcttcatacgtttcctcacgcactggcgacacaatcatcaaaccatatttcttatttgccggtggtcgtaaggtgaatttaaacacttgcttttcagttttcgcattaacaatgaaacgatttttactatccaacttaattggcttgtcgttcaatgtaatactttcaacacttccaacgcgatcgccatcaaccccaaattcaaccgggaatacgcctgcttcttggtctgtttggaactgttggaagtcctcttccatcttgtcgaacgtaatctcataatccataaaggcacgacgctgcgaaaccttaatcacaaatggtaccccttcttaatcgaagtagtcataaattgttccggcaacactttttagcaccgcaggcttcgttggtgtcgtcggttctaactcaccttcacccatcagagttgggttatccttaccagccccaatcacatctggcagtgacacttgaccggtatcttcaatggcatccaataatccgttttcaattttagctggcaggttgctaattaaggcatttttagcttccgcatacgccacctgactaaatagcaccagattacacaacagcggcaccaacagaatcagcacactaaatcgactattcaattttcgcatgcgactactcatcgttggcgtccccttacatatttttactcatcctatattacggacaagatacaacttgtctgtggctgtcaattaaagactcttggaaattctcgatgggtttatgaccaaaaatgcaacagaaaagccggctgcgaacatttctgttcacaaccggctcattcaagcaaatttaattttcaaatatgtgtatcaaaattattggttttgacggcgcttgatgtaccaagctgccccaccggcgatcaacataacgatcaaaccagcaccaatgtatgcttgaattcctgttcctccaacacgagggaaaattgacttagcgtagttactaatttcaaactgcaccaagtacttaccctctttgagagtcaacccaaccgggttaccagttacattaccttgttcatcagttcggtacatatacacatcactagccgtggttgatggttgtgatgcaggcatatctgacttagaaaccaatgcaaagtaagtatccggatcatcttgagcataacctgaaggtgcacccgtttcagttaccttgtaataaacttcagccgtttcgttgttacgactgtatgttagcgttgataactctgatggcaatgagaacgttgtcccatctgctgatacagtcaacggataagtagttccgccaactccgttcttgaattcttgaatagtaaacgtagcaccggcaagcgcttctccatctccatcgaccttttcaagcaacaactcaccaccaacttgtgtattcttaaccttcaactgaacgccacccgttcccgtaatgtctgatgatgtaatgcttgagttagtataagttactgtcatcttgatgttgtcataatcaggatctgttttatcttcacctggtgttacacgaacataattaataatcagttccgtgttagcaatgccactccatccagacggtgcgctctcagacaaagtataaactcccggcttcaaatccatatccttcaagtcggttacactgtcatcaccgaatacgacatccgctccatcgagcttaccctctacctcaacggctggattttctgttgtcgcacccgttgttgtatatgtgcttccgttccaatcgttgtaggttgtcttacgtgaaagtgtaaacgttgcacccgtcaaatctgcaccagcagcatccgtcttcttaacatcaagcttcaaattaccttcgaacggcctcaacttcgtgagaactgaattcgtcgccttctcagtattcacagccttaaccttcgctgtattcacccatttaacaccagcatctttgtcgttagcatcgattggcgttccgagtacaggatcagcattcgctgaatcggcatctaccttaacgttcattgaccatgcaatgttatttccgttaaaggtaatcttatccattccaaacttagctgtatcagaattaatcgtgaccgcgactgtttgtcgtttagtagttggatcagtagaaatggttaccttgtaatcatcatcgagcgtcaatgcacttggattaggcgtagttgctgtcggcgttggatataccttgatatctgccgccgtaccatttactaaagttgtaccaaatggcaattcatctgtcatcacaatctgctttggcttcaaaagaccttcatcaccaataacataagttggttggaatacccaataattatattcaaagtaatttttgccatctccttcagttacagtcggcaattgactaaccgactcattatccaaatttccgtgcaatccccctacagacgcattcaagtcagttaacgcaccattgtaagtagtctctgtcgtaaccgacttcacaggattggttagcggtgcggccgttagtcgagccatgttaatcgattgccatgtgttaccactaccagtatagaaacggaaaccaaacttttgtccagaaacttcataactaaccgctcctcgagggtacgtatcagcccttaaccagtcaacccacgcatatgggtctgcataagtcgtgcctgttgtataacggtgcggatcagatgtatttgtataatctccaagcgtacgagagtaccaaatcttaccgcgccctcctgattggctgtcaccagtggcttgctgcatattaccactgtcatcaacaatggctttaatagaccagtcaacatttccactagcattcaacataccaactgtttctgcttgttgcgcttttccatattgatcagtcctaaagttttcaggatttgccacattcgtgtggttattcaaagacccgaacgtcacttgcgttgcaacttcatcggctggattaataatatttaattctttggtaaagtttccattgacatcaaccgcaaagaatcgaagctcaatatcaagactatcaataccttgatacagcacacccgccgccaatttgtttggcacgtcaattatcgggtgttggattggatccaaatagcttgaaaaacggttgtcgtttctcgtcttaatgttagaaatcgtcatgattgctcccatctgattaggagtcgaacctgtatagtacgtaccaacattatcgtaagtcacactaatttgcgcaccattcaaagtagtttgattaaaatccttaaattcaaacaagtatgacgatagattatttgtcccattttgcgtaccgtacttgttatagtagtaatttcgcaaagtattttggtgagttaagccaccagcagtcgacacactgtcaattgtagctgctgtacgattaaacttcttccaaatagctaaattctcagtaggcgtcgggaaattattattgtttgtcgagttcacctcatactgctttgagcttgtcacattagtatagtattggaacccacgaggattcgtgttagttgcctcagcatttgtagacgtgcggtgatcttgaccaatcgtcactgtgtccgtaacatccaaagcccccagttgatcggccttaaccgttgggtcgtatgtcaaatgactgtcattaccatcatcagggaacgccttgacatctttcttctcagcttgattctcttcagaagaagcttccttaatttcttccttcgcaacttgctcaaacaccatcgtcaagtcaactgaacgattgtcgacttccaagcggttctcaccattttgttcgtcatacagtcccaactcagtaaccggcaacgtaatatcgtgcttgtcttcattagtactaatagctgtcaaaatcaaatgtgtgctttgtgacttcaacacagcatccacgataccctcgcgcatgtctagtgtcttgtcatcttgcttaatttcagcgtcctttaggcccgccttttccaaatcaagtttgaacttaactgtctgctcactgacagacatatctgatcgatcaaactccaaatcccacgtggtctttgtcttgtcctgtgatgtcttcaatttgacattcagcaactcgctctcatacacgttctgcggtccagtgaccgcatgaatcgcgtctcccaaggtacccagattggcggcaaatggcacagccagagctgccaaaccaatcaaagcgcctaacttgcggtgacgcttcttaattgaaaagcctccactttttgtcatagacgtactccctaaatctgtattttttctctcataaacagtgtggtccatcccaccttctgttggactatctcagaataccgataaaatggtgtaacagtttggcgcaggcgtaacgacttttcgaaacgttatgaagaaactttgccacttgccttgaagtttgaattttccattacagaatggcgtcaattcacaatttattcatttttattccacgatttcacccttatttactttttataatgaataaatgtaagaggggctaacgcaacttctcacctagagaatacacaaaagacgtcgaccggcataactgctagtcgacgtcttttatttataacttattcaaataccatttggttgttgtacaactcggcgtagaagccgccttgcgccaataattccgcgtggctaccgtgttcgataacgtttccgtcacgcaacacgacaatcttatccgcattcaaaattgtcttcaaacggtgggcaatcacgaaacttgtacgtcccgcaatcacattatccatcgccttttgaatcttagcttccgtcaccgtatcaacgtttgacgtggcctcatccaagatcaacaagtcaggtgcggtcaaaatcgtacgcgcgattgacaacaattgcttttgaccagttgagaagactgagttttcatcagacacttgggtatcataaccatcttccaacgtcatgatgaagtcgtgaatgttagcttgcttagccgcatcaatcatttcttcatccgttgcgtcaggcttaccgaacgtgatgttgtcacgaatcgtacccgtgaacaaaacagagtcttgcaacacaataccaacgttatcacgcaaagacttcaagtccatgtcgcgcacatcaacaccgtcaaacttaacggcaccgtccgtcacatcatagaagcggttcaacaagttcataacggtcgtcttacctgaaccagttggtccaaccaaggccaccatttggcccttgtccacttcaatgttgataccgtgcaaaatctcgcgctcagggttgtaaccgaagtgtacgtcatccaacaaaatcttgtccttaacgccggtgaacttcaccccgtccttagggttgatttcatcgtcttgtgcaaacacttcgttcaaacggtgcgcaccagtcatcgccaattgcaacatgttgtacgttgacgtgatttgtgtgattggttggtagtattgctgtgagaacgaaacgaacgtcacaatcagtcccaaaccggccgcacgtgaagccaagtcaccgttcaaagcttgtgtggcaccgtagaaaatcacgatagccaagttaaacaagcccattccttgcatcaaggggaacaacacacctgaccaggcttgaccaagtgtcgttgccttacgcaccttgttgttgtgctcgataaagccacgaattgactcttcttgcaaaccgttggtgataatgaccttttcaccgttgatttgctcgttgatgtatccgttcaagtgaccgacttcagcttgttgcgcatccacgtacttctttgcttgcacaatgatcaaagcagccaagataactgcaacgggtgttgaggcaatcgttacccacgccatcttagggctttcattaaacatcatccaaaccacaccaatcaacatcgcaatttgtgagaacaattggaaaatagcttggttcatcgcgttgaagatgttatccaagtcagacgtgaaacgtgacaagatttcaccgtcttggtgagaatcaaagtaacgcaccgtcatacgttgcatcttaccaaacaagcccttacgcatgtcattaactgagttagatgacacgatagcttgaatgaaggcgttgatgaacaaaccagttagcatcaacaacacaaagccgaagaacaatagcaaggcatggtggaaatcatgcaaacttgcttggctagccgtcattgggttcaacttcaccatcaagtactttgacaattccgtaattgaacgtcccatgtaaaccggcgccttaacttgcgcccacgttgcgaaaatcgtgaacacgaggatggcaatcatccccatccagtaacgcttgaagtagtgcgcaaagaaacgaattgattcagtaatattcttcatcttttatgcctcctgcgccttttgtgtcttgtaaatctcttggtagataggtgatgtttcaacaaggtccttgtgggcaccttccgcaaccaattcaccatcttccaaaaccaaaatacggtcagcgttaatcactgaagaaatcttttccgcaatgataaaggtcgtcgtatcttgcaaatcatgatcaagggcttccttaaccaacttttctgacttagcgtccaaggcagacgttgaatcatccagaatcaaaatcttagggtcgccaattacaccacgggcaattgacaaacgttgcttttgaccaccagagaagtttgatgaacgctcttcaaccacgtgttcgtacgtgtcttcataacgctcaacgaattcagcggcttgcgcaatttgcgccgcacgcttcatgtcagcttcttgggcatccgccttaccttgacgcaagttgtcagaaatctttcctgagaacaatgtggcgcgttgcaaaacgaatgacaccgtcttacgcaatgatgattcgttggtatccttcaaatcaacaccgccgaccttaaccgttccctcagttgggtcaaacaaacgtggaatcaattgggccatcgttgacttacctgaaccggttgccccgacaattccaatcatttcgccaggttgcaccgcaaatgagatgtgcttcaacgttggcttatcatccccagggtacgtgaatgacacatcgtcaaattcaaccgcaccagacaagtcttgttctgggacatcctcgtattgcaaatctggttccgtattcataatttcttgaatacgacccatagaaacaaatccacgcgccgcaaatgtcatcatcattccaccaataatgatagattgcatgatgatcatcaagtagttcgtaaatcctgtgatttgggccaacatcttcggctcagaaccaaccatgtttccaacaaagtagatcgccacaaccatcaagccttggccaataaacatgaaggcaggcacaataattgagaacaagtaaccaatttgcaagttaaccccgttcaattcgtcagaaacttcattgaaacgcttttgctcattgtcttcttggttaaatgacttaaccacacggacaccttgcaagttttccttcgccttggcgttaacgcggtcgatcaagccttgaatcataccgaagcgcttacccatgtttcccatgacaaccgctgacacagcaccgaccaagatgaccatcacgacaataacccaccacaaagcaggaattgagtgaacggccaaaatgaaaccaccgacaaacaaaattggcatacgcaacaatggttgtagacccatcatcaaaatactttgaatttgcgtaatatcgttcgtcaaacgaactaccaagttaccaacagagtattgctcgatgtttccaaatgagaacgtttggatcttgcggtaagcagcttcacgaacatctgaggcaatcccttgtgaggcacgggccgcaaaaatcgtgttaataattccagcaatcaacccgataccggcaatcaccaatagcttgaaaccaatttggttaaccttgtccatgttatcgtctgagatagcttgaacgatgttggttagcaacgttggctgtagcaacattgaaatcgccatgatggtcaccgtcaaaacggcaatcgtcaaatcgagtttgtaacccttaaagtagggcttcaacaatcgcataatttcccctccaaatttcttatttatttctattcgtcaataggctattttagcagacttgcaacaccttttgtaaattaagtttacaaagaattaaacaaaagccacacccgaaaattcggatatggcttcaaaaagtcttatttaacaaatagcgtggcaatcgccaaaatgattgaaacaccaaggacaagcgctgaaatcgcgatgtgcaaacgacggtgcatgttcaagacagcaatgtattcacgaataaaggctggaatacggtagtagaacggcgtcttaccaccacgaccttgcgcttcgatgccaaactcacgggcttgcaatcccgcacggaagacgtggtattcactcgtaaagaactcgaatgagggttcaaccacgcccgtttccttactaatcaaatcacgtgagaaacgcatgttttcacgcgtcgtgcgactttgatcttccatgcgcgtttgctcggctggataaccaaacgtttcaaccgcgtaatcacgcatggcttgcgcttcagaaaccttctcgtcgccaccttggccacctgagaacacgataactgggtacttgccgtccttttcaaaacgacgcttacccgcatcggttgcggcttgaatacggttagccaacaacttaccaaccttgtggccgtcaatcaaaccagcgcccaagaccacatagtagtcactctcgcgcttacgcatcacccaaccgtaaacgattgctgatacgaagaaaatcaagaagaccaacatgaagtaaagtgtcatcacgcgggcagctgtgaacaacgtatccagccaagctggcgcattgttcatgataccgtcaacaatgttgaacacagccaaagccaagaacaccaatggcaacaacaagtttgccaaggtgtgcgattccttacgccaaattttccatgagtagtaaaccacgcccaggtcgataaagattgacgcaataacgaaaataccaataatcatcaagacaatgccggccaatacaagcaagccagggccacccaagaagctagcggcaagcatcaccgtaatcaacaagaagaacaagaacaccaatgtccacgttccaagccacattgagcgtggctcattcttggtattacgccaaatcatataaccggctaatacggtaattaataatgaaagtaatgtcagtgggaccattcgtgggctccttaatcaacaatatattttgcaaaacgcgcagcttgcactggcgtcaacgtcacatccatcatcgtgccagcttcaacataatcgatgctgtggacagatgcttcttcattcaattcgttcaccaattgaccttggtcaaatggaatcaacacctttacttcttggtgatccgcaaagatgtgctcacgaataacgttgaccaacaagtccaatgaggcatcatcttgcgctgacaacgtcaacgtatcaccttcacggtcagggaatgacaagccttcaatcttatcggccttgttgtaaatcgtaatcattggaatatcaccaacaccgatttccttcaacgtacgggccgtcgttgacatcatttccttgtagttttcatccgcatagtcgaccacttgtagcaacaagtcagcttgcgcagcttcagccaacgttgcgcggaaggctgccaccaaaccgtgtggcaactttgacacgaatccaaccgtatcagacaacaagaagctttggttatcaggcaagttcaacttgcgcactgatgtctccaacgtcgcaaacaacatgtcggcttggaaaacagtcttctcctggttctcaccaaattgacgcaccaaaccattcatgaacgttgacttaccagcgttggtatacccaaccaaagccacgttcttgatgctttgcttatcacgacgagcgcggcgcgtttgatcgtcagcttcaacatccttcaattcagcacgcaacaatgaaatttggtgctcgatgtgacgacggttcatttccaacttcgtttcaccagcaccacggctagtaaagctaccaccgccaccaccagtttgctggtcaagacgcacgttcattgacgtacgcaaacgtgggagttggtattgcaattgcgcaatggcaacttgcaacttcgccacacgcgtcttagcacgtgatgcgaagatgtccaagatcaacgccgtacgatccatgatgccggcacccgtccctgattccaagttacggatttgtgatggtgacaactcatcgttcgtcacaaccatgtcggcttcgtagtattcaacggcttcctttagttcttcaaccttccccttaccaaagtacgtggccgcgttcggacgttccaacttttgggtcaccgtcccaaccacttccatgtagttcgcttcggccaagttggccaattcgatcatctcgtaatcgaattcagcattttgcttatctagccccgcaaggacgaccttacggattggatgcaaatcattttctatcataaaatatctttcctaccaattagttgtcgtatcgttgtacgccttcaacttcatgtcgtcatctgagacttcccaaactgaaattgaaccattcaatggcttttccttagccgtctcgtgtgagtcgtacttataaaccaagtttcgaatcattgtaccgtgggcaacgaccaaaacgttttgcccatcgcgtgtgttttgacgcaaaatgtccaagccgttctcagcacgggcccagaacgtggccgcatcctcagcgtcatgcgttggatcagcttccttgaacgcatccatcacttcgtcttgcgtcaattgtgacatcaaatcaccgtatgacgtgatgttttccaagccaataataccagcaatttgctcggcacttgatgcactaggtagtccttcgaagaaaccgaagaattgctcacggaattgttgcaattgctctggcgtcttcaaatcaccactttgcgtgttacgccccaaaataaattcagctgtatgaatagcacgttgcaagtcagatgagtaagccgcatcaaagcgcacgttgctcaaacgctcaccggccgcaaacccgtctgaaatacccttatcagtcaaaggtgcgtttccccacccttgcatacgttgatatttattaaagtaagtttccccgtgacgtactagatacaaattaaatgacattgttaacctctttctggttgtgcttgtccccgataatcaggcatcaacagccttctaattgttactattgtaccatttttgttacagtcaccgcaggcatcaaggaattactaataatttgaaattagtttacgaaaaagtgttgactttagtgtgggttatctgtatagttatgtattgttgttaagacaacagatgataattttggcccaatggtcaagtggttaagacgtcgcgttctcagcgcggaatccagggttcgattccctgttgggctatcacttaaggcacggaagtcgtttgacttccgtgtttttttattttctcataacaaataaagcggtgaccagataactgatcaccgctttttttcaactctattttagacttcacgacgcttaaacagcatcaacgcaatgccataaagtacaccgctgtaaacgattgtgaccaaaccgactagccacccgctcatctgatactcagccatcacatcaggcaaccctgccagcgcgctcacgtaaaaggcacccagtggtgaataatcaagtggcaaaataccgtgtccaacgattactgccccaatcacttcgaacatcaaaatcagcaagataccgataactacgactaacaagtcattacgaattaagttagcgatcacaaacatcacactgacaaacagaatcgaactgatgacgctaccaaataagtaacccgcatagctacctaaatcaattaaccacgcctgaccaaataacaacgagacaatcagcatcgtaccaaacaacgcagcttgcaacagcacaaaagctaccgccaccgtcgctaattttgccacgaagatttgtcggcgagtaaagcgttgcgcaaacaacatattcatcgtgccaaacgtgaattcagacgtgattacgcgaccagcaatgccaagtaacattaaatcagtcactagcgccaatgttcctgtgaattcttgattaactagggttttaactgtttcggaatggccaactgcatttgcaagcgccaataataacccaagaacaactatcgtcagtggcatcacccaagtggatgtcttcttgaaaaacttctgcaattccaacttaatcaacatcaccgactccttgttgtttgcgacgcgcaatcacatccgcaaacatttcttctaagtccggatccaccttaccgtcagcagctgtcagaatttcatcacgcgaaatgatttcaccacgatcgataaagatataatcatcaactaagccttccaaatcacggacggtgtgtgaagaaatcaaaatcgttttgccagcatcgcgccagtcccgcaacactgccttcactgcttcagcgctaaccggatccatcccattcaatggttcatcaagcaacaagaggtctggatcattaaccatcgccaacgccacgccaacgcgttgcttcatcccccacgaataggtcttcatttttttattaataaactcaactaagccaagctgtgtcacaatctcggtaatttcattatcggatatgccagcgacttccgcatataacttcaagttatcccaacctgtcatatacgcatacagacccggattttcaatcaatgccccaaccttggccagcacatgtcggtgttgcatcgtgaccgtttcacctgccaccttaacctcaccaacatccggcgccgtcacgccagtaattaccttcattgttgttgacttaccagcgccattcggaccgaccaggccaatgattgtgccacgtgcgactgaaaacgatacatcacgcaaagcccttacacgaccgaatgacttattaatattcgaaacctgtaaaatcggcgtttccataacgtatctcctcctatccgcaactattaatcatacaactcaactagaccccttgcaaagaaattgtcacattacggtcaaatatgtaatctgacaggcaccccatttttcgatacaatggaatcaaacagaaaagaaggataggtgtctgaaatgaagttcatctcatggaatattgatagcgttaacgcggccgttgaacacaaatcagcccgtggcgaaatgacttggcaagttttgcaagatatcgcggctgagcaaccggacgtacttgcaatccaagaaacaaagttgaagccaactggtttaacaaagaagcaggcgactgcgctggatgaacttttcccaggctaccaccgctatcttcgtatgagcactggtcgctcaggctactctggtaccatgatgctctcaaagactgaaccaatcgccgttgaaatgcccgaaattggcgctcctggcgacatggatatcgaaggacgtattattaccctcgaattcccaaacgtttacgtatcaacggtttatacaccaaattcaggtagtgaattggcccgtctcgatgaacgtcaagcctgggatgatgcctaccgcgcatacgtgtctgatttggatgccaagaagcccgttatcttctctggtgacttcaacgtcgcccaccaagaaatcgacttgaaaaacccaaagacgaaccacaagagcgccggctttaccgatgaagaacgtacgaagtttagcgctttgttggacgccggctttaccgatgccttccgtcacttgaatcctgacctagccggtgtttatacctggtgggcacaaatttctaagacatcaaagattaacaattctggttggcgtatcgattactacctcacgtcaacgcgtttgaacaatcaattggctaacttcagcgtcatcgacaccggtgcgcgccaagaccacgccccaatcaagttggaaatgaccgacgattttgaattatagacaaataacgcacctgaaaaaataaatttcaggtgcgttattttttaatcattatcaatcaacgttggcgtcagcacctcaacgtatccacgtaatgtgccatctggatttgcataaatcgagaatccgacctcaattggtcccgctgaatgatgtgtttgcgccgtcatcaagccaatcttgtgtgaggcaccttgttgggcttcgctcgtatcatcatacccagccggttggccatcatcaccaaactgcttcaccaaatcgaccgctaacaactgcaactgcttttcgctcgtcaaatcagccagcgtccaaacattacttgatgaacccggcacattaccaaaggtcaaattatccttctgatcaacactgcttccgtaatcaacggccgtaatgtgctgaatcgtcgaaccgtcaccattcgtctcctcagacccttggctgtagtacttcaacttgccatcagccatcttaaacgttggcaacgtctggaacaggttattgaaattaccgtgcggatctgtcgcaaaatcatcctgattctgcaacgcccaacgactttcttgtttcgccaaattcaacgccactgaagacgctgcaaccggactaacatcgtaatgcgcgcgatagctattcaatgcatccagcgcataatcttgtagcgaatccaatgtccggtcagtcaacacttgtcccggttgattacttgccaaatcagcttgctcgctatgaaccgaagatgaccccggtgcacgatccaacttgtacgtaatcgtctgtgacttcttcactgtcaacgtatcaccacgtgacatccgataaccgtcttgtgaaaatgacggaataatcagctttgccccgtaggtcgcatcataagttttcgttgccacgacgtcattgttatctgcgtccacataacgcaacgtgactgaatatgtttcagggacatatttaaatgtaattaacgtatgacttttgatggtctgcgtaattgattcaggcgttgaataacctggaatatcaattggcaccaacgtttgttgctcaccaggacgaatacttgcattaccctgcggtgcaatttctttcccggtacgcacatcgacatacttgatcacgacaccactttgactgatgccactggtaaagccacttacgattccgtcgccaccatcaacggcgagcccccccaacgccaatgatagtccgaccaatccggccacttgccactttttcaaatccttcacctatactctcttgggtgtgggtttgccactgtttttcgttaacgcaaagtatacagattagcgttaagcctctgcaacaaaaatgccccggaattttcgtccgaggcatcgcttattatcgccaaccataactaccaaagtcggtaattaaatcagaatatggtccaaagcaagtttcttcatagcccttaaaaggcttctctggcacatatttccccaaagacttctttgtttgcgtgaccgcaattctttcttcatgttgcatcgccaagcccctccttttcgacacctctattttatcaaatcctgtgattgattgtttgttggaaccttttttgcggtggatgattatctcagacagaataaaacatctcggctgccggcatgaaagtgtggggctatcggagcgttcaaattggggcaacatgccgcatggccggcgctattcagaaaagcccattcaggactagaaggattagggggaattatttgccccgctgaatggcgtccgcgccattcggttgccccaatttgaactttgccggagatagccccgcgctttcatgcctcggcgcgatagcgacgacactaacaaccacctaaataaaagcacccacaaaccatggctgtagtttgtgggtgctatagatattgagttgtgaggcgttaacctagattagaattggtctgacaacaaagtgcggatctcttccaaacgtggttgacgtgggttacctggcgtcgtttggtcgttgtataccaagtcaggcaaagtctccaaagccttgtcaaagtcagcctttgatacaccgtttgctgacaaagttggaacaacttctacaccagcgaacaattggtcaatcttagccaacaatgcttcaaccaattcggcatcgttctttccttgcaaaccaaggtaacgagcgatatcagcgtaatccttttgtgccgtgtaagtctcgtaacgtgggaatggcgtacgctttacgtttccagtaaccgcgttgaacttgataacgtgcttcatggcgattgagatagccaatccgtgaggcaaaccgaaggcaccaccagtcttgtgagccaaggcgtggttaattcccaagaaggcgttggcaaatgacatacctgccaaagttgaagcgtagtgtatctttgaacgtgcttcttgaccttccttagttgggttagctgggtcgtacttgtatgacgtctccaagttatcgaagatcaacttgatagcttgcaaagcccatggacgagtgaattctgaggccataactgaaacgtatgactccaaggcgtgtgacaaagcgtccaaacctgagaaggcaaccgtgcgctttggcaccgtcataacgaactctgggtccacgatagcaacttgtggcgtcaactcatagtcagccaatgggtacttaacgtgcgtttcgtcgtcagtaataacagcgaatggcgttacttctgaaccagttcctgacgtcgttgggatagcaaccatttgcgtcaagtgttggtgatcgaacttcacgatacgcttacggatatccatgaacttttgtgccaactcgccgaacaattccttcaaggcagcatcgtcgttcaagattccttcgtgaccttcttctgcagagtactcgtacaagaagcgagcaatcttaccagcgtcaagagctgaacctccaccaatcaagacaacagtgtctggttggaattctgacatttgacgggcaatttcgatagcttgaccgatagttgggtcaggttgtactgaaccgtagattgacgtcttcacttggtcttggcgcaaagcaaattggtccaaaatcttgtctacgaagccgaacttaaccattcctgggtcggcaacgatgaaggcgcgatcaatgtttggcaattcttgcaagtacgtgattgcgtttgactcgtagtagatgtcctttggcaaacgtacccattgtgggcggttacgacgacgtgcaaccgtcttgatgttaagcaaatcgtaagttgacaagttgtgtgacaatgaattcttcccccatgatccagttccaagcgtcaatgatgggcgcattgcgtcagtgtagatatctccaacaccaccgattgagtctggttggttaaccaagatacgtgatgcttcaatcttgtcggcgtattccttaacgaatggatcgtcttgagcaccgatttggatagcagcgttgtgtccagcaccttggtagttcaacaaagcgcgtacgatttcgatagcgtcttcgcggtcagcagccttgtagactgacaacaatgggctcaacttttctgatgacaaagcttcaccgatgttcttcttgtccaattcgaacaacaaaacatccttgtcttctggcaacttcaaacctgattgctcggcaatccacttacctgacattccggcaactggtccgttaacaccgaatccttcagcatttggcttgaagacgaagttagcaaccttctcgtagtccttctttggcgtcaagtatgcaccttgctcttgcaacttgcgcataacttcatcgtaaacaggggcttcgataaccaatgagttttcagtggcacagatcataccgttgtcaaaacgctttgacaaaagcaagtcttcaacagcgcggtcaacgttagcagttgcgtcaacgaatacggcaccgttaccagctccaacacccattgatgggtttcctgacttcaaggcggcgttaaccattgatggtccaccagtagccaagattgaagcaatctttgggttttgaatcaaagtcgtcgttccatctagtgatggcttctcaatccattggatgaagttcttaggagcaccagcggcaacggctgcatcgtaaacgatcttagcagcgtgcgctgatgacttttgagcttgtgggtggaaggcgaagacaatcgtgttacgcgtcttagcagccaacattgacttgaaaatagtcgttgaagttgggttagtcgtaggcacgataccagccaagattccaagtggggctgccaattcaaccttaccagttacgcgatcttctgagataacgccaaccgtcttgtcgttcttgatagcgttgtaaacagattctgatgcgaaacggttcttcgtatccttatcttcaacaacaccacgaccagtttcatcgtgagcttcgtgggccaacaacaatgagttttctgatccagccaaagccatcgcagcaacaatcttatcaacttgttcttgtgtgtaagttgagaattccttcaacgcaacttcagacttgtcaaccaattctgaagtcatcttcttagcagcttcgaaacgtgctgccttttcttcttccgttagtaccttcttcttaggtgcatcagccatgattataacctctcaaatatctttcaaaaaattcgtttgctcatttattaacatacttagtatatcatttcacaaaatgttgtcaacaccatttgccaaaatcgattatttttaccaaacatatgcgtcataccaacctttcgcgtctcttttttctacaagtgaataatatcacataaggtcaatatagtgcaactgtttgttttattttcatgaaaataagtgatttataactaaaaatgtatgcgttttcatatttttaagtaagtcaataaaaggcttgtgaaccgcgtaactagtggatttgtgcccttataaactaataaagagaaatttaccggagtaaacttctctttatcagttattcgttatgtgcgtcgctctcacccgacgttagggacagattaccaagcgtttatgaactttgtctaacgataacccttagactttttgactaattatcgcgatatcaaacaagtaccctctgcattggtatttccaacgcagagggtgcttgttgtttataactattgtttcttcggtaacttgaatgtcttggcggccttcatgatgatacctgtgatatcacccggcgtaaccttttcaccagactccagttcattcacgatggcccatccgattgcttcagtcaaaccgactgcggtcgccattgagatggctgcaccggttgttgttccgataccagggataaacttcaatgcatttcccacgacaccacgaccgaatgatgtcgcagcgactgcccagacggcaccacgcacggcaccttccatcaccttttgatcatacgccttgaataatgacgtaatcatcgtgacttgaattggcacaagcaacgtcgcgtccgtaaacggaattggtgacaaagccaccgcaccagctgcgcctgacgctgagtgaataatgttttttgctttttcatttggtgtcataattccacctccataccgttattataccgaactcccccaaattaaaaaccgaattcgacctgccaatcgggcaaagtcaaattcggttatttcatataattaccagatcatcacgcggtcttctggtgcgcgatacatcttgtcagatggttgcacatcaaatgtcgtgtagaaatcatcaaagttagaaactgtcacattaacacggaacttggctggtccgtgaacgtctgaagcagccaacaattgcatgatttctggacgagccttttggcgccagatagttgcccaactctcaaagaagtccttcgctgaaaaatcagcatcgcgctttgcggcagccaaagcagcagccacaccacccaagtcagcgacgttttcagaaaccgtcaacttaccgttaaccttggctccgtatgaatccaagccgtcgaattcatcaacaaccttttgcgtgcgctccttgaaggcttcgtagtcttcttccgtccaccagtcgttcaagctaccattttcatcaaatgacgcaccgttcgtgtcgaaggcgtgtgaaatttcgtgcgcgataaccgcaccgattccaccgtagttagctgatgaagattggtccaagctatagaatggcgcttgcaaaatcgcagccgggaacacaatttggttttgttgtggatcgtagtaggcgttcaccatgtgcgctggcatgtgccactcctcacggtcaaccggttggttccactttgaccattggtaagccacggcttgcgcgcggaacttttcagccgtttcaaacaagtcagccccatcgtccacaatcttatccttgtagcggtcaggcaacttttctggatacccaatgtgcggcacaatcgcatccaacttcacaaccgccttatcgcgcgttgcttgttgtagccagtcagctgattgcaaacgttgcttgtagacatcaatcatcgtcgcaaccttttgctcaacgtcttgcttagcggcctcagagaacttctcaccggcataccacaagccaagtgcttgcgtgtatggaccggcagccaagtagtaggcagccttttgcttgttcaacgcttctggcgttcctgacaaagcacggccgtatgcaccacccaagacgcgaatctcatctgataggtagctcgtaaaggcgttcgcgataccaacaatcaacgttgcttgcaacaatggccaagcttcttcagagaagaattggtctgatgcagcccagaaacgttcttctggcaccacaatcatgtctggcgtcttaccagtcatcgcttgcaacacatcgtccattggcaattgcgtcaacgctgtgaagtccgcccacttgtatgggtggtacaacttagcgtattccgcagattcttcttggctcaagacaaccttggcaatacgcgcgtcataagcaatgtacttatccaacaagtccttgatttcgtcagctgagaaaccaaactttggcaacaagtcctcttgcgctgcacgccacttagccaacaattccttaccttgctcatgatcttcagcatagtaagtcgtatctggtaaaattgtgcccaaagcatccgcccacaacacatttgtacgagcatccttgaagtcaggggcaatgccaactgggaaagcgtttggtaagccttccttttccaactcaatgatgtgatccttaaagtctgcaaatgactcaaaagcttggtagcgcgcaatcaatggcttaactggctctgcacccaacgcatcacgggtctcccaatctgacgtcaaacggtggaacttaatgaagttcgtcaaaatctcgtcagttggcgcatccttgccgtccatccaagcatcagtcgtttccaacatcatctcttcaatttcgtcagccagatcactgaagccacccgtacgtgacttatccgcaggaatcaccgcttgcgcttcccattcctcgttgattgcatcatagaaatcatcttgtactcgtgttgccatgtgcattacctcgttcttattatttctcactattctaacactgaaccatgaaataagcccgaaggatatgcggatgttatcgtgcgaaatacatattctctatacaacaaaaggagtaccgtcaacacgatactcccatcattaactatactaactacttaccggccaaggccatcttagcttgcttgatgcggataatcttacgaatcaagacaccgataatcgtggccacaaccaccatcaacccggcgaaccacaaaaattctgaacggattgtaccagtcggcaacgtatcacctggcacttgcttacctgtcaccaacaaacggtgtgagttcacaccaactggcgtacaacttaccaacgtcaccaagttctccttagggttcaacttgaacgcgttttgcatcttgtcgggcttcatgacacggatttcaacaacctcatacgtcatcgtcttgctaccaagcgcttcgatgtagaacttgtcacccttcttcatcttgcccaagtccgtaaacaactttgaagttggcaaacctgagtgtgccatgatggccgtgtgcaacccttccttgttagcttgtggcaatgacgtacctggcacaatacctgcacccgtacgcaaaaccttttccttcacggaattgtagattggcaaacgcaatccaccaagctctggaatcgacaagacacccaatggcttaccggcaatcttcgtcaaagaagaattcttacccgtctccacatccttcttttggttcagctcaatcatcgccttcaccacgtcaggatccgtatcaccattcgtgctctgcgccttcttcttaatttcatcgttacgcttatctgcctcagcttgcaacttcgccttttcgttagcgttcatttgcgcagccgttgagcgataattgctaaccactccagattggtgagttgcttcatacgcttgcgtcacaattggatatgagaagatgctcaagcccacaataaatagaatccaggttgaccaactggccccggccataaacttctttttcttctttgccattcttttctcccccgagttaatagctaaatatgtacctcgccgatcacccggcgagcaaactaatcaagattagtcattgttttgggcacgacgcttcttaatcaaagcaatcaaacctgccaatccaagcaacgtcaacaaaccaccaagggccgttgccgtatatggcaagataccaccagcgtgcgttggcgtatcattaatttgtggcttttcatcgcggtagttagccaccgtgatgtcgtctgacgtcgcagcgccgttaatcttacctgattgcgtgtttgacaacgtgaagtagtgcggttccgtcatcaacttgtagcctgatggggcttcacgctcgatcaattggtaatcaccgccagccaatccacagtattgcaagtatccgtcaggacctgaatagtgggtcgtggcattgtcttcacgaatcgtccacaaaatgtctcccatcggatcagatgcgtttgagtgcattgatgccattggctcacccgtcgtcatatcttcgtgcatgaagtatacccaacgcgtcttgccggccttcacatcatcacgcagttgttggacgtcttgctcagatgccgtacgcttcatgttagggaaacgggttgctgtatacatttcggcgataacttcatcaatattcgttgacgtcaccttaagtcccaaatcgaatccggcaccagccaaaccattcgtgatgttaccgttactatcagtcttcacatcaccatccgtcttgatgatttcccatccggccgtgaatgtgtgcgtcttatcgtcgtctgagccaccgtcatacttggtgttgtaatccaagtcaatcttgttgaccaagtgatccgcttgcaacgccgtgttaccagctgagttaatcttccagctcaaattccatgaaccgtcatcagcaccttctgccaacaacttttcaatcaaagcacccattgcttggcgaccagaagccgtcatatccaacacgatttcaccgttttcaactggctttgtccagtcaacaacacgggctgggttagctgaatcaccttgtccaacgaatgtgtacgtactctcgtgaccgaacaagttgaatgatgatgcatcaaagccttcagccaaacttgtcacttggggtgcagttgcagcatcataagcaattgtcttgccattcaacgttgaaccgttttgatcagtcgtaaagccaagtcccttaccagtcacaccttcgtcaatcaatgacttgtcagttgcgtggttcactgggtacaagccattgaccacttgtgacaatggcactggctttgtctcgccgttttgcgtgtacgtcaacgccaaatccattgacatccagttaacttgatatggcatttcatcagtcaacgtgtagttcgtgtaatcagcgatgttcttgttcaactcagacgtgatatcccatgtgaacttttgtccacgggcgataccttccttgtcatcaccggtacccttttcattggcaccgaacgtttggttatcaaccgtaatcgccttgtcgacttgcaactcatcgtagttgaccaacttcgcagcgttttcgctatcttgttcagccgttacaaccgtgacttgtggatccgtcaagtaacccttaggtgccatcaattcggcgatgacgtattgttgtccctttgaaatcgcgataccgtcgtttgcatcaaagacaacttgtccatccttgtcagttgattcaattgtgaattggtctgacgacaatcccaacgcagcagcgaccaatgaatcggccttcgctggcgtcttttcaatatccttaatcaattgtggcaagacttcgttcaacttatcttgtactgaagctggcgcaagcaaaatttgcgccccgcccaaagccttctcagtctccgcatcagtcttcttgatcgtcaatgaagccgtcttgtattgcttcgtgtaaacgtgcaaaggtgactcagtgtcataccagtagtcagtgtctgatccgttaaccttacccattggcaagtccaagaagattggcaacgcttcatctgtaccagtagcatcagaatcttgtgtaatcacccattgtccgtttggcaacgtcaacttcgtttcaccatcaccatcagttgggccactagtttgcgtcttcaacccagcatccttcacagcagcaacgaacttatcacggtccaccacttcaatcgtcttgccagaaatatcttgtgttttggtatcattagtcgttgcggcagtcttcggcgcttcaataaccttcaatagctttgaccagtcaatgcccttaatcttttcagttgcaatcttaggatcactgccagagttcgtgtatgtcacgaccccatctggcaactcatatgccgtaaacgttgcaccagttgtcgtttcccaagttgtatcaggatccgcattcttcaacgtatccaaatcctttttttcacctgaaccccacaatgttggtgcatcggcagggtcactatcactaacgtctgtaatagcgtgaatcataacacttgtgcttgttggtgtcttattgatgcctgacgttgccaacgcatccccagtcgttagcaaaatcggtgcaatcaacgtccccattaatagtaatgaacgatgctttttcatccgcgtatctcctcaaaaatcatatccttatttttaaccccatacttgaccacgtatgagtttttcttcacagtaaaattctcacaaaaaaaaacggcgtttccgccgtttttgtgtttcacttttctatttaatttgtgcctgaattttgttattcgtgggcattttgtgaagagtgaaatttcaacacagtcaaccgaaaaacggtaatcaaatcattcctgattcgattaccgttttcgtgttctttcacatatcgtaagaaagatatcatcgcaaaggcgggatcaatctcgtctttctaatatgtcttgtcacgttttctggaatgtataacgttattctagcttacaaattaagcttcgttcttcatatccttcttacgcttcaacaatgcaagtcccattgccaacaatccagcaatcactgcgaacaacgtaccaagtccaccgaccaatgggaagattgacttttggtagttcacaaattgaatgtcatctgaagttggaagtccatcaattttacctgaattcttgccgttatatgggttcttaacagtagtgtcgtctgcactacctagaccaaacaatacagcatggtcaaactttgttccagccacaccagcagctgtatcttgaccaaggtaaacagtctcaccaccaagttggtaacctgaaggagcctcacgctcaatcaaagcataatctcccgcagccaaaccacagtattgcaagtatccatcagcggcagttacgtgggtagttgcccatgctgcaaccggcgtccaaataacgtcacccatgacaacaccagtggctcccatgtccatttctggctcagcagcacctgacaccgcatccttgtgcataaagtacaaagtacctgatccaccttcggctggtgattggtaatcccctgcgtccatcattgaaactagacgatcacgcaaattcgtgcttgaatttgcatctgaaaccggatcagtttcaggatcgtaatctcccgtataggctgttgcaacaatagccgccttcttttcatccttcgttggataagtagtatcgtcgttccaaattaccgtcgtgttcaacgtatcgtccgcaaggaattgctctgaggtagcagccgcatagtacatttgttcccacaaagcctgtactgttgtttgctttccatcgatagtgattggcttttgcttagtgtcatcatctgagccataaactacagttccatcaccattacttgccttaccatcatagaagttgttcaacaatgcgtcacgctttgcaacggctgcatcgctatcaccaccaggaatgtttacagccaagtcaaacttagctccagccagtgcctcaccgctaccattcttctttacaagttcccaaccagcgtcaaacgtttcaacgtcatctgtcttggttgaagaatcaacattaccattaacaaccaattcaacgtggttcttaattgcatccgcttgcgccgctgagtttgcacgtgcattcaatgttacatcgatttgtggatcagcgtcagtagatgcactagcaaggtattgcaacaataaacgactgtctgccgtattgaaatcgatggtcatttctcctggcgtacgagtatccttagtcgttgtgcgcttgtcgtccgtccaatcgtaaattgatgaaacacccttgatttgaacattagtcttaatccaattatttacaatcgcatctgtaagagtagcctttgttacacctgtaccaaaaatctttgcgacttgctcatccgtcaacgcggctgcaatatttgctgcattacccgtcaaagaaacattatctcttgtcaacgtatcatcagcggcgaaatcatcatcaccaccccagttatcataagccaaaccacttccagtgtcaccaaccgtaacatccaacttcttaccatcacgcaagtgttccatactgaacaaaggtccagttaggccatcgacagagattgttcccgtcaaccaatttgtttgatatggaatcgtatcgttaatcgtgtaagtagtcagcttctcgacacccacctttggcaagtcacccttgataatccactcaaagtcttgaccacgatcaataccttgaaccttatcaccaggctcttgttcgtatgggcctacacctgatgttaccccagcgatgcgaatttgcttatcaacgttgttttcaaagttagtcacatcaacctttccaccagtatatgaagctgtaccatcttcagttgcgtccgtatcacctgttccttctgaaactggatcaattgtaatcgacttcacgtcaaagtcttgaatataatctgcagtaggtgttgccaactcaatcagtttgtaagtttcacctggaaccaagccagcaaacttatatgatttcgtaccatcactcatttcagtgtattcgtaaggatcaactacaggagcggtactctttgcggcggtctccaacttcgcaaacgcagcttcagcggccgcttcatccgcgtattgtgtgcccccagcagcagcatccgtcaattccttaacagccgcgttaaatgcagttgcttcagcatccgtaacgtggaatagtccaaagtacgctcctgctacttccgtattagtgtttgaatcaatcttattaactgtcaaatcacctgtaactgagtaatcctttgcatacaagttcaaagcatgtgatgtaccatcgaaccaataatcatcatcatcatctgcatttgtcgcctttggatccatcattggtaatgacaatacaattggcacagccttttctgaaacatccggtgctgctgatgtttcaacaatcaaccaatttccactgttcttattaccgtcgctgtcttttgaatttgctgttgccaaatcattaaatgttgcaatacccgtagaaggattaacagcttcagggcccgaagtggcgtaccctgccccttgtaacaatgccaactcagcatcagtacctacccattgcaaagcatatgggttgacctttgaattccccttgtttccttgctcttggtgcttagcagcatttacagaatcatcatctgacgtagcagttgcaacttgcttaactggcttaataacatcactccatctaacagttgttgaacctggaatgaaatcatcggaaatgacaggcttatccgttggaaccgctaccttttccccggcgacagtaattgtcttagggaacgaaatcaacttgttcttctgtgtggcaccatctgtgtattctggcaaattataagccgtaaactcatagcccgtcctttgagcttgtgtccaagttattccttcagacgcagtttgagttgaatttgtaaatgggttatcatccgtcgcgtcagatgtgcctactgacccgtttccccaatagtaattagtcttttcatcacctgaaagagttgatccctccgcattcgcaacaaacttgtgtaccttgacatcagtcgtcgttggtacagacttttttgcagacgccaacgcatcccccaacggcgcagccccaaaagcaactggtgcaacgattgttgaaatcaacaaagcattcttccatttagccatatagcatatctccttaaaaatacaatctacccactcgtggctcgatttgtttgttttttctttactctataattctgccgaaaaaaaatacctaaactgctatatgcacgtttaggtattttacatcttgtgtgttttattacaggtttattacagtcgtttttgaataaactctgaaattgtggatttttttagcgggttagttttcgcgcatatctgtcttacgcttgatgtatgaggcgatcattgcaattgctccgatgaacaacaaactcaatgctccaacaccaccaacaactggcaaaactgacttcttgtagttcttgattcctacccagttatctccagcttccgcatcatcacctacattaccagtaatttggttatccgaaaccatttgttgattgtcacccgttgacgttaccaatgggtactcatcgttcgtcgactttccattcttgacatagtatgagttatcagctccaattgtgaacttcatgtcttccatttgcttgaagccctttggcacaatttcttcatgcaacatgtattggccgtctgccaatccacagtattggaagtacccacgctctgtaccagacaagtgggtcgttgcccaacgcttatcagttacccagtagatgtcacccatttccatgtgtgaattcatggcatcgacgattggttgcttgttcttatcagtaccatcttcacccttggcatccaagtggataaaccaaacaaacgtttccttatcaccctttacagcctcacgcaagttgtctgcttgtttatctaaatagtcagtaacttgatcaatcttagattgttcactacctgtaaatccaattttgtccgccatatgcaatttagttgcattagagacaacattaccgttgtttacgttaccaatcaattgagaaatcacattttcaacgttttctgccgtaacacgacgacccaaatcaaatccagcaccgctgaccggatttccctttgaatctgtcttttggaattcccaaccaacagcatttgtctgggcttggtcatatggtgaaccacttacataaccatttttgtagttaaacgtcacataattgttaatcatgtcagcacgtggttgatcaccttcgccctctttaacggttgtatttgatccaccaacgtttgcttgtgccgctgaattcgtttgcgcattcatcttaaacaccaaacttgatgataagccttgtttatcagtaagcgtcgtgaatttattaaatgatgagtaagcctttaaaaacttatctttaaagtagatgttcatctcaccattcattaccttcttattttctgcttcggcctgaagctgaacggcttgattcttctcatcaaatgagtactgactattagctccccacatgtgaatcaagtttgctgaaatccattcagtttgttgcgccaatgactcgcggtaattagcgtccgattctagtgccacctcatatgggtatccaaagatgtctgctgattcttggttatagaacttaaatgaaacaccacgtttagtagggtcctcattttcagtgttgtattcaactcgctcttggtgtagcccgtcactagttgagtggtcaggcgtatctccgtccgggtccacggcttgaatcagtggaaccagtccttgttgagtgacagaaggcttctttgctaggtcaattacaccacccgtaccaaatcgaccatacaacgtccaactgttgacgtttacttggtatggaatgttatcagtgattccaaattgtgtatacgttcccaagtcagcgttggtttctaggtcaattgtatagttaaacgccttaccacgagaaacaccgaacaacaaatcattattcttaaacgcttcttcgttgtgataatcagcgtttgcgttgtcataaacaggattttcgttattctcaccgttgtaacccgtgacttccaagtcgccaacctgaactggcttcagaacattgatatccttgtctagatttggcttgtcgtagtttactagcttgtacgttccacccttgtgatcaacatctgtgtcttgatcatcctctccaatcgtataatcgcccgttacttcactggcccgatgcaaagtagcttgttgcagcttaccatttggcaaatatcctgaaggcgctgcaatttcaagtacataatatgtttgaccaggaacaaggtcattaaacacaacaccttgttctgcattttgaataacgtcatactccaacgaatcttcgtccgcatattcagtcaattttgattcaatctggtccaatggctttgacaacaagtcattagaaagatctttttcaagtgccgtcttcttgtcttcgtcgctcagctgcataatcgcgatagttgcacccttaacggcctgcttagtctgaccatctgtcttaacaacacgcaagttaccagtatccgtataattcttagggtacaagttcaactttgaatcttccgccgttccaaaccagtttgtcttaccctcgtccgtctttgcatttaacattggcagtgaaagaataatcggcgttgcaaacgtctcaatagaatcagacggttgttctccgtttttaatatcttccaagataatccaattaccatttgctagattttgttctgttgttccatttgattttgttttcgcaaagtccttacttgtaacttttccctctttttcagctgcatcaagcgcactacgcaaatcaactgcatcgaagttgctcaagccagtgaattcaatgacatactcacttctagtatcatctagggacttgtcatctcccacgttatatccttttgctttatctaatgcagccacacctttggaaacagtcaaaatctgattccacttcactccatctggggctcctggaacctgtgtacccgctatttcgggcataccatcttttccaatggaaataatcttaccgaggttaaaagctgtaaatgaaataccctcttccggctcccagggatctccgaaataactggtatcctcgtttccatcaccccagtaaagattttcagcgtccttacctgccacttcagcgccctctgtttgacgcttgtgcagcacaactgtcgtaccgtcaccactatccgttggtcggtttgcttgcgcaaaggcgtcacccacaccaaacgcaatcggcgccacgattgtactaattaaagcaatatttttccacttcgccatatcgctatctccttaagcatttatatcatttaataatttcgatattctcttacgtctatcagtttcgcaaaaaaaaacacccaaactgcaatgtgcacgtttgagtatttttgagtttgtatgtttaattcttgtcgcttaactgttgtttttgacgtttctgtcgcaactgttaaataattgtgccttttattgccaactttgaattttttcgttcaaagccttttcgagattagcttggcgatcggccgtcaccttgttgacaatgtcgctttgcaacttttgttgagcgtccttatccttcataaagttctcgtcatccttggcacgatctgcgaattgctttttaacttggttagcaacttcatcggtaatgccgttgttgctatccttcaccatcttttgcaattccttgacttgcgctgacgttagcacgttccaatcctttggtaccgttagcacgtattgcgtcttaccagtcttcaactttgtttcaccgaataacatgaagcggctaaacaatgacttggcttgatacgtcgtcacaatcgtttccaattgggccgtctcaccagtcttcaccgtcgtctccgcattttgcgtcaacgtttggtatgacttattgccaaccttgtaggtataacggttttcaccattgctccccttttcagtcgtaataaacttgaagtccaacaaggttgctgctggcttaatcttttgtgtcttatctaatggcatcttcgtcaacaagaagtttgaatggtgggccgtatacaacccagctgccatggcaattgccaaaacagttccactaatcagtggcatccatcgcaccgtgtgttgttgcaccgaacgcaaaatgacaacgactacaataacgattcctaataccaacaacaaaatcatgctatcttcctccggctcttaatataactagtatatcaaagtcggcctactttttgtcctttgtgcgcaaggcatgcacataaattatcaaagcccacacgcaaagcaaggtaatcatgaatggaaacgccgtcttcttcaccatcgtcatatcttccccattgacgatgtcacgcgccctaactcgcgtgtctaaactcggcgtgtctaaaactttttcatccaaaatcaaatctggtgtctcatacaacgttgattgactcacctctgatcgattgtcagagtgagcgaccgttgatacgcaactcatgctcaccaaggcgagcataatcagcaatatacgtttcaacatttccatctccctttaatatctatctttccaatggtctatactactcggccttcttgttgaaaataagatttattgatactgaattcaggagtaaatgtgaattaaattatttaattttggatgggacgaaaattagacagataatactgcaacggcgcgaactgtggtgcgtaatcgaccggtgacacatcggcacgtagtacgtccacaatcgcgacatcaagtggaccatcgtttggtgaccaaagggtaatccatggcaccgcagtacaccatgcttcaaacatggcgcccatcaagcctgactcttcggcgatggcaaccgttggtgtttgcgtaatcaaaccgaacaacaagccatgaatttcatcggtgaccaatacttcatagcctgacatggcgcgccagcattcacgcagcgttgtatcgcgcttatgaccgcttagatgcaggtgcttagtgttcaagtaatcttcttctgtcacgcggccaaagaggtcgctaatcagctctctgacctgctcctgcgttgaccggcggaaatcattaccagacgcatgcaacatcaacatcgcaccgtttctaggtttacgactagtcgccaagcgtccgctcaagtgcaaaatcatgtctggaattaacatcgctgggcaaagcagcaattgcgttaagtcttgcagtgctttttcatcacgcgccaacataactagtcgctcggctgtgttatacacctgctttgaaatttcacgttcgcgtgtactgttgaaaaacattgattgtggtaattgaatcatcggttgatctttcaaccaagccaccactgaacggcgcaaattctcttcaactagttcacggtcaccaatgatgccaccaccatgaagcaagaccaggttatccggttgaataatgcggtgaatcagcggcaatgcttcaactgtcgcttcagctggcacctttacaatttggtgttctggtaagtttgtacgcaaaaacaattctgtggcatatgcaaccgcgtgatcacctagatcaccgtgttctggcataccaatgtagaaaaccgtaggtaggttcatttcaagatttaaaagttgttgtttcaactgtgggcgaattgtccatcgccacgtgatacgtttatgtatccattctccaaatttattgaccataatatcttccccgatttaaagctatcttctactatgcctgataaatgtgggggttctatgaaaatttccaggaacgacaaaaagaccattactaaatctcgaaagaaatagtaatggtctttaagttaccctttaaccggccgaagccagcctcaggtcaatttttatttcgcttagaaattaatcgtacggcagtagattacttcttcaaagcagtccacttccagtcagtgaactcttcgatgtcgcgaccttcgttacgagtaacttcgaagtgctttgccaagatgtcatccatcttcttgtcgaatgcagcagcctcatcagctgaaacaactccgttagcagccaagacagcaacagcgtccttagcttggttgaagcggtccaactttgagtatacacgcatgtcgtaagtcgtagtgatgtcaccatcttcacggtatccgtgtacgtgcaatcccaagtgttgacgctcgtagaagattgactcgatcaagtcttcgtatccgtggaatccgaagacaacaggagttcctgactcaccgaacaaagcgttgaacttgtcatctgacaaagcgcgctcgtggttcatctcaccgttcttgttttgcaaacggtgcaactcaacaacgttgacataacgcatctttacagatgggaatgcagcgttaaccaagttcaaagcagccaaagtttcgatcgttggctcaacaccagcagatgcgaagacgatgtcagcttgctcaccttcagcaacagttgaagcccagtcaatagccttcaaaccttcagttgccaattcttgagcttcttcaactgagaaccattgttgacgtggttgctttgaagcaacgatgtggttaaccttgtgacgctcagtaaatgcgcgaccaaagacagccaacaaagtgttaccatcagctggcaagtattgacgaacgaagtctgacttcttttcagccaagtgcgtcaagatacctggatcttggtgagtgtaaccgttgtggtcttgttggaatacagttgaagttgagatcaagttcaatgatgggtaatcgttacgccatgattgctctgaggcgtgacgcaaccacttgaagtgttgagtgatcattgagtcaactacacgtaggaatgattcgtatgatgcaaatacaccaacacgaccagtcaacgtgtaagcttccaaccaaccttcagcttggtgctctgacaattgagcgtccaagatacgtccctcgtgggcttcgtattggtcgtttggctccttaacttcttccatccattgacggttcgttacttcgaacatgtcccatagacggtttgacatcgtctcgtcaggtccgaagatacggaatgacgttgggttcatctttgagatttcagcgaagaatcctgacaacacgttcatgtccatgttgcgctttgagtcagccaattcagttccacggtttgactcgttgatgtcgttagcgaattgcttccaatctggcaaagccaaatcttgagcttcttcaccgcgacgacgtccaccgttagcgattgggtttgaagccatacgcttgtcacccttaggtgccatttcagccaattctgacttcaatgaaccatcttcgttgaacaattcagttggcttgtatgagttcatccactcttcgaattgtggcaacgtttccatcttctttgatgacaaaggaagtggaacttggtgggcacggaatgaatcttcgattggcattcctgattggtcgtgagtaggaccaccccaaccctttggcaaacgagcgatgattacaggccaagctgcaatttcaccgtcttcgtaacgaccgttctcacgggcgtccttttggattgcttggatgtcttcgatggccttatccaagacattagctgccttttcgtggtatgccatgtagtcgtggatgtcatcgttttcgatgaaacgtggtgaccatcccaaaccttcgaagaacttagtgatctcttcatcgctcatacgtgagaagatcgttgggtttgaaatcttaaatccgttcaagtccaagattggcaaaactgcaccgtcgttcttagggttcaagaacttgattgagtgccaagcagtcattgaaggaccagtttcaacttcaccgtcaccgataacagtaaatgcgatttggtttgggttatccaaaacggcaccagttgcgtgtgacaatgagtatccaagttctccaccttcgtgcaatgaacctggcgtttgtgcagtcatgtgtgatccgattccaccagggaatgagaaacgcttgaacaaacgtgacataccctcaacatcttgagtgatttcagggtagttttcagtgtatgaaccgtccaagtatgagttcgtaaccataacttgtccaccgtgaccaggtccaccgatgtagaacatgtctagatcgtacttgttgatcaaacggtttgcgtgtgcgtaaaggaaagtttgtcctgagatagtaccccagtgaccgataggcttaaccttaacgtcttccaccgtaattggtgtgttcgtaactgagaacaatgggttgctcttcaaaaagatcatacctgctgaaaggtagttggtagcacgccaccaagcatcaaccttagcaaggtattcctttgaatcaaaatctactgccattttgattaaatctccttataattttgagaaaaggttcaatcgcagaagttatcttctggattacaaatactataataacagatttcaaaaattggtacaataaaaagcacaaaattggtgcggtccaattttgtgctttgcttatttttcagctgtaaagcctgatataatcgcttttctggccaaatgtgaacaatttgtgaattttggattattcgccgtccaaactgacgaaactgttatatcgcatgtacttgtagtgtacgcgcatcgttccaacttcaaatggcgtcccatcatccaagaagtaaataccggccatcacaccgactggttcaacttcactcaactgcaaatggctgcgatcatcttcgtcagacggttcaaccgtcaccgtcataaatgacttcgtaaccgccttcttggtcgttgcttcggcgtagtggaacattgagtgacccaaatcttcgctggtcaactctggtagcaacttaaccggcaccaaggcattctcaatcatgaaggcttggtcttgcaacttacgcaaacgcttgatgcgataaacttgctcaccgggttccaaaaagagcgccaaacgcgtttcttcattcgcctcttccgtctcaaatgacaacagttggatggcgggtgcttcgccgttaaagcggaacgaatcagaaacacccaagttattaccaatcgcatggaacattgattggtttttgagatatagcgggttcacgaaggttcctgagccacgcttcttaaagataattccttgctgggccaagacgttcaacgcgcgcttgattgagctgcgtgacacatcataagacaaggccaatgatcgttcatctggcaatttcaagtttgggaattcgcgcttgtagatgcgatccttcaaatccccaagcactttcatgtacagtacttcagttggcatttgtctatgccctcccgtttttaatccggttttatcgtaacacaaaagtggtccaaccaaaagttttggttggaccacttttttaaatagtatctgaatcatcgctatcaagccatgacgtaaaatcttcgtcactctcgaacttcggctcaaatcctgcacttgtagcaaatgccacaatttcattattcacagtaagccagtcgttattttgaattgcggtctttgctttttccgtaatttcaaaaaacttctttttcgcttctgccaacttttcaaccgtcgcatcatccatggcttcttccgcagctttaatatctgcaatacgagcatcaaatatctctttgattcgttctgtacgttgctcatatttgacaccaaaaatatcaagtcgatccatggcatacatgaacaaggccgcagcaacaccggccagaatagtagacaaaacgccagaaagcggatcaacgggtacacccacaagcttcaaaagctccgtcactaatgtctcaaacacttttcctgaaagtgcaataacagtcgacccaaccaatttaactatggcatcccccttctgggcaggtgacatagttttcgaatccttcccaaacaaaattttaaatgcttggattgccgcaccgatagcttgcttcactatcttataaatttttgcaaaaatccccacaaacaaagacaaaatcccatctataaaactcaaaaggaaagttttaagcaaatcaaatataagcgaacctatgtttttaagttgcctcaaaacataacgggtcagtcgcttaaaacgatactttatcgccgcgccgttcttatacccattaacgtcaataccattcttcacaatatcctttatttcataggtcaatggatttaataataaacgaatcgcttcaacaaggccttggttagcagcttgcttgccaccatcacttgcggcatgtttaccaatctccttttgcatgtctcttgtgtccttgttaaagacattaacattctctcgcagttgcttattcgtatttttctccatcgcttcctgagcttgttgctctttcgctaacatggtttgtctttgagactctgatatttcgcctgaatgtttctcaacatattcactgttggtctgtttgtttttactaaggtttgtatctctagacgtaactgcaagattggcatcgtcattgataatggatttaatattttcttccgacaatccgtaattctttgataggtcattaagagccacttcaacgggaattatatgatcactattcgcctgcttcccgtccgaatagttagttggttgattttttttatttttgaatatcatctgttcaggatcatattcatctcttatcaccttataactgtctttgttatcttccccttttttaaaaactttttcgttatatctctcttgattgccatttctatatcgggagtgatctccactttccctaatcttagcgttttcatcccttcttgcttgctgtcgctcacctaatttttcaagtcgttgcttctcaacaagtctatcgctatattttggcctagcagattcataatcaacctcatcttctgggtcatattgaaaatcccacgctcgccctaacaagtcagacgccgttattcctttatctcttaccggctttaaaatatccatctgtaagaaaccatcgaaaatactaaaaaacgtaggctttacaattgagtccagcacattgccgcctttttcaaagtcagcataaacctgctcaaccaccttgtgagcatcttcttcgtcgtatagctcagcatcgatcagagcttgaggcagatcaaaaatcgacgcgttattgatattgttttttatttggtcaattgatgtcatacttcctcctttacgccgccttagcaaccttgtccatttgcttctcgaaggtcttcatttgcgatacgtcttgttgcttaggctcagcgaattccttatcgattaactctcgaatcaacttggttgcttccatcgttgcacgaatttgcatttgttcttgcttcgtaagcaacttcgaacgcttcaatcctgttgtcttattcaagagcgacacagttgcatatcggaaactcttagcctcaatttcattaagtaccagaccatacactgactcaatctgattaagcacgtctcgaatcgcttcaaaagctaacgccaagtcctctgcgcggcgcagttcggccttcaccttttcttgtgtttcctcaaacaccttggcttcgtctttgacgtgataaagcgtttccttagctcgctttcgaccgtaaatccccaatgtaaaaatattcttcatggttctagaaaacgacggcttatcaaaatcaattgtctttaacgcatcaaatgactgaacagattcaaccttcttcagactaatatccagttcctcaatcaaagcgatatcatcgttaactaataaaggtttgattcgaaccattgcttttgcaaaacgatgcaaattctctttaagatttcgttgtttccagtcattgatatcattaactgcgctctgaatacgatcgctcaaatcttgataggaggattctgatttttgtttgaacgaatcagattccttcttcaatttctcgtacatcttcgacgcttcgtccattgttgccttaccactaatttttgcagcggtgcgggcaaccattcggcctgcggctttaataccttccttaattttttctcccgccttcttaacacctcggcgaatagcggcaaacattcccataatatattccctttacctttcgatcatgtcataaccttcatcaagcaaatcattgaagtccgtcatccaattcagcattcgcttcatctcaaggtcgcgaaatcccaaatccgtccccacagtcatcaaccagtcttcctcagcatcatcaacaacttcatccgcatcagctaccccagctagctcaataaaaatcgcacgcttgactttcttggttgagctttgaaaatgcataatcaattcttcgtaaggaacatccttaaactcatatttttgcaactcagtttcaactcgcaaggcgttcataaagcgctcttcctgttcattcattggggacgaatgctcgaagcttaatttcaccaactcaataaaatccttttgctctcgcttgttcaaaaaatttaaaaacatatcacttcacctctttgccgtttgaattatatttttgtgttgttgtgttgtcgcctacagttactctgcgttgcttcaagttaccgtttggatagaattcttcgacagaatataaattacccttgtcatcgaagttacgtacattgtgcatttgtccatttgaatcaggataataatccgctagcacacgacgaataccatttttatccaatgtcgcagattgcatcagttcaccttgaggaccataaactgcataacatccaggtcgttatccttcacgcgttttgcctgtccaccagaaacctttcgcaaccccaattgttccaacttatcaacagttacattactcgttgcatgaacagattcttctgtcttattcgtatcggtttgtgcaacacgcatcagtttttgtgtaatcacttgaatatccgcggtggcatctaccaatcgttgatcaatcacatctattcgcttctgtaacttttcattagtctgctttgataacttctgcatttgctcgatatcttctagcttatcggcatttccatatgcaaaatcattgaagccatttgccataatttcaatcgaatcattcaagcgtgtttcaagacggtgtaagtttcgaacgccacggtaaacgtccgtttgaatcatctcactaaattctgccaaatctgatagatcttcaatttcctcagtatgattatttttaacctctgccaagatttccttattcgactcaagcatcgtcttgtcgctcatctcaatgagttgctgaatgtcattgacttgtttatcgatagcaagttctagaccagaaatcgcaagctgggctgctttaatttcatcggttgcagatcctgaaccttgttcaactgcagtcgtcagttgttcactttgctggtcaatcttagtatttagggcttgttcaatattttgactaccagctaccatcttgtccgacagttcattcaatgcatcaagctgcaaaatttgagcattttctatcgaatccttcatagcgtccgcactatctgacacaccatctaatacatttgtcttcaaagcacttaccgcctgctcaacctttcgataatcagacgtcatcttatttgacaatccatcaattgactctagttgcgcatttcgcgcattttccaaagacttcttcagggtatctgtattgtccgatacaccttctaacacatttgtctttaagtcacttaataacatcgcattttcacgattgttatctgcaacgttttccctaaatgattcaattgacttattggcttcttgagttttttcaccaactgaactaacttcagcaagcacatcgtcaaacctagtctttgccaactcattccacgctgcgaacgttttttcgtttgtcagtacttgatcatttacattcttaacatcaccagtaatcaatcccaagtgagacataacactttcatggttctgattagttgtcgcatcaagtgcatcagccacgccttgcaaatccgcattgaattggtcggcttgtccctcaaaattgacttgcatttgttgcttaaccgaatcgatgctttgacgtgtctcattgaactcactcttttgcgtctcatcatgtgctttcatcacagcctgcatgccgttctcaaaaccactcaccgattcgctcaaactatcaatgcggttcaattgagccgtattattctcactcgccttagtttgtccctccaaaatcagtgctttgattccatcatcgttagaaatcaagctatcattttgattggtcatttgttcagcaagactcgcattggccttccaaagagcgttaccaaggttttcattaacatcatgtacgtgatttaaaatatcttctttttgctcagacaaagcgttattaatcttgtcctgactatcacgcaacttgttgagtacattttgaacctgtgcatctacgttcttttgaatatcgctcataccacgctcaagctcatcagcacgttcagcttgcttgtccatttgctctctaaatcgtttttcagccttctcagcatttccatcaatttgattgcttaattgattagtaacagcttctagcttggtgaactctttgtgattttccgaattcaaggtctcaatcatttttaccgactgatttgaacgttcatcgacatacttccttaagttcgtaatctcagaattaagttctttagttgtcaccttgttttgttctgtcagtgtcgaaaaattcgtctgaacctcctgagttacattcttatcaacctgcgatattttctcatcaacttcgctggatagattaacgattttttcagccgttgcttgagtatcagcatcttgtttttcttgaatactgtcttgcgtcgccattaactcgctaaacttagcatcccagtttgctttgaattctgtaacaacaacgtatgtcacagccatcagcaaaataacacctagtgcagatgaagcagccgttataatcagttgttgcccatagtcaaaagctgtatttaaaattgcgagcgcaatcaacactactgaaaccacaaataatggttttttataatccgaaatagccttcatacatcagtcccccaaattgatatagttggtttatgctttagattataaaaaagaactcactgcaattggtgtttgaacccttgaagactaagacaattcaaaacccaacaagaaaaatatctataaattccttatttattcaaaaaagagcggaaacatatcgtttccgctcttttctatgcgttatttcgttgcttaaacaattgcgttaatccgagtgataagacgaccaatccggtcgcaatccaaaaggctgcgtgaataccagccaaatcggcacgcgcttgggccatttttgctggtgcacctagtgaaaccagactgtagacggtaatcaaagccgccgttccaaatgacgcagcgacctgacgaatcgtcgtgtacattgctgatccatcgggcaccatctcaagtggcaatgaattaaaggcctcggtttgaattggcatcgtgaccataaccaaaccaagttgacggatgaattgtccgaccgctggcaaccagattggtgaatccagttgcaacgtcgccaagacaatcgttccgataaccacaaacaccaacccgattggggctaggcgctttacaccgaactggtcataccatttacctgatgttggcgataggaacgccgtaatcaaggcaccaggtagcaaaaccaacccagatatgaatgctgattgaccacgaacggtttgcatgtaaagtggcaacatcaaggccccaccatacaaggcagccatcaagacaacgttaatcaacgttgccatcgtgaagttgtgatacttgaagacatcaaagttcaacaatggcatctttgagtgggtttgttgatagacgaacaacgccgttacaacaataccgattagcaaaaatgcccaaacgtcaggacttagccagttacccgtaccggcgtttgagaacccgtatagcaagcttcccaatccgatacttgagaggaccatccccaagaagttgaacttcaagaacttttgttgaccgatgttcttcaagaaaataaaggccaaaatcaaatcaataatgatcagtggtgcaattcctaagaacaaccagcgccatgagtggttagacaccacgaatccagatagcgttggtccgatggttggcgcaaagttcaacgccagcccgataatccccatcgcttgaccacgtcggtcagccgcgaacaggttcatcacgaccacgttcatcaacggtccgaagacacccgctccggccgcttgaatcatacgtcccatgatcaaaatggggtatgatggcgcgaaccctgcgaccaaggttcccaccgcaaatacgaataccgcgcttaagtacaacgttcgcgtcttaaggcgttgaattaagaaggctgttagtggcaccatcacaccattcaccaacatgtacccgttcgtcatccattgaccaagggcggttgagatgtgaaagtctgccatgacttgtggcaaggccgtgttcatcaacgtttgattcaagaatcccaaaaagactcctgcaatcaagataatcaaaacacctcgctctttcttgctaattccgtccataacccctccttatatttttttagtttagataatcagttcctgcccactctgcttcaaactgcgccacaaattcatgcataatcgcatcgcgcttcgcaccaattcgcttcccttcgtcagtattgaggtagtccttgagcaaaaatagcttttcatagaaatggttaatcatcgtttcgcccgtcgcatcacgataatcggccttcgtcttcaaatcgcgtggtggcatcgttgggtcatacaaaatgtggtgcttttgaacaccgtattgaatgacacgagccacggcaatcgccccaattgcttcgagacgatcagcatcttgcacgatttgaccggccaatgtaagtggctctgggttaccgaaacgttgcttgctccatgacatgttatcgataatttggaaaatttcggcctgtttagcctcatcaataccattatccgtcaacatgtcgacaactgcttgtttggcgcttgtgacatttttaaataacttatcgtcatacgtgtcatgcaacgtcgcggcagctaccgcgataaattcgtccgcggttggttcagtcgtcaaaatgtgcttagtcagcgccacaacacgatcaatgtgcgtcgtatcatgccctgattcatccccgccaagcaccttttgcataaaagcagtaatagcaaccaattgttgttcttctgtttttgtcatcattattccccaaattttattagcgtcgaccgataatcgcggtcaacatgtacatgataaacgtcgctgccaacacgccaccaaagaagtaggcgattgggcgaccaacggtttcccaaataacaaacgcatcgttaatccatagcccaacacccaaggcaacgatcgtcaaaaagataaagtagtacagcgcaccactcttggtattctgccaatcagcatcactcaaattcaacgccaaactcaaattcaaaatggcataaatccacagagcgacttgccaccaggcggtattcagccacacgctactgccgtcgtgaaacccaattagcagttgtggccacaatagctttgttaacccccaactggttaaggcaatgccgaaaatcggtgccataccaatgaaaaagttaccgagttgttggtacttattctttggattccaagcatgtgacacataacccatgcgattctcattgccttccttaaacggattttggagcaacttgattttgtcgacatggtggccaaagataattgacatcaccgcatgcgaaatttcatgaatcatcacgccaaaccagccaaagatgagcggtgcattaagtccaaatgcacgcatcaaatgttggttcgtgcgggttgtcaccactgaaatcaacgcactaccgatgagtggcaacacgaagaaaatgccaatgacaaagacccacgtttgccaaataatcgtccagctcatgattagtcagccgtgcgaatgtccgcaaacttggcgtggacaaactcagccaattgctcggcatccaaacggattgaacgacccacttcaccggctgacaacgtaattgtgccagcttccttagcactgttatcaaagtaaattgggaacttcttcgtttgccagataccaactgggttattcgcaccgtgaatgtaaccggtcgtcttttgcaaatccttcgttggaatcatgttgaccttcttgttgcctgaaacggctgccaacttcttttcatccaagtgggcatccattggcacgataccgataactgggccggttacgttgccaatcaacgccaacgtcttgtagatatcatggtcagttaggccataattatccaactcggcttgatcacggttcataccaccagcaaacacaatactttcatatggaatcttagccttatcaagaatttgctcgacaaggatcttcttaatacgctctttcttagccatgattatctctccattcttcagaacacttctcactaaatctagtacctattaatatacgcttaaatggtgtacactaaaagtccgactaacccttcatgtacttttgagacgtatttctcggcttttagccaggtacatgaagaaaggctcgtacgttttgcgacgtacgagcctttttgtttttttatttacttgcgcaattccatttcaatttcttccaatgacttaccacgcgtctctggcacgaggtaacgaacaaagaagattgagatgaaggcaaagacggcgaagaccccgaatggtccacccacgttgttgtggaagacagccaacaaaaccaagaagaattgtgataccaagaagtttccaatccagttggcagctgaaccgattgatgatccgattccacgcactgacattgggaagatttcaccaatcaacaaccaagcgattgggccccatgaaatagcgaatccgaagatgtacgttgcaatcaacaacatcgttggaatagcagccgtttcaactgataccgtgtagttcaagaccgtcaagatagccaaagcgactgtcatgacgattgaaccaaacgtcaacaatgtcttacggttgaagttatccataatcatagttgccaaaatcgtcaccacgaagttaaccacaccaattccaactgaaatccaaatggcgttggcttcgttaaagccgaatcccttgatgaacacttgtggcaagaagtaaatcactgagttgatacccaccaattgttgcaagaacataattccgatcgcgacaattacggctggacgggcgattgtgaacaagtccttcaaaccaccctttggttgcttatcaacttcagccatggcagccaattcggcctcgactgattcacctgacttggcgcgcaagtgagtcaaaacgcgctctgcattttccttatcacccttcgcaaacaagaaacgtggtgattctggtagcaacaaaccaccaatgaacaacaagacggctggaatcaaagctgatccaagcatccagcgccagtcgcggatacccataaagtcgtgtcccaagaaaccaaggttagacacgtaggccaacaaaattccggccgtaatcatcaattggaacattgaacccaatgaaccacggtgcttagcaggtgccaattcggccaagtaagctggcgtcaacgctgacgctgacccaaccgccaaccccaatacgatacgcgcaatcgccatcgtaccgaagccagtagcaaaggccgtcatcaatgaaccggcgataaagaacaaagaagccaaaatcaacaacttcttacgaccaaagcggtcagctagcggtccaacccctagcgcaccagccgctgatccaatcaagacggctgacgttacgaacccggtttcagcaaccgtcaacttaaaattgctttcgataagtggcgaagcaccagaaataattcctgtatcaaatccaaagagcaagccacccaatgccccaaagaaaaaaataaaccaaacgttaatcttcattacgttttcccctcacaataagtaattaaaatatctcaccggcttaatataacttacttttcggacacatgcaagcgctttcataagaaaacaggattaaatttgtgcttaatacgggaaaataaaaaaatgacccgtaccccaaaggatacgagtcattttcaaaattcaattattgaaaccaatatagaactgtcgcgattgccagcaggacaccggcgatcgtgataattggtcgtcgaatgtccttacccacaacaatcaaagaggtggcgataaatagccccaccaaacttaagatatttctgatcatggtaaagacctgctttgtcgtaattatgattcaacgtgtaatgaacgaatgcctcgtagaatattaccgtaatcctcacgctctagcataccacgatttagctcagttaccgcatgttcaagacgcttatcggcgtcgtcaccgaatgacaatccttgttcacgggccgtgttcacaccgttaataacgttcatcgtaaattggtgcaacacttcgatcggtgctaattcaacaacacggttcgtaatcgttggctcaaagtcattcaacatatccgtgatggccataaactcatctggacggatggcacctgccaccacgatatccaattgttggaagaacgtgatgatttcagggtcgtttgcgaaaccgaacacttccgcttcacggtgcattgattgaatcaattggcccaacatacgaatgtttgaatcacggaatgccggcacaaagcgaatgaatgacttaataactgtctcataatcatcagctgtcaattcttcttctgtgcgctcacgcataccacgtagcgccatttcaatcacagggtcctcgctagcaattgcatatgaatcaacgatgttttcagcaaccttcttaagcatttcacggtcaccttcgaagaaacgcaatggggcaaacatcaagcgaatacggaattccgtcaaaagtgacgccaagtccgctacagtgtcacccaccttaatatctttggcagctgccaaaatacgactgcgatctgcttcatatagctcgttttcacgaacatcaatgacatccgctagcgtatccatccgcgccaatacagattccgcagcctcaacaatggcttcgggatgcaaaacatcacaatcccagccaaacttcttgctgaccgtttccttaggttcggcattgatcttcttctcaagctctaaatctgttagttctccaagtccttgcataattttcacctcaattatttggtatctctacccactacttctattaagactatcgtacctaataaatgttgggtaattgatatgaaaatacgaaaaacgctggcctttttcgtaaaagaccagcgtaaatttctattcttgatcgtattgccattcatctgggaagcggaatatgccattcgtacgcaagagcgctgatggatacaattccttcaccataaagaattccggagtgatttcaaaggctggcttaacaccaaactccgttgaacgaatgtagccgaattggttccagtaaccaggccaaccgatggcagccaagacaccgtatccagcgaaacgggccacaatttcagcttcttcaaccaagcgccagcccaggccacgaccacggtgaagtgggtcaaccacgactgggccgaccacgccgactgctgtgccagtgcgattatctgaaaccgtcgcagcggaaacaataacataacccaaaatttcgtcaccacgcttggcgacaatttcaattggcttacgaccaaatgggttgccagcgcgtaggcgacgcaccaattgttcttcttcgccagtgctgtagttggcatcgtcaaatgcactgcgaataatcttgtcgacttggtcgaaatccttatcgcctaagaattcaaacgtcacatccaataatggatgcgtttcattcatttggcgcattgggaagcggtcaaagatatagcccaattgcttcatgaaacgcaacttttgggcatccccatgacgcaacttttcgctacggtcagggtcgccaatcaagtgaccaaacaagttgtataagtcatacgtcgtgagcacgtggaactcaggttcggtgtacgtaaagatgaattgaccaggcaacttatgaccgattaatggctcaaccgcactttgtggcataaaggcaactgacaacgagtcatcagcgtttgagaataccaattctggcatgtccaaacgttcaaaaccaaccgtgcgcatgacggattcaatcatcaattcgttgctaataacatcatcatccaaaatcaacggtgccaacttactatccaagtcatagccagacaagatttccaatgcaaatccgccggatacgattggcgtgacattggcttcattcaacgaacgcaccaattgttcaaattgtgtatagcgcttcacatccatttcggtgcgccctcctatctcaaagttcagtactttaattataccccacaaggctacttgtaagcttgccttaactcacggagcatgtctttcgtctccgcgtcatagccgtaacggtcgttttccttagcaaccgttggcgcatcatgcacgtagcccaagccttcgtaaaccaagttgcgatacaaatccaagtatggcaagccacgctcttcagcaagagccatctcagctgcttggtcatatgcgaccgtgcggaaatccgttgcgaaacgtgtcccttcgatgtccaacatcaagtaacgggcttcgcggttttgacgcatcttgcgcttcaatgagaacggactaccaacagaaccagggttcaagatggctcgaccatctgaagccgtgcgataaatcatttggtgcgtgtgaccataaatggcaacgtcggcatcacgtcccaagaatagcgcatcaaaataatactgatcactcattggcaacaattcatgacccgcatttttatttggcatattgtgcgacaacgtgaaggttaaatcttcaacgttgcgtgtatcagatactggcaatgccatgataaagtcgtaatctacttttggcatgtgttgcatgacataggctgatagacgcgccgtgtaaacacgcgttggcttgttgtaatcgaccgttcgctccaatgctgcgaacatgaagtcatcccagttaccgcgtagccaaaccgtcacgtttagctcccgcaacatttcaacaacatcatgtgcaccaggtcctggcataaataaatctcccaagaaccagaattcatcagcaccttgcgctttggcgtccgcaatcgttgctgccaacgcggtcacggtgccgtggacgtcagataatactgccacctttgtcatgtcacacacctccatttcattactgttattgtaagcgcaaaaaagccccaattcccgtgaaaagggaactgaggctaaaaagtcacgatgactaactttggacagtgaaaatcgtgactcgctttttctattaacttagaacgaagctcttgcgatgcttcgctacagtgttagtttacaatgtagcgccagcactttcaatctaaagtgctggcgctatttaacttaaatcatcttacgatctgattgttgcaacttcttctcgaaacggcccagcacacggctgataccgaacgtcaaaatgaagtagatagctgccgtaatcatcaatggaataaatggcttaaatgaggcaccttgtaccactgacgtttggaacgtcaattcaccaacaccgataactgagacaactgaaccttccttaataaccgtcacaaattcgttacccaaggctggcaagatgttcttgatggcttgtggcaacaccataaagcgcatcgtttgcatcttcgtgaacccaagtgaacgcgcagcttctgtttgaccagctggcacagcttgaattcctgaacgaataatttcagcaacgtacgcagctgaattcaagaacatggcaatcgcaccggccatgaaacttgaaacatccaacccgataacctgcgttccaaagtacacaatgaacacttgaatcaaaagtggcacaccacggactgcctcaatgtaggcaacggccaaccacttcaatggcttcacgcttgaaagcttcatcaaagccaacaacacaccaagaataattccgaagaatacaccgatgaccgccaagccaaccgtgtaaagcgttcccttagcaaagtaaggggcatacttttcgaagaatgactccttgtggttcatcaacgcaatcgcttcgttcttccacttttctagcggatcaccgataacgtgcttttccaagatgttgtcgaccttgctttgcaaaactgttgcgttcttagccatcacaactgaagaaccgttcgtttcacctggcaacgtggccttcgcaaccgcaaattggttactttggtccatgtagctgtcagccgtcgtatctggcacaaccacaccatcaaccttgccttgcgtcaattgcgtcacggcgtcgttcaccttcttcaatgacacaaccttcttggcgccaacttgcttggcagcgtcttcttgaattgatgaaatttgagcagccaacgtggccttcttcaagtcgttcaagttagccaacttattcgcgttcttcttaagcgtcatcaccacgttcttatcaacgaagtatggttctgaaaaagccacttcttgttcacgttcaggcgttgccgtcataccggccacaaccatgtcgaccttccccgtcttaacagcaccaagcaacgcatcaaagctcatttcttggacaaccaacttcacgcccaaacgcttggcaatttcgttggcaactgagatgtcaaacccaacaattttgtccttgccgttcactgttgtgtggaattcgtatggcgcgtaatccgctgacgttccaacaatcaacttgccgctcttttcaatttttgaaagaaccggatccgtttcggcagcttggacagacgtcaaaccagcaaaggaaccaatcattaataatgtcgccataaccgccgtcatgacttttaatacccacttatgcatataactcattctccctttgtcttacaacatctttgccaagaaactttgcgcacgctctgaatctggattttcgaaaaatgcttctggattatcatattgcgtcatatcgccatcagccataaaccaaatctttgacgctacttcacgggcaaagcccatctcgtgtgtgacaaccaacatcgtcatgccttcttgcgccaactcacgcattgtcttcaacacttcaccaaccatttctggatcaagcgctgatgttggctcgtcaaacaacataatcttaggattcatcgccaaggcacgcgcaatcgctacacgctgttgttgtccacctgacaatgaagctggatatgcttgcgctttttcagccaagccaacctttgctaggaacttttcggcaatttgtgtggcttcatcatcagccatccccttcaccttcaacaacgcaatcttaacgttgtcgataactgacatgtttgggaacaagttgaagctttggaacaccatccccatatcttggcgaatcttatccaattcagtttccgtcgcctttgagatatcttgcccatcaaagataacctcacctgacgttggtcgatccaacatattcaagccacgcaacagcgttgactttccagtacctgaaggtccaagcaatgcaatcacatcaccctcttcaacggatgcattgatatctttcaagatgaccttgtcaccatattctttgtggaagtttttaatcgttaaaatcgccataacgttttccccgtttcatattcgatggataaatattaacaggtaacgaaaatttatgcaataactttgtttatttttgcataaacatcactcgcgacatacaaaaaacgctactgcagcaactgcaatagcgtttttacccctgtgagagagtttaattattattgggcaatgttttctgaaattgaggcttcgtcttcatgccaacccttagcgtgggcacgtgaacgaagatctgcttcaatttgctcaagtgattggttacgtgtttcaattgtgaagtacttaacgaacacgatagccgcgatacacaaaacagcgtatccaatgaacaatgaaccagttccgaataagttcaacaatggtgggaacgtcaatgaaacaacggcgtttgcagcccagttaacaacggctccaaatgagttacccaaaccacggatgttcaatgggaatgactcaccgatcataacccacataactggtccccaagttgctgagaagaaggcgatgtaaatcgtcaacgcaacagcacagatgtatgaagcagcttgtgattgacctgagaagtgcattgagaatgacatgatgaacaatgaaatacccattccccaggcaccccaaatcaacatcttcttacggtcaaccttgtccataatcttcatagctacccaagtaacgataacgttgaagacaccgattccgatgtgggcaatcaaggctgcactaacaccgaaaccaacatcagtaaagatagttggggcatagtacaaaactgtgttacatcccatgacttgttggaagatagccaatcccattgccataacaagcactgggcgagccatcaagccgaacaattccttgaatccaccgttagccattgaggcttgcaacttaatgtcagccaattcagcttgtgcagattctgagttgtcttgcaattgcgtcaaaactgccaaagcttcttcgtcttcacccttacgtaccaagtaacgaggtgattctggcaaggcgattccaccgaagaacatgatgattgaaggcacagcagccaatcccaacatccaacgccatcctagatcaaagccagacaaagcgtagtttgagatgtaggccaacaagatacctgtcataatcatcaattggaacatggttccgattccaccacgcttatcggcgggtgccaattctgacaagtaagttggaatcaaggctgaggcaccaccaacggcgatacccaacacaatacgtgacgcaaccaatagctcaaagttgtgagcgattgatgatcccaaagctccgatgatgaagatgattgatgaaaccatcaacaacttacgacgaccatacttatctgaggatggtccaataattgcggcaccgataacggcaccaagcaacacggctgaaacaacccaaccttgttgccactcacccaggtgcaattgcttttcaataaataaaatagctccagaaataacacctgtgtcatatccgaaaagcaaccccccaagggctccaaagaaataaattaaattagtcgaaagcgacttcttttccgtctgcatgtttgttctccctaaacgtaaacataaagcaataggttagtttgccctaaaaactaactctcaacaccataaataatacaacttttgaaagcgtttgcaagctttttctcacaaaagttaaaaacttcacaaaacggacaaaaacgagtgcccattactggacactcgtcatttaacgtactagaataccggacgcttctctgtcgtcacaaaactggccttctttggtgtgccaaaacgtggctctccattgctgccgaccacaaaagtaaaactggctaacttttgcatttctgccaacacttgcgcacccgttaacgtctcatcgatatccgctaacttcaaaatcaccttttgatttggcttctctggattagttgattcaaataccatcttcaattccttagtcatgggtcacctcctagaatgctgccggtacgtctttgcgttcagacgtcacaatttccgtaatgctcgtttccaatcctaacaacatcatcaccgttgccaaacgatgcaactgagcaactgaagtcccctttgcaaccttgaaacgacgattgatcgccttagcatcacgatcaagccccaaaatacgcaccgtcatacggttatcgaccttcttttccaacttatccatctgtcttcctccttgaattcagcaatgagcacgcggccgcttactcgacttatcagctattatttgctgacacttatactaacgaatccaaggggttaaaatgtcgcacaaaataaaaaagacgccacattaacatttgtgacgtctctctatttatgtagatgcgacaaagcatcctcaaatttttcttctaacttcatgccccaggctgtccaagccactgcaatccaagcaacgaacaagaaaatcaccactgccgctgccccaatttctgaaacaaccgcggtcaagccaatactttcaaagataaccatgtctaagaagaacaataatggtcctgctaagacaagccccaaggtcatcgtcaaagtatcttcccggcgatcgcgttcttgcgcgacctcacatgcaccgattttcaacatctccatcagctcaggttttgaaacaatctgtaaatctcccgcttcatacgccgaaaattcttgtttaaaagccatcgcgtcctcaatgtgatcaccaatactgaatggtgcaatcagttttgttaagttgggccgagatagacgcaccaatttttcaattaaaaaatcagacgtgccatctggaaaataaaacgttaacgtatctttttgctgattaacgacgtaatacataattgcctccccataaaaactccgaagcgatttgtaccatcattatcctattgttacgtttatgtttcaaattatctgctttagtgaacgcgggcaaccatcttttgacgacggcgcgcaaagcgaatccaatcgtaagcgttaaaaatcatcatcccgacaaaaaagctaacgtacacgcggccaatcataggtacgatgattgaaaaatccataccatacaaatagcgcattgaaagcatcaagaggccgaatacaactgatgcaagtgcaagcatgaccgctgtttcacgtaaatcttccatgattttggtatacataatcatcaccgtcccatttctcgtaaattcaatataattatcataatcagaaaatgagtttattatttgaaacccatgagaaacgaagacctgtagttattataattccgaaatttaggaacacactttagtcacgaatgatgctaaatacttctattctgcgaatttattacacgcaaaaacccgtcatcttcagccaccacagccaaaaacaacgggttttactaactaaccaattttaatccatattcatggcagaaaatgcaggcgctggttctttatcaccgttagcaatttccgccttcaaacggcgtacaaccttaacccaggctggcaccaagaagaccaatgatccaatccaagccaatgggtttgccaagctagctccaaagaaaccaaaccagacaaccaatgagaaggcggccactgaacggaccaccatttcaccaacaccagcaagcgttggcgtcttaacgtcacccaaaccttgtagcgtgtaacgaagcacgaacaaagtggctaggatggcgtacaacggaccatttgcccagaagtacaattgtgccaaatccataaccgtatgttgaccggcaccgacgaacagcgtcaccaagctgcgaccgaacgcgatttccagaataccaagcagtgttcccacactcatacccagaatcaaggcaatcttcaccccgaccaagatacgggcgtacttgcgcgcaccgaagttttgcgccgtatacgttgccatcgtcacaccaaatgacatcaccaccataatgatgatttggtcgacctttgacgctgccgtattcgcagcaacggcatccgttcccagcgtgttaaccgctgcggccaacgtaactgaaccaatcgcgatgattgattgctggaagcccattggtacgccggctagcatgtgctgacgcaattcacccttaggcaacttaaaatcagacccagtcaagtgcaacgtatccgtgtaacggctaatgtgccagtgtgacgctgcgattgacacaaactgtgccaaaaccgtcgcaaaggccgctccttcaacaccccagccgaacttcaaaatcaaaatcagttcgagtgagatgttgaaaatcatcccgacaaccaggtagtacagtggcgctttactgtcaccaaccgcacgcatggcattagaaatgatgttataacccattgtcgcaattgttccagccaagataatgacaataaacacccgcgcctctgcgaaaatatcggcaggtgtttgcatcaatcgtagcaatggatcaatgaacactaagctaataatcgtcaaaataattgacatgataataccagcaacaatactggtggcatatgattggcgcacacccttcatatcaccagccccaaaacgctgtgccgtgatgattgacataccagagctaaacccttgtacgaaacccattaccaagaattgaatcgcacccgtcgctcccacggctgccaatgacgtcacacccaaagtttgtccaacaaccaacgtatcggaaatattgtacatctgttgtactaagtatccgataaccaatggaatagtgaacatgacaatcaacttaagtggactgcccttcgttaaatcattcatttttaaactactcccccgctaactttaaaccttattaattcatagtatagagtagttttgttcaaagtgtgaaatttcatgaaaaaagaccgaggttgtaacgttctgtaatagtttgtttgtggtttgtatcgcaggagctccgcaccaccagccccaccaaccaccatgccagcagccgagatattctctgttagttttgttcgtcatccacggttcattcgataaggattgctatttcctattttctaaccgtggatgtaaatccaatacagacaagaacatcttggctgctgcaaatgcctgtgggagctttcggagcgattttttgaaggacagagacgcccgacccgaccgctgcccgtctatgcaccaaaaccccaagtttccagtttggtgcatgcgaccggtaagggagccacgggcagtgctcgcggttgggcgtgtccttcaagaaatctttgtcggagaaagctcccgcaggcatttgctcgtgcgagagcacgacacaaacaccaaaataaaaagcacccacccaaaggcaagtgcttctaattgttattacaaagtaatgttcttctcggcaagttgcttttgcacttctgggtgcgccataaactcgtcgtaagtcgtctcggcacggtcaattgcaccttgatctgaaaccacgataatgtggtccgcaatcgtttgcgcaaacgtgtggtcgtgagacgtgaagatgataccacccttgaagttaatcaaaccatcgttcaatgacgtgattgactccaagtccaagtggttagttgggtcgtccaaaaccaaaacgtttggcttcgtcaacatcaacttagacaacataacgcggaccttttctcctccagacaaaacgtccaaagtcttttccgcatcttcacccttgaacaacatacgtcccaacaaaccacgcaagaacgtgttgtcgctttcttccttagaagcaaagtcacgcaagtagtccaagattggcatctcaggcttagggaagttcacgttcatgtccttagccaagtaatcgtgagacgtcgtaacaccccaagttacttcaccagaatctggtgtgtcgtttccagcgatgatgtccaacaatgccgtagcggcaacgtcgttttcagccataactagggccttctcattagggcgaaccgtgaatgagatgttgtccaacaacttaacaccatcaaccgtctttgaaaggttttcaacacgcaacatgtcgtttccgatttcgcgttggatttcaaagttgatgtatgggtacttacgcgttgaaggttggatgtcatcaagcgtgatcttttccaattgcttcttacgtgaagtagcttgctttgactttgaagcgtttgctgagaaacgggcgataaagtcttgcaattccttgatttgctcttccttcttggcatttgcttgtgattgcaaacgttgtgccaattctgaagattccttccagaagtcgtagttaccaacgaacaacttaatcttaccgaagtcaacgtccaaaatcatcgttgaaacggcgttcaagaagtgacggtcgtgggaaacaacgataacgatgttttggtagtcagccaagaagtcttccaaccaagcaatcgtctttgtgtccaaaccgttggtaggctcgtcgaggatcaagatatctgggttaccaaacaatgcttgcgccaacaaaaccttaaccttcgttacttcgggaaggtcggccatcatcgtgtagtgttggtcttcagcaattcccaagctttgcaacaattgtgcagcttcagtttcagctgaccaaccgttcaattcttcgaaacgtgctgacaactcaccaaccttgataccatcttcgtcagtgaatggatcgtgcgtgtaaatctcatccatttggttcttaacgtcatacaattccttgtgtccttgcataacagtgtccaagaccgtgaactcgtcgaaggcaaagtggtcttgtaccaatgatgacatacgctcgttagcctccattgagaccgttccagtcgttggttggagcttgccttccaagaccttcaagaacgttgactttccagctccgttggcaccgataacaccgtatgtgttaccaggcgtgaacttcaagttaacgtcatcgtatagcttcttaccagtaaatgatactgatacgtttgaaacagttagcatatttgtttacgtttccttttctcgtttttaatgtcattgtttattataccgaaattgtgaacatttttgggaattggttttaaaaaacggcaacaagtcgcctcgttgccgtctgatatttaattacgcttatagagtgaggcgaaataaattgctgcttcgataatcgcgatgaaaaatgagactggtagattcagcacatacgaaagtaccaatgctgaccagaccccggcaactgagaacaatacggccaggccaataatttgccagactgtgcgtccccaacgcattgcggcactggctggaagaatcatcaagatgaaaatcaacaatgatcccacgatttgggccgaaaccgccaccgttgttgccatcaagcctaagaacgctacttcaatcagttgaatgttcttcagactaaatactgccgtgtcataatcgaatgcatagtggcgtaattgacggaacatcaataggctagctagtaatactagcaatgccaaaacgaccacttcaatcacatcgacgcgactaatactaaagatggaaccgaataaaataccagttgcggctgtcgcatttttatttgagagtgacaagaatgcaattcccaaaccaattgccaccgcactaacagcagatatcaatgattcagaacgcttttctttgatgcccaactcaccgacggtcattgaagcgaccactgaaaatagtagcatccccaccaacggcgaccagctcataaagagcgcaaatgacgcccccgcaaaaccgatttcactcaacgtgtgggtcaaaaacgacatacgacgcgccacaacgaacgtgccgaccaccgcactcacaatggcaatcaacgtcccagccactaaggcattttgcataaatggataactaagcatgatcttgattacctaccttcaactttgaaatgtcgagattagcaatttcaccaaactcactaccttgtggcgttagcagcaaataatcatctgcatagcgctgaataatttccaaatcgtgactcaccataatcaccgtaatgtcatgatgagtttgataatcacgaatcacatccattaattcaaacttcgcgacattatccaaattagcggttgcttcatcaaggattaagacatttggattttgtaccaatgcctgagccaaatacgcacgttggcgctcaccgccggaagcagtatcaatccgactcttggctagattggttaagtgcgtgtccgccaaaacatggcttagcttctctttttcagttgccgttaaccatggacgcatgccgtgatcaaaactcaaagccacgaaatctgagatacggagcggaaacgcctgcatatctggacgatattgaggcacgtagctaatcgcacgtgccgcttcgggtgtttgccagtcaaattgaccggcagaaagtggtaactggcctaacagcgcacgaagtaacgttgtttttccaacaccattatcaccaatcagtgctaatacgtgcccattttctagtttaaaatcaacgtttttgtacagccatcggtcgccaaattgcatcccgatgtttgagccagttaataatgtcatttcttcaatgcctcgtctaatgccttcaattgatcgtattgccattcagcgtatgtcttaccggctggcttcgtttctgtcgcttggacaaccggcacaccatgttcctttgcataggtcatcgcttgcttcgccaacttacccgttgactgtgggttgtaaatcacaacagctacttcgccagcatcgattgccgcattccaattgcgaatatcttcaggggttgggtcttggtgttcattgacagccttcgagaatgattgattcaagacattggcgcctaaatcaatcaaggtgttatcaaagacaggctccgtcgccatgacgttcttcccttgcaaatcttgcttaacctgttgttgcatagcgtttaaatccgtcaaggttgccaaatatttatccgcattcttttggaaataagcgcgcttacttggttctaacttactataattcttaacaagctgctttgacaagcgtgtcgccacatccgtcttataccagaagtgctcgttaccggtttcctcttcttcgtgatcatggtcgtgtgactcagcgtcttcatggtcatgatcgtggtcatgttcaccctcaaaatcatataactttgccaagttaattgcctcagcgtctgtattttgcttagcgaaattcacgctccagttatcaaaaccaccaccatttgaaatgatgacattggccttttgataaatcttagcatcagctgaagtcggctcaaattcgtgcggatccatatcaggcttgtccataatgctcgttaccgaaccttggttacccaacaccgctttcgccatttcgccgtaactatctaaactcgcgacaaccttaatcttaccggtttggtcagccttttccgtacggctaatgctcgtgaagataaccataccaatcataccaacaacggcaacggcaggaatcgccaacagccatgggtgcttcttattgttcatgatttcctccatttagtcgatcagcaaccaacgtcaaaaagtgactaatcgttgtttgatcctgttccgtaaagacagcaaaaacactttgatactcagataacgtttcacggtggcgttgcgcgtgggccgtcgccatcgaaatgcctaacgtcgtcaatgaccaacgtgacacacgcccatcatcagggtctggcaccacattgaccattggatcatcaactgtgttgagccccttcatcgccttagtaatcgcggcggccgacacatgcaaggcatgcgcgagttctgtgttggtttgtggtccgttttgggccagcaacatcaacacgtggccttgggtcgtcgtaatgggtgaatttgcatcccccaacaaaatctcacgttgattttcagccaacaagcgtacgtcatttaaaaaatgatccaattgttctgcatactcttcagtcgccataccgtcacctttatcctttaccggttaattaaccagttaagaataacacacgtgacaaaaaattagcaagttttaatataaaaaaagcgccgacttttacgtcagcgcttagcgttactattgattttttgccatatccttcgcaatcaaagctgcatattggacagacccagctgggttagggtgaacatggtcaccaccaagccaatcgccgtggtccttaaccaaatttgcccaatcaacaatgtgcaaattgggatgcttgtctttctgttgctctaggaattggttattggcttgcacccatgaacgatcggcataaccgtttacccagtaaacattacgattaccgataatctgcatgatttggtcaaacacattttgcccaatcgcgccgtttgtcccaatcgaaaccacaacgtttggtgccaaaagccccttattaacatatgactgcaacacagttggcacaacataaggttgacgaccaaccgctgcatcagccactgtatttggcatcaattcttgcaagtcaggcgccacgtcaaccatgaccgaatcaccgaccgctgtcactgacaggtccttaatcgccgcatattctttatccgttaagccatatttttgagccaacggatcagaaccagttgtcgctgtgctgcttgaagaactagacttggccgacttcttgttggccttgttatccttcttagctgcttcaagcgcctttttattggcatccgcgattttgttcttgttgttattcaaacgcttttgcagttctgtcttaggtcgcgcactccctgcttccttagctgaaactgcattcacagttcccaacataaataccgctgcaattccggccataatcttggctgatttgctttggaagaaatgcgccatctttggctcacctggttgcaattctggcttcttgaaacgacggaagacattttccacatagcgataactcacttcggcaattccaagcaccactgcaatcttaatcacattcatcaagaatgaatcattttgatgcgtgaacttgtcaaagaacacaaaaaccggcaactgatacaagtaaatactgtatgaacgcgtcccaagatagttcaacggcttattatcgaggaccttactcaaaaatgaagccggatgcgccgtaattgcaatcaaacccgtcaccatcaaagtgaacacaaacatcaagcccatgtacgttgcttcccactgaccgttcaaccaaaacaagccaaccaacgtaaaggcaaatgaaattgcacccaacacattcaaatttcggttcgcttttggctttaacgtcaatttcatgtgatttgatggccaagcaaaggccaacgcagttcccaacagcaccgcaaacatgcgcgtgtcagaaccatagtaggtacggttaatattcgctggatcgtagaaaatgcccatcaagatagctgatacaaccgctaatcccaatagcgatgctgcaatcgagctacgcttaatcttcaacgccagcactgcaaagaccacaagtggccaaattagataaaactgcccttcaattgacaatgaccacaagtgggtaaacggcgaagcgccaccccatgaatcaaaatatgaatcaccatgcttcgttgcccaaatattgtagacatacgtcatattcgtcaagataattgctcgtaagttatacagcaaatcacgggcgaataaaccaatcatcgtcgctgtcgcaaacagcatcacaaccagcgccgggtacaatcgtttgatacggcgacggtaaaacccaagtaaatcaatgcgcccattgcgatcaaattcttggattaacaagtctgtaatcaaataccccgacaacacaaaaaataacggcacgcctagccaaccaccgactagatgctcaggccacaagtgaaagacaatgacgccgattaccgcaatcgctcgcagaccgtcaaagccagtaatataccgtggcttattactactattttgccccatttattattctcttcctaaagtcccaactaacatttacaaaactaagttctatgataccgttatatgccagtgtgtttcaagtgaagacagctatgtgtaaagaaaaacgtacacagttattaactgtgtacgtcataattttatatttagattaatcaaccactgaggccgtcattgaagcacgcaaaacggcttcaacatcagcaggttgcattggtgcgtaaacaccttgcgtcaaaccaccgtgctcaactgctgctgcagccatcacgtcaagctttgactcatcgatgccaacttcaggcaacgtcatcggaatatccattgattggtaccaagcaatggtcttgcggatggcatccttggcaacagccatgtcatcatccccttgcaagccccaaacgttacgaccgtattgggcaaacttaggtgccgtcttctcgtccaatgcgtattccatccaacgtggcgtcaagatagccaaaccaacaccgtgtgtgatgtcgtagaaggctgacaattcgtgctcaattgggtgaacagtccaaccaactggctttccggcgttttccaaaccgttcaaagccaatgatgatgcccacatcaattcggcacgtgactcgtagttatcaggctcgttgaacgcaataggtccgtgcttgataacaaccttcatcaaggcttcagccaagaagtcttgcaagtcaacgttagctgtacgggcaaagtattgctcaaacaagtggctcaagatgtctgatgaaccagcagccgtttgccactttgatacagtttgcgtctctgctgggtccaagaatgatacttgtggaatcaagttcatgcccgtcgtacccaacttttcattcgtctccatgtttgagataacagcgttacggttcatttctgttcccgttgctgacaacgtcaaaatgtcgaccaatggcaaggccatgtcgatcaatgatgggttcttaacaagatcccaagcatccccatcgtaaggaacactagctgcgataaccttagaagcgtccacaactgatccaccaccaacagccaagataacatcaatcttgttgtcgcgggccaacttaacaccttcacgtactgaatcaatacgtgggtttggctcaacgccagacaattcagtcacttcaaagtcactcaattggttcataacacgctcgtacaaacctgaacgcttgattgatccacccccgtagacaaccaaaacgcgcttaccaaactttgcaagtgcctctggcaattcgctcaaacggtcgcgaccgaaacgaatgtcagttggcacgaagaaacggaagttctccatgaatactcacctctaatttagaatatgtgattagtataacaaagcaaccaaccttagtcaccaatttttaattcaccagtgaggcggattggtgcaccacattttccgcaggcatagcgtaattcattaagtcgccgttgccgataaatttcatggccattcttacacgtataaatccaataatgcttcggttgtttgcgcaccttggccttggatgtcgctggcgcataacgcaaaccggcaatgcgttgtaattcggtttggaaatatcggtctttgtgttggtatggcaaaccttgaatgtgattgtggtagtgcaccaattcatgcttaataaccccaatcaagttctgctcatcaaactcttcaatcattaagggattgatttccaaattatgtgtctgcaacacatagcgaccacctgtcgtgcgcaagcgacggttgaacgtcgccttgtggacaaaaggtcgtccaaaatcagctagcgatacctgttcgaccaatgcttgtagttctgaatcggtcatcgccagcgatctcctcgataattttttggtaccttcgtcggcaacttcaaagcttgccgacgcttggtgtgcttcgttgtaaattggcccagcgtatccgcgctcgcttccgtcaacaattcatctgattgccaaacgcttgcctcaccgtaactttgcgcgaattgcgtctcgtaataacgggcaaagtaattcatcaaggcgatacctgtatcactgacgaccacttgtgtctgacgcacagccagcaaaccactcttcaacaacgtttgtgcgacagcaacgtgctcatcagacaaaccatcgtgatgttcaccttcactaaccagccagtgcttaccgcgtttttcgagttgttgctttagtcccggttgtgaccaccaacggagccacgtatacatttggaacgtgaacggttggaaggcttcaccggcgacaattttacgcacccaatcgcccacttcagaggcttgttccaaaaattgcgtttgaagcacgggcatcttttgccaattaccacctaaacgttgtgcgacacgcagcacttgaaaagctggcttctcgtgcgccacaaaactcacgtatacactggctgaatgacgcgctgattgcacgctcaccaaatcaacatccggttccgtcacgcgggcagcgttttgctgaatgaattgttgccagatacggcggctcgcgacttcttcgtggtcaaggaaaccaattgtcaccttctgatccgcctttgggtgctgatatggctggtagatatctgcacgtgtatccgtcaccgcaacgcgaattgcgaagccggcatcttgattacgcccgagcttcacgcgcggtggccgtattttcttataacttgcgacttttctagccatagcaccctcctaaaattgttctaatagtttgtcagatagattggcatctttgagccagcttgtcaaaaattgctcgcgattgcgcaaatacaacttaccaaactcatcgattaaggcgtggaattcacgggcttcatccggtgtgaagtcagaattcatcatcacaaccttttggaccttttcataggtcagcttttctgggccacccaagaagttcatcaaacggcgcgaataagaatccgcgataaattgtgcccggccaaaaatatagaccaaccaaacgtccgcggtctcattaccaatccccgacaccgcgcggatacgcttacgcaacgttggtgtatcgagcttttgcagttccgttaggtcaaaatcatattccgcgaagaactgcaacgaggcccgcaagtactttgccttgctgcgatacaagccagcctcaaaaattagctgttccagctcttcctgtgacatcgccatcaaagtcgctgggtcaaaattcgtttcgcgcccaaccttttcaataactggatcaactgtcttggcagaagcattttggattaaaatgctcccaacaatcgtttccatccagcgttcagccggccaccaacgttgtggtcccatttgattataaagttgttgatacaacccacgaatatccagcgtcttcatctctcaaatctcacttttccaataataaaaggctagagtttataccctaacctttttacttactatctattatagttcatcatcttcatctgatgttgatgcggtgtacgttgcgcgggccccgtaacgacgttcacgcgttaattcaatgtagaattccgccatcgttgcgttgtagtatggcacaacataaattgctgctaaaccaaacgtcaacgccaccaaaatccaccaaccgataaagctcaattgtagccagaacaagcgcaacttgtagcctgccatcaactcttgtgagcgaagcaagtattcagacaagttcgtgatttcaacaccttgcttgtggtcttctgcgtaaatcaatggggcttgtgagtaaccgaatgacttaacgattcccgggataatcaaaaccaatgtccacaagaatgtaaataggaaacgtagtcctagtagcacaacaacatcaacgattgtgctacgtccccagaactttagtccatcagcaaatggttgctcaggtacttccttgttgcgaccccattcaacgaatgcccacatagcgcccaacccaaagacaccaaaagcaatttcaccaaccatgttggtcgtgaataggcgaaacaaaaattgtagtgattcaccgaacgtcatcgtcgtttgtgcgaacgataccaccggtgcttggttcccatcccatactgatgatagaatctgccaaatgattaagaacattgacaatttaattgaaacattgaaggctggcccttttacccgattacgagcacgtgccttcagatcataattagttagcataaccctttttcctcataaataatcgttttaataccttatagtgtaccatattccggtataccgcttctcagcgcaacaaaaaaggcagcaagcaaacgctcaccgccttcattagctgggatagctggattcgaaccagcgatacacggtaccaaaaaccgatgccttaccacttggccatatcccaatgatttttcaacagaaaatataatacaactgcttacaaaaagtgtcaagcaaaagagcataaagaaatggttttcggtagacatttacttcaaacgcatcttcaccgcgccgaagatgagataaccaaaaaagcacagaatatacgagataacaaaactccctacgagaaacctttcgaccactaagggaatcaccagaagcattagcgtatagacaatgatattttttaccaattgtttcatctcattcgccgccgatcttaaaacaagcaattgtgtacaaaaaaagccggcaagcgtattcgctcaccgacttccatcagctgggatagctggattcgaaccagcgatacacggtaccaaaaaccgatgccttaccacttggccatatcccaatgatttttcaacagaaaatataatacaactgcttacaaaaagtgtcaagcaaaagagcataaagaaatggttttcggtagacatttacttcaaacgcatcttcaccgcgccgaagatgagataaccaaaaaagcacagaatatacgagataacaaaactccctacgagaaacctttcgaccactaagggaatcaccagaagcattagcgtatagacaatgatattttttaccaattgtttcatctcattcgccgccgatcttaaaacaagcaattgtgtacaaaaaaagccggcaagcgtattcgctcaccgacttccatcagctgggatagctggattcgaaccagcgatacacggtaccaaaaaccgatgccttaccacttggccatatcccaatgatgcgatgggggctataggattcgaacctatgaacccgaaggaatggatttacagtccaccgcgtttgaccagacttcgctaaacccccgcaacaacttttatataataccaagtatttcacaccttggcaacccctttttcaaaattagttttgaaacgacaaaaaaggcaacatttccgagtaagaaatgttgcctaatcaatatgtttattattagtcgtgcttacgttcacgcatgaacacagctgcaccgattgcaccgatgaagaccgtaatcgcagccgtcacaccgacagccgccattcccttatcgtacgcgttcaacaccacttgttggaatgcgtgtgcaaatggcgcttgtgatagacgatcactaaacgccaccgcgtgacccgagaatggcccagcttcaaccaatgccttgtgcaaaccagttgcagcagcttcaggcatcttcactgaatccaagtgcgcattcaagtacttttcatagtggttcgtttgcgtcaaaccaagcatgacaacaccgaatgacacaccgaattgacggaagacattcaacaaaccagctgccattcccatttcttgtggcgcaacaccttcaagaccagccgtattcaacattgggttaacgatggcattcgtaatacccatcaaaatcatcgctggtaccaagtcgatgaattcaagcttcgtcgtcatggcatttgccaacaacaagaaaccaattccgccaagcaacaaagcacctgacatcatccacttctttgagtacttgttacccaaaatacccgtaaccggtcccaaaaccagtgaccagattgagataaccaattggcgcaaaccagtttggaaggctgtgtagcccatgtagttttgcatcaagcccgtcaagtaagcgttgatggcataaacaccagctcccaatgtgaaggccacaataacggcacccacaaagttaatgctcttgaacatcttcaagttcatcatcggcgtcttaaccttcaattcaaccaagacgaagataacagccaatacaaatccggcaatcaaccagccggcgatacgcatatcagtccatgcccagtggacattggtttccttttggatcaaaccataaactgctgagaacaaagctgctgcagacaacaacattcccaagaagtcgattgattgacccttaccgtaacttggcgtctccttgacgttaatccaagtcataataaccgccacaattcccactgggacgttgatatagaagattgaaggccaaccaaaggcttcaactagccaaccaccaacaagcggtccagaagccgttgaaagcccaataacagaccctagaattcccaaggctgtaccacgttcgcgaccttcaaagtttgatgcaaccaaggccatcgccaatgacatcaaaccagatcctccgatggcttggacacctcgaccgatatccaagaccaacaatgatgacgccattccgttaatcgctgacgcaattacgaaaacaaacatgctggcaatgaaaatcttcttacgaccaaacatgtcacctagctttgagacaatcaacaacattaccgcgaacacaatcgtgtaagcgttcaagacccattgcaagttattaaatgtcgtcttgaaatcaatcgccatcgttggcaacgccacgttcacaaccgtcacgtccaaaagggccatgaagacacccaaagacatggctgccagcgcgagccacttcttgtatgacttttcttctgtcattttattcaccgttcctattttttcgacaagaactgattatagactcatttacttacttttccaacaagaaaagacgcctaactcataatgagttaggcgtcttctaattaactatttaacacccgccatcagcttcttgatacgtggtactaagaataccaaaacgataccaagaacaactgaagcgattccgaaccaagcaaagtaagcaacttcgttcttagggttgtacaacgttaccaattgggcgttcaatgctgaaccagctgatgaagccaagaaccacattgacatcatttgtgacataaatgccttaggtgccaacttagtcgtaactgacaatccaactggagaaatcaacatttcaccgatgataaccaaggcccatgagccaaccaaccaaagtggtgaaaccttaccggccgttccaaacaacgttccaggcaaagccatcaacaagaatgatgctccggcgaacatcaaaccgattgcgaacttcattggtgatgaaggttggttctttgtccacttaacccacaaccaagcaaagaatggcgtgtaaagcatgatgaacaatgggttcaatgattggaaccatgaagctgggaaccatgacgtatcaacacgttctgcggcgaacgttgccaaaacgattgatccttgctcttcaatagcccagaacaatacagcagccaagaacaatggaatgtatgagataacgcgtgaacgctcttccttgttaaccttagctgacgtaatcatcaacgtgaagtatccgattggcaacaagattgcgacaatcgtcaacaagttaacgaagttttgcaattgcgtccagcccatcaaaaccatcaacacgataaccaaggcaaaggcgacaacacccaaaacaatcttcgttaccaaaggcttaacttcctctggttgcaatggatctggtgcgtacaacgaatcctttgacaagtgcttaccgccaaagtggaattgaatcaaaccgaagaacattccgatggcagccaatgagaatgccaagtggaagccggcttgctcttgcgtccaaccaaccaacaatggagcaataaatgaacccaagttgataccgaagacgaagattgagaatccagcgtctcgcgctgaatcgccgtccttataaagtgatccaaccaatgatgaaacgtttggcttcaacaaaccagttcccattacgatcaagaccattgaggcgaacatcgctggtgcaccgaatggcaacgccaacgcaatgtgtccgaacatgatcaacacaccaccccagaagacagtgcgacgttgacccatcaaacggtcagcgataaatccaccaacaacacctgacaagtaaaccattgaggcgtagatggccatgattgatgcggcagttgccttggtaacattaaggtcgccagtggcaatcaagtgccacatgtagtaaagcaaaatggccttcataccatagtaactgaaacgctcccacatttcggtcataaacaaagtttgtagaccgcgtggttgtcccaggaatttcttttctgattccattgagaaaagctccttacaaattatatatttggtttttagagtactaaaaataacttattcattagaaaatacttattaagtttaccggaatttcttcattatcacaagatgttcaaagaattacaatttactttttccaacaataaacgttgcgaatttggtacaattactgtcataacggcgtcagaaaggcattatcatggtcaagatagcagtcacaagtgataatcacttcgacatcaataagcaagattatcaagaaattcttgcacaacaatcacaatatattaacgaaataaacccagatttctacttaattaccggtgacttattcaacgattttaagaaatcaatgacatatgtgagcgatttacaacaaaacgttggatcaaccaatgttttattcatcgctggcaaccacgacatgggccgtggcacatcatttgaagagcttgaatcaccggttaatgaacattatctacataataagtacatcgatattcctggcacggattggcgcattattggtcacaacggttggtacgattatttgtttgctgaaggtatcgaccctgaggaagtggcaaccttccggcgtggcttctattatgaccgcatcatcgaacaaccaatgtccgacccagaacgcatggatttggggttgcaacaaatgaaggtcctgttagatgatgcgaaagcggccaataagcaagtcatcttcatgacgcacttcgccccaatcggtgacgaattaatttatccagaaggcgatcgtcgttggcgcatggtcaacggtgtgcttggttcaccacgaactggtgaattattggaatcgtatgataatgtgaagcacgttttctacggacacattcacgtgaccgttcctcctcgtgagcgaaacggtgtgacatactataacaccagtgttggttacaaccgtcgtcgcctgcaagaatggacggcggacaactacttggactcatggaaaaacaaagttcaacaaatagtgttgacatctatataaatgttctgtatagtatatattcgttgaggcggtgataaatcgctaaggcgtttatatgatgggggtttagcgaagtctggtcaaacgcggtggactgtaaatccattccttcgggttcataggttcgaatcctatagcccccatttattattgggatatggccaagtggtaaggcatcggtttttggtaccgtgtatcgctggttcgaatccagctatcccagctaaacgaagtcgatgagcgattacgcttgtcggcttttttgttgtctacagaatctaacgaatgattcaaaattcatattagtcctgttttcaatactccggtacaatagtaggcgttctgtaataaggaggcctcatgaaaatcaaatggaccatcattaccctactgtcactgaccgcaattgcagccgccagttactggggtgtcgatgtattcaacgacaacaaaacgtaccaacgtaatatgcaatccgctcgtgaagcggtcgctgcccatgaatggtctgacgcggccgtctactacaaagctgctcgcaaagtacatgtttcaattgaaaaccgcaccgcgcttgagcaactcaattatcttgagcgcgctgataaagaaattcaggccgacaactggccatctgccctcaacctatacagtcgcgttttagaaaccaatgatggcgttgatttgctaaacaaagctgcaaagagtggcgaaacatacgttaatgcccttaagacggccgacgagaagtctgataaagtttctaccttaaaaaaggcacttgccaaaaagacatcggaactggctcaagtacaatcagtcgccagtgattctgtcaaagctgcccaagattcagccaataacgcgatctccgccgctaacagcagtgttgctaagatggccgacagtcaatctgaaaagtccgacactaagacatcaaccgttgatgataaaaacaaaaaagatgataagcatgaaagctcaaaaaactccgaaggataaccttcggagttttttgtttttaaaatgatgctttcattttagctgctgtggcaaccgagtaaatcgcaataaagacgccgatcatgagcataacggctgccccaacactaccgacgaagtgtgatgctgacaccatcaccccggccataatgtttcccaatggacgcgtcgccgcaaaagcacctgaataggcacccaacttttctggattcatcatatccgcacgcaatgtctgacttgatggcacattaatcatttcaccaaccgtgaagacaaccgccgcgaatgccaacggccagaaatcacgcaacaagaatgccattgcaaaaccaagcccttgcataaacgttccaatcgcatagccccgaatcagtggccaacggtttgtcatgtggttaaatgccgacatcgtcaacacaatcacaactgtattaatcaccaacatgaatgacagcatacgttgtccatagaaatgcacgccgaatagtgtgtagtcacggaatgattcagccaagtgcgctgccaaatagaaatcaggttgtgagtaaatcacgacggcaaaaatcgttccaaacatgaacaacaagtaacgcttatcagtcagcacatgcgcgtatgacttaacggcgctccaaacagatgaatttgccttaacgttagccatatcaagcgtttccgccatcccccaattaataatcgaagcattgataatgccgacaatcattgagcccatcaacaactcaaacaagtaatctcggaagaaccaaccaccaatggctgcaccaatcatcacaccgatattgataatccaataaatcaatgcgaagacgaatttacgattcttcatcgttgatgagtcaatcatcatcgcctgttcagccgggtcagcaaacgatgccccgactgacgccgtcaaaaacccaacgaacgtcacatacggattggtgtaccatggtgaattcatcagcattgccaatgcgtatccaccgataatcatcgccgatccaattagcatcgttttcttacgacctagcacatcggccaagtgaccaccgtacaagccagcaataaaaccagcaaccgataccgcaatcaataagaatcccgtgataaacgcgccaaaatattccacataatacacggtcacgttcggcccaattgaacttcccaaaagcacagttaggaaaaccgttaatgatcgcaacttaagattacgatccaacgccatgaagtcttgcatctcgttgcccccctttactatctaaactaatctcactagcataacacaaagaaaccgctgtttatacccaaaacagcggttttattagatttcaattagattgtattacttcacatattcatgcgataccaattggttatcaattagattagttggaatcgtcatttcaactgggccaacatacattggcgcgatatcaccacgttggaaaaccaataccaactgattacgttcgttaatatagaacgtttgcgtcttcgaaatggcttcaaccggcgtattgtacttatctgacgccttaatttgcttgttcacatagtcgcgcaacaccgtttggcaatcagccgacttgaacaacataggcaacgttagcaccaacccgcgttgcttatcaatcgtcgtgtaactcaacttggttgctgtatcggccatcgacatgtcttggcgtcgctcgagcactaacaactggtcgttattcaccttttcttgataagtttgcgtcagcgacttgggtgtatcgtccgtcttattcatgaaggcatcatacaatgcgcgaccttcactagcatacgaagcatttagcttgtcttccaaatccgtattcgccaaatgactcaatagtggcaccttaatatccgcgtatgacgtcttatcaacatgcttatactcacggaacagcaccaccttcactgcatcgcggacaactggcatacgttcagcagcgctcgcaaatgaatatgaggtgttcaccgccaacgtaaacgccgccgccactgcaccaacaccaatcagtgacgtttgccaccaattcaagcgcttgcgcttaggtgccgtcttcacaacggcttgatcgattacggctgacaacttatccattggtacatcttgggcattataggccgtctttacatcttctagtgtcatcttacattcccccgttcaaggctgcttctaactttttcaagctacgataataggtcgttttaaccgtgttttctgataattcaagcgttaatgcaatgtcagcaaacgtttgatcctcaaagaaatgtagccgaataatcgcttgttctttagcgcccaaatccgcaaccgcatcattaagtgccaatcgcatttcaggcgcaagcgttgttaacgctggcataaattcaagtgattcatcgccaatttcgttgcgacgtgcttgcttgcgttgcacatcaatcgcggtgttaatcaaaatgcggaatagccacgttttcaaatagcgtggctcctgcacctgacccacctgacgcaacgctttttcagcagtcgcctgcacaatatctaacgcttcagcctctgtgtgcacataactcagcgctacacggtacaacgcgactttattctcatgtagcgttgcaattaattcttcacgcatgtcgcgtcctcctatctgcttacactaattagacgcacgaactggggaaatagtttcaaaaataaaaaaacacgccgttaagcgtgtttcattttactacttagttgttggaacttccttgattgggttgcgcttacgcatcaactcaagcaacttttcggcttccatcttgtggaagacaacattggctgcatcgcgcatgagttgcaaatccaagtgatcggggtcgaattcaactggcacagggccttgcaaacgagctgccaacgcatccacaaaggcattgtaggccttctttggataatcgccaaccgtaacttgatcgatagccgcacggatttcatcaagtgaaaagacaggcttcatcaaagaaataatcaagatatcggcaatttgcatcgcttggtacttcttcttgattggtgacatgatgaccttttgcttaacgtagttgttaatcatcgttgacgtcaccattggcatgttaagtggtgccaaaacgttattcacatactcaacgacttgatccatgtaaagatcaaatgctggcaaatcctcccagtgtgggaattcaacatcctttaggccttcacgccatgtcatatattcgttcatgttagctcattgtccttccgtggtatactattagatgaattaattttaccacatctagagtgaggaactaaatataatgtttgaatctactaagtcacgcgttgttactgaagaacttgccaagcgtatgcctgaggaagcgcaaactgcagtctggggtatctttgatacgatgatgacctacaaggccatcgttgcaccagttgttgagatttggtttgcggatgactacacggatgaagcggttggtgtcttgttccgtcaacacgacggtgatttccaacaagaaatggaaatgccatattctggtgaccactcatggttgggtaagggattgattgttgagatccgagatgaagataacgttgtaatggacgtctcagaacgtttgttgcaatacgaagctgccgttgctgaagaagaagcaaacacggacgcggagtaaactaaaaatgacctgatgccaaacggcgtcaggtcattttttacttaatcaaacaaatttgaaataacgcgcttggcgtcacggtaccattgaacaagcgttgacgcttgttcgacatcctcgttcataatcaaattaaccttcggaaagccgtcaacaaaatcatttgctgcacggacttccgcctttgaaccaccatcaacaaacaggttttcattgtgatcaacaacgtgaccctttgaaatcggtgcaatcatatcatggtttgaacgaatcgtcatattcaccttggctttgtcccaagccttgggtgcaaagagcgtcactgtcttgttcgttaccagcggataacgacggtgaccatctttggcctcctccaccggcacacgctgcatttgcgtgcccttctttagggtaacaacctgcgtagctgccttcacttggtccagcatcgcggccgtttgcgtaaatgtgtgatcacttccaagcacaacggtaatcacatcgtgattggccaacttcgtcaaaccaataaaggtgctgtgaactgatagcgcgtatcccgtcttcaagcctttgaagtcgtaaccgtggccgtccgtcaataacgaatttgaattctttatcgtttcagtcccagtcgcgccactaggcacaaccgctgacgtcatactcgtaatttcagtgatatttggataatcttcaaccaagtgacggccgacaatcgctaattcacgtgccgacaattcgttttccacgtcatcaccaagatttgggttcttcaatgctcccatatcaccgttagttagaccagcgccactgacaatcgtcgtatcgtcgatgccccaactcgtcaacaagtcttgaatttcctgattgacccccgtcggcgtgcccgaaaccgcataaccaagggctaatgccgcggcattagccgacttaatcagcgccatttccgtcaattcacgcaccgtatacgtacgctcggtactcaacggcacgttggccaacccaggttcagtactaatcgccacaattgacgcaggcactgaaacaggcgtatccattgtcaacttacccgcttcaatcgcccgttctactaagtaaaccgtcaacaatttagaaattgatgcaatcggaatgcgcttgttgccgtttttatccgcgagaacttggccggtttgcacatccacaacagccgctgcctgagcatcaactgttggcgttacgatcgcggcataacttggtgttgcaacaccaaatgccaacaccaccgtcattaacaaacctgttaaccattttctcatcttcacattacgctccttcgtcatcaagtccctctggttgtaatggtagtcgaataataaaacttgtcaaatcatcattcgattcaactcgtactgtaccaccgtgcgcttcaatcacaccatttacgattgcaagccccagaccagtgccaccagtctttgtgttacgtgagctttcaacgcggtaaaagcgatcaaacaagcgcttgattgattcttctggaatcttttcaccattattcgtcacacgaatctcagcaatattttcagatgggaaagttttagctgacaaacgtacaaacgttgccccatccccatacttcaatgcattactaatcaaattcatgaaaacacgcgccaaacgatccggatctccaaccatttcaatgctgttaggattcgtcacggctgacacaaccacgtgtttattcttggcttccaactcatagtttaccgccaattgttgcaacatggccgccaaatcaagcggtgcccagcgcaacttgaaatcaacttggcgaacttgcgtgtaatcaaacaaatcttcaaccagcgacttcatttgtccagccttatcaaaggccgtcgttgcatatttcgtcatgtcagcacgtgataagttgccttgttcgtcattcacaatcaatcccaaataacccaagattgacgtcaacggcgtacgcaaatcgtgcgacacattagttatcatttcatccttagaacgctcaatttcacgttcctcggccattgctttttgtgcggcatcaaacacgccattcacattagtggcgagcgggcgcaaacgacgactcattcgcgtttccgacaaaccagtagcgttagcatcacgcacgcgtggtgccaattcactcacgctatcaatcaggtgcgttaaaacaatctgttcataaaagaaatgaaccaccacaccccagagtgcaatcaccacaatagcgaccacaactgccaacgccgtatcttggcgccagatagcctgaatttcaagcaaccagtttgctgtatgccagtttgaacgcatcgccaataggatgccaatcccagtaaacacaaaaagcagggccgaaacgactgccttgactactaacaacagccaatccagtacactaagtttcatccctacttcctctttctatacgcggtgcttatagcacttcaatcttataaccaacaccccaaacagtttgaacaacttggttaccaccagttgcggcttccaacttatcgcgcaagtgtgaaacgtgcaccataactgtcttagcagacacaactgattcttgttgccaaacgcgttcgaagatatcgtcagcactaaacacacggtttgggtgtgaagccaacaaatacaaaattccgaactccaacgccgtcaaattaacttcaacaccgtcggctgtcttaacttcgtggctgtccttgttaatcgtcaaaggaccgatatcaagtacttctggtgttgcttgcgccataccgttttgggcacgacgtagcaaagcacgcacacgtgccatcacttccaatgggttaaatggcttcgtcacgtagtcgtcggcacccgtaatcaacccttgaatcttgtccattgcaccagacttggctgacaacaacaaaattggtacaggattgtccttacgaacttccttcaacacttccgtaccgttcatttcaggcatcatgatgtccaaaataaccaaaccgatgtctgggttcgtacggatcttcgtcattgcttccttaccatcgctggcaataactggctcgtaaccttcgttcttcacgtagatttcaagcaattcagcaatttcgtgatcatcatcaacaatcaaaattttcatcgattcatcctcactaattctagttgcttacttggtttgtggacgacgtgtgctaccaccgaggaatccaccttggatacccgtcttaacacgccagaagcggaacccgataaaggcgattacggcgaatactaggtacaaccaacctggcaacaatgggttgataacagctggcaagtagctgaagcccaagtatgccaagaaccacaatacaaaggcaccgactgaaatcaaaatcttcaatagtactggtgtctttgaaccgtccttctttggtgccaacgtcattgtaacaacggcgaagaagaatccacccaacaatgatgtcaaaaccaatgaggtaattccggctgcaccggcactaccagtttgtgatgccttgctaaatagcaacgtcaatccaaacataaagctgaacatcatgaagaaggcaatcgcgttatcaaccaacaatggccagaagccgtatgttgcgtagccaggtgctggcgttgcttcagttgcgtttgccttgcgccccaacgcttcagcaggtgtgttaaacaattgacgcgctgtcgtaccagtcttttgaccgtccaacaactttgcgccaacttcagcaatcaaggttgccttgctttcgtcgccttcaacaagttgtaccatttgccaaataaaatcttgattacgcttcgtcaaaccagacgtggccaagtcggcacgtgatggtagcgtaggcgttaccgtttgttcttgtgattctgtcatgagttcccccgattaaacgttgaacaagaattcgatgatatcaccgtcttggacaacatactccttaccttctgaacgacgacgtccagcttccttaaccgccttcattgaaccgtattcgtccaaatcagcaaaggcaaccgtttcggcacggataaatccacgctcaaagtctgagtggataacaccggcaacttgtggtgccttcatacctgcacggaacgtccatgcacgcgtttccttaccaccagaggtaaagaacgtacgcaagtccaacaagtggtaggctgaacgaatcaaacggttcaaacctggttccgtaataccttgcaattccatcaattcagccttgtcttcgtcatccataccggccaattcttcttcggcacgggctgaaattccgataacatcagcgttttcggctgcagcgtattccttgatttgttggaagtactttgatgcttctggatctgccatgtcatcttcagcaacgttagccacgtacaaaactggctttgacgtcaacaagaagaagccacgcacaatcttttgctcatcttcgttccaatcaattgaacgagcaggctttccttcttccaaaactggcttcaacttagcaagcacttcaaattctgcagcagcatccttgtccttagcttgcttagccttcttttccgttgttgcgtaacgcttttcaacggcttccaagtcggccaaaaccaactccaagttgattgtgttgatgtcatcaattgggtcaaccttaccgttaacgtgagtgatgtcatcatcgtcaaaggcacgaaccacgtgcacgatggcgtttacttgacggatgttttcaaggaacttgtttcccaatccttcaccctttgaggcacccttaacgataccggcaatgtcagtaaattcgaaggtcgttggcacgatcttgtcagctggcaccaattcttgaatacgggccaaacgatcatctggcacttcaaccattcccacgtttggttcgatcgtggcaaatgggtagttagccatttcggcacccgccttagtaattgcgttaaacaaagttgacttaccaacgtttggcaaaccaacgattcctgctgtaagagccatttttaaatacctatctctctattaatcttgttctgacgctgaacgcaaaatgcgcttcaaacgcttatcgaaatcatgacgcgtcatcattacttggtgaccacaaccttggcacgtcaacttaatgtcggcaccaatacggttgatttcccattcattcgcaccacacgcatgtggtttcttcatctcaactacatcatgcaagttgtacataaccaacctccagattattcctcgtcaaatgaaatgcccaatacatcaaagatgcggttcaaatcatcatcagacaagtatgcaatttcaattttaccagcacccttacgattacgggtgacgttgaccttcgtcccaaacttatcttccaaagcagctgtcgttgccttcaaataagctgatggttcgtcgttacccttaccagtagtgtcagcttgttcgttcaacttgttaaccaattgttcaagttgacgaaccgtcatgctttcagcaattgcacgcttagcaactggcacaatgcgacgcttgttgcgcaatccgagcaacgtacgcgcttgtcccattgatagttgaccagcttgcaacatatccttcacttcgtcaggcaagttaagcaaacgaaggaagttagccacggctgagcgagccttaccaaggcgcttggccacttgttcttgcgtcaacttcaacgcatccatcatgtcgcgataagcttgcgcctcttcaagtggcgtcaagtcttcgcgttgcaagttttccaaaatagcggcttgcatcatttgttcgtcgtctaacttacgaacaatcgccggtacgtccttcttgcccgccaattgtgaggcacgccaacgacgctcaccggccaacaactcgtattgcgtgttgtccttagggttgtgacgcacaatcactggttgcaacacgccgttttccttgattgatgctgccaaatcttgcaaagcatcttgatcaaagacatgacgtggttggaatgggttcgccacaatcttgtcgattgcaatatcacgaaccgtatcagtcgttgcaatttctgtatcaagaccttgttcagcaaacaaagcgcctagaccgccaccgttgccaccaaggccacccaaacctgacttcttagtgttcgccatgagctgccaagacctcctttgccaagtccatataaacttcggctccctttgactttgaatcatagtcaatgattgccaatccacgtgatggcgcttctgacaaacgcacgttacgtggaataaccgtgtcgtatacatcgctaccgaagtactcacgcacattttgaataacatctgatgacaagttggtacgaggatcaaccatcgtcatcaacacaccctcaacttccaagtctgggttgaagtgttgcttaaccaacttcatgttgttcatcaactgtcccaaaccttcaagggcgtagtattcagcttgcactggaatcaaaattgaatccgctgctgagaacgtgttaatcgtcaccaatccaagtgaaggtggattgtcgattaggatgtagtcgtacttttcgcgaacaccttccaaggcattcttcaagcgcaactcacgcgccattgctggtgccaattcaagttcagcaccggccaagcgaatcgtggctggcacaatgtccatgccctcgtgtgacgttggcataatcacgtcggccaatggcacatcgtgaaccaatacgtcgtacacatcgcgttcaatgcttgacttttgcacgcctgaacctgatgtggcgtttccttgtgcatcagtgtcgatcaacaacactttcttacctagggatgctagggatgcgcccaagttaaccgtcgtggtcgttttaccgacaccacccttttggttagctaatgcaataatgtgtcccattgttttcccctttctacaacggcttgcgcactggatcaccaggcttgcgcggatacttttttggtgtgttctttactttcttaatcacgataaccgaacgtggatcaccatttggtagactcacgtcgatttggtcgccaatctcagcccccaaagttgtgatggccttcttagcttctgccaattcttcatcagcagcgcttcccttcatggccaacaacacgccaccaaccttaacgaatggcaacgtcaactcccccaagacattcaaacgagctaaagcacgggctgtcgcaacatcatattgctcacgagctggcgccgtcttgttaccgaattcttcggcacgagcatgttcaactgttacgccttccaagcccaattcctttaccaaatcacgcaagaagttgatgcgcttgttcaaggcatcaataatcgtgatttgcaattgtggaaatgcaatcttcaatggcaatgatgggaacccagccccagcgccaacgtcaatcatgtgtagctcttctgtctgtaattctggatatgcccaggccaacgtcaaagagtcgtagaagtgcttcaagtacacttcatcacgttcagtaattgccgttaggttcatgtgttcattcaccgcaactaaacgctcgtagtattgctgatattgcgctagttgttgtgcattcaattcaacattatgctcgcgtaatgccgccgcaaattcttcaggattcatcaccattctccaaactgattccaataataaaagaataccgcaaaatgcccgtctaatcaatagttccaaggagttcaagaaaacaaaacaaggtgttatgtttcacgtggaacacaacaccttgtttcattacttaattcgggcaatttctgccataaaccattcgttaaacgctgctacatcaatgtccgtggacactgaaacatttgtttgtccgtcgtgtgacgtgcgcaaaatgtcagcaatcgtcccacccattgcgggaccttcagtcacaacatcaacccaatagtcagttaattcaaagtattctgggtgtgccaaatagaacaatgtgttcacatcgtgcattggctttccctcaatttcatcatctgcataattacccaacaacgcttgcaacattgcgcccgcttcgttgagcgtaccaagctttttgatattttcgtgtgaaagcaatgccttcatcgtcacatcaagtcctaccatcacaattggcaaaccagcttcgaatacaattttggcagcgtgtggatctgtataaatattaaattctgccacactagacatgttaccgcctgaaagtgagccacccatgacaaccaaacggtcaatcttagctttcgtttcagggtacatgcggaacaagtgcgccacgttagtaaacgcacccgtggcaacaagggttagcttttcgtcactggccatcaacgtatcgcgcatcgcctcaaccgcatgttgtgccaatggcttcgtcgtcactggcgcaaaatcccaaccaggcatccctgacgcaccgtgtacgtgagacgcatcctgatagtgcttcaacaaaggcatttgagccccagttgcaaccggcaccttatcttgcacaccgaagaactccaccaacttcaaggcgttaagcgtcgtcttatcagcgctgacgttacccgcaacggtcgtcaaaagttttacatcgaattggtcatcggtcaaagcaattgaaatcgctgcagcgtcgtcaattcctggatccatatccagcaagattttgtgtgtcatgtctatattccccgtgttccatttgtgagtctgtgtattagataataccatacatcacgactgcataatattgcatattaattcaatcgtttccaaattttttcttggatttttggttgtggatcacgcgtcaatgcgtcaaattcacgccacgtacctcgttgtaatggcattgcttcaacttcagccgtcagtacggtcaccgtccatttttggtgcgtgtatacgtgcgtcactggtcgaccagccattttagttaactcagccgctacgccataatctgccagcaaacgtttctcagtagctgcaatcatttcgtcctcagaccactcagcatccggatcggtaacgaagtctgtcaacgcatagagtggcatcgtccaaaaattagcgagcaaaccagtcgtcggacgctgctcccatagatagccagccggtgaatgcacagccaccgcaaaataggtaattggcttaggcttgggcgcctttgacttcaccggatagaaatcttcagtgccatctgcataagcagcattaaattgcttaaccggcgagtgttcagaatcataattcttggcactcatatacgatgaccctaaatccataatcgcttgattaaaatcacctggacgctctgggtcaatcaattgcagacccaagtcaaaaaacaccttacgtgtcttcggctgtgcgatatcggcatcaattttaaacaggcgcgcaaacacgcggaatgcattaccgtcgatagctggcaccggctccttaaaggaaatgctagcgatagccgctgccgtatacggtccgatacccgttagattttcaagttcagccatcgtatccggccagacaccgttgtaatcatcacgtacttgaatcgcggctttttgcatgttgcgaacacgtgaataatagccaagaccttcccaagctttcagcaaatcttgctcaggcgctgctgccaaatcattcaacgttgggaacatggtcataaaccgattgaaatacggaatgacagtttgcacctgcgtttgctgcaacataatttctgatacccagacacggtatgggtcttggttttcgcgccatggcaagtcagctcgacctgcttcgtcgtaccaatcaagcagtgtcgcacggaacgcacgaatcttttcttcgtcccacatgtcaatcatgactcgtcctcaatttcttttttcataatgagtccagtttagcagatttcactaacaaattagcaccttcgttttttgcatttgcttaaatcaatgcttataagcgataatagaagtattaaatctatgaaatggaagttggccacatgactgatacaaacgaactcaagaaaattgccggttatcgcgcagctgaatttgtcgaagacggcatggttgtcggtatcggttctggttctaccatcgcgtacgttatcgaagcccttggcaagcgcgtggcggaagaaggacttaacattgttggcgtcccaacgtcagacaagacgcgtcgtacggcagccaagcttggcattccgatgtacaacgttgatgacgttgaccacattgacctgacaatcgacggagccgacgaaattgaccctgaatttgccgctattaagggtggcggggccgctttgctttgggaaaaaatcgttgccattaactcatcacgcaatatctgggttgttgatgaaggtaagcttgcgccaaagctaacgcactacttgccagttgaagtcatcccttatggatctgaccaacttttcaagcgtttggaagccaagggctacaagccttcatggcgtcttgaccaaaacggcaaccccgttcgtaccgactcagcaaacttcttaattgatttgcacccaactgatattacggatccattcacgcttggtcgtgaattgactagcatggttggcgttgtggaacacgggctatttttgaacatcgttgataaggttgttgtcggtcgcgacaacggcgttgaaattttcgatgctcacccacaacctttgatttaaagaaaatgcaaaagtctcgctaaggcgaggcttttttatttgttttgaatatcaactatgacacaattatcttgggaggtatttgttatggtaactatgtggcaagcatttattaatttttggaaaggctatgtgaacttcacgggccgttcaactcgtgccgaattctggtggatgagactttggtcaactatcatcttctttgtttggcttattttattcgttatcgccttggtaagcgattctagcctaattagtaaggtcgacaagtttagtcagcctaacgtacaaggcattgaaaattggaagctaatgagtgaactactttcagcaccgttcacatttatcgttgtaataattggtatcctattggctttggccatgttcttaccaaatatcgcgctaacgattcgtcgttaccgcgacgctggtacggcaacttgggttgcttggcttgtttggatactttcattgttctcgcacagcgagcgcatttacagcaacggctcaatgcgaattacgattatgattggtggtatttttgcgttaatcggcttcatcctgtccgttttgccaagtgatacgctaactggcacgggctttatcggccgtccaaaagatcaaaaacttgtttttaaagaagattatactgattcatccgatgacgaattgtaattgaaaaggcaaccttatagcacttgctacgaggttgcctttttgtgtgcattatagttcttcgagatccgacatcattgtaaagttacgcatgcgggctgcataatacaagtacatgataattgtaaagatggccgtgatacccagcaagacaccaacctgtggccataccgacccaccaatcataatcgactcacggaaaccatcaaccgtgtatgtcattggcaagtacgggtgtaaccatttgaagaatccgctcgttaattgaattgggtaggttcctgctgaaccactcaattgcaataccaagaagaccaccgccaagaatgctcctggtttgtccaaccagagattcaacgcggtgacaatggcaccgaatgtcagtgatgtcatcacggtcataccatatgtggcccatgggtgaattgggtccagccccaacactgttacggccaagccatacacaatggttgccgccaaaacagaatagaataccaacacactcatcttagaagcgaaccagcctaattcagattcaggcttcttacgtggttcacccattcccatcatcaaattaaacgccagcatccccacgtacaatccaaccgacaacatgtatggcgtcatacccgttccgttgtttttaacgtggtccttttccgtttcaacagccttcactggtgtcgcaacttggttatacaaggcctttgttgcgtggaaaccactcgttgccttgccaacctcacccaacttctcagccaatgttgcgttaccacccttaatctggacaagtccgtcgcctaacgtcttcgatccatccgctaattcagaagacccactacggatttggtccgcccccgaaatcaaagcaggtacgttgttcttaacggttgtcaggccaccactaagttgttgtgatcctgatagcaacgtcgctgaattttgatttaattcacccagccccgccgtcacttgatttgaaccatcagtcaattcagtaatggctgctgatgcctctcgtatttggccaattccgttcgctaagtcattctccgcaatcgtttgaaccttgtcgtgcaattgcgccgctgaatccagcttttcttgtgctttatccaaaactggttgcaactttgcgtcaagattgtcaaaatccgtctgcaacgcacttaatttttgggtcatggctgagtttgattgctgtttttcaatcgcttggagcaccacttgtttttgattatcatccaactcattcaagccattgataagtttcgccaattcttgttggtcattcttttgtgcttccgcaagaatttccttttgcgccttaatttgtgcaacaacttgctttgcatcttctaaatgctctggctttggcatcccggctaacaattcttctgccttcgtttggacgtctgacagtgtcgcttcaacgtcagctaaatcttggttcaccgctgtcgtgcctagcttgtcattaagttgcgacagaccatccgacacctctttgctaccatcgtacgcctggctgacaccactcgtgtacgtcgcaaccccaccagtcaaggtcgtcgcaccgtcagacaattgtgtgacaccttcgtccaatgtttttgttccattttcaaaatccgtcgcgccatcagtcagcgtacccagattcgtggtaatcgtcttattcccatcttccagctctaaagatccatctgataaggctttgttagccttggcggcatcgttaactccggtaccaactttcttaacagccttcaccaactgttttgcataggtctcagtcacttcaccagcaacctgtgccacgataccttcagccgctgtttcagccatctttccggcaataaaactgtgccctgaactaatctcataatgcaacaccattttctttggtttatccgctagcaagcttgtggcattcttcgaaaagtcttttggaatggtaattttcatatagtacttaccatctgaaatgcccttattggcctctttttcattaagaaccgtaaagtccatagcatcagatttcttcaattcactcgccaggtcttttccgacagacaatttctgcttatccactgtatacgccttgtccttattcaccaccacaacaggcaaatcagacactttttgatacggattccatagcgaactcaggaaaacgacagcataaattgatggcaggactagcaagccaatcatgacgacaatatagaatttatgctctttaaaatatccccactctgctttaaacatctagtccctacctttcaatcattctgctgcactttatactccagtagaacaaataaacgttaacaaccaatgccctaatctttaggcatcattgcctaaattcagaatgttttcaaaataaaaaagcgtcatcactgactgtgataacgcttgtttgctctcttacttcaacttttcaagtactgacgttggcacgtctgacttttgtaccccttcaggtccctttacaacacgcttttggctgatgtcagccttcacatatgcatttggtgtcaatggatctgcatcttcaatgctgtagtccaagacacgacgctccccatcagtcgtaatgaacgtcaacttatatgagtatgactttgatccggcaatcttcttaccagcatcatcaactgtgtccttcaactctggtacttgagcaggtacctttgcgtaagctggtgttgccttgtacgtgacgttgtagtattcgtatcccttgtataggccaaacacgaccaacacagctgcaatcaaaccaatgattttcttcatgatttccacctcttaaaatatctcaatcattatccgtatagtacataacctcttatactatttaaagtataatatcagtttctgaataacacaagtagaaagtgccaacaaaaaaacggtatcacatctctgcgataccgtttccacatcagtctcctttattcagttgtcgtaactgattaggtgtctgaccgtataattctttaaacattttcatcgctaacttcgtgttgctagcgccgtgacggataaagatcgtcttaataacctgattcgtcgcgagcacatcttggtagatggcatctagacgaacctgataaacatagttcacaaacgttaccccgactcgtcgtttgaaaacacgactgagataatcgggattgtagtggaacttctccgcgacctcactcaatgaaattttcgttcgatactgctcgtgaatatacataatcacatctttcaaacgatcatcttctgttaagtcgtccggagttaacgtcacagcatagtttgtaatcaagtcgtacaagacttgcatcaatatgctgctaaatcgcaaccggtagccggcttcttttcgcaaatagatttgggtcatttgctgaagcatgctgacaatcttgtcgtacgtctcatcatgcaaactatggttcgtccacaaatcaaatcgtagcaattcactattcgaccaatactggttgagataatacacaggaacttgcaagacgagggcttgatttgccaaattggttgtcgagtggagaatccccgatccaatcacgatgaattcattttcatgcaacgtgacatcatgttgctcatatcgaaacgtcacttcaccggttaggacgagcacaatttcaatatgcgtgtgccaatgcagtggcttaaatccaagcggttcatcggataaaaagacgcgaaccccaacatctgaattatctgcaactatttcgtgctgttgcgctgccttttccatcactgaacccctcaaagtttacgcaccgacccccatcggctcgcgaaatctataagctcagtttatcacattcttaattgacctggggttctgactttccgtcagccttagccgatcttcttccacaatggcaagctcatgaagtcgtagttttcagtcatccagcgaccgttttcagtcacttcaacgacgcgaccatccaagatgtgctcccacttaccagctggcaagtagtaatcaacatccccttcttcagtcataactggtgccaccaaaacatcactaccaagcatgtattgacgatccaacgttgccgtattttggtcctcagggaactccaagtacattggacgcatcaatgggataccagcttcaactgattccttagcttgtccgtagatgtatggcatcatctccaacttcaattgcgtgaacttacgcgttacatcaacggcttcttcgtcgaacaaccaaggcacacggtactcgatgttaccgtggtaacgtgagtgacttgatagcaaaccgaattgcgtccagcgcttgtagattgatgggctcgcattctcttcgaagccaccgatatcgtgactccagaatgtgtaacctgatgacatcaagctcaaaccaccacgaagactgtcagccattgagtggaattggctcaagttgtcaccaccccagtgaactgggtattgttgaccaccgaccgtaccagagcgagcaaagacaaccgcttcgtcttcacccttttcttgttgcaacaactcaaacacagcgtcgttgtaacggtgcgtgtagtagttgtgctcaccttcagggttgccgccgttaaagaatacggcgtcgtgcattggaatacgctcaccgaagtccgtcttgaagcagtcaacacccatgtccaacaagttcttcaacaaaccttggtaccaagcacgggcttctgggttcgtgaagtcaaccacggcgttacctggttgccacaaatcccattgccaaacactgccgtcagtgtgcttgatgaagtaacccttttccttaccaatcttgaagagtggtgacttttgtgagatgtatgggttaatccaaacgcagaccttcaagcccttgtcgtgcaaacgcttcaacaaaccaactggatctgggaattgttccttatcccattccatgtttgaccactcgaagcccttcatccagaagcaatcgaagtggaatactgaaaccggaatatcacgttcgaacataccgtcgatgaaactcataactgtttcttctgagtagtccgtcgtaaatgacgttgatagccacaagccaaatgtccattcaggtggcaaaacagaaccaccagtcaacttgttgtactttgaaatcactgactttggtgaatcacctgcaatcacgtagtattccaatgactcaccgcgtgttgagaagctgacacgatcaaccacttcgctgccgacttcaaaactcgttggttggctttcgttaacgaaaacaccgtagtaaacgccagccttacccgtcatatagaacggaattgacttgtagctttgttctgaaccagtcccaccgtccatgttaatcgtatcaatgctttgaccattcttaacgaaggccccgaaacgctcaccgaatccgtaaacattcgtacctggcaataggctcaattgctcacgcataaagtggtccgttgccgtaactgatccttgtggtcccaagttttgcgcaccagtaaccgtgttggcgtgcatcacttgacccaattgcttgcctgacaaatcatcgattgacgcttgggccttgtattcagaacccgtaatgcgcttacccttgtagttgaaatcaatgttgaacttgtcgtgcattgagacagccaattgcaaatcaccgcttgtcaacgttgcaacagaatctgcgatttcaattgctggcgttacgttgttgttttgcaactcgtatagtggattcttgtcatcgcgatcgaagtgcttcaactcaacaccgataacatcttcggctggtgagaacaccgtcatcgtcgttgcaccgacatccaacatgtcactgcgagagttgatacggtggtaggctgagtaaacacgcaaggcatcacttgcgtagttgtcgtcatccttctctacaaccattgcgtcaaaggcttccaatggtgagttaacaatgtactcatcacggtttagccagtatccattagtaaacttcatgtttttattccccgtttaattatgtttgaaatgcctatctgcttaggcttcagcttctgcaactgcagcagcttcacgttcgtgcttagccgtcaaatctgcgaccatttgtggctcaagcttgtcgatattgttgaacaacaaggcaattgctgaggcagcgtaaccgataaatggaatccagatgaatcccatgcggatagcgtccaatgctgatgcggtctgcgtaccgtcagctgaagcggcgtaaccaccagctgccaaaacggcggccaataccataccaccgattcccatacccaacttggctgagaatgaactaaatgatgtaacgaacccttcggcacgcacaccgttcttccactcaccgaaatcaacggcgtctgacaacataacggcgatcaacgcacccgtcaaaccgtagctgatgaagtacaagacgataccagtcaagataatggcaacgtttccgttcatgatgtccgcaaggtaaagaaccaattgtgacaaagctgtaccaaccattcctagcaacattgtgtttcgcttaccccaacggcgggcaacgaatggcaccattgctgttgaggccaatgtgataaccgttccggccaaaaccaaacttcccaacgcttcgttgtgcaaaacgtacttgaagtagtaaggcaatgaacttgaacgaacggcaaatccaccccagtagataaagttgatgaaaatgatgatgacccatgggtagttacccttcaaggccttcactgattcgcgcattggaattgaacggttagagtcctttgtgaccactcgctcacgagttccggcgaaagcaaccaacaagcaggctgccgtgataacacccaagataacggcccagatgaaccaaccagttgctgatgttgatggatccttagcagccttatcaaagataccagcgataagtccaacggctggcaacgtcaatggcaagaaaatggctgcgcccatgtttccgaagaattgacgaatcgttgacaacgtcacacgttcttgtggatttgaagtcaacgctggcaagattgatgtaaccggaatattgattcctgagtacaaaatctttgcgccgatgtaggcgatgtaaatccaaacgaccttaccagtttctgatagtggtggcgccgtaaaggccatcacacagaagatggcaaatggaattgcgaaccacaaccagtaaggacgtgactttccccacttcgtatgtgttcggtcgatgaattgtccccaaatcaccccatcgattgaatcaataattgctgtaatcgcgaaaagtcctgtaacggctgctgcagcaacacccaatgtgtcagtacagaaaaccaagaagtacgttcctacgatttgaaaaatagtgttacacccaaagtccgacatggcgtatgagacacgttcgccccaccccacttgattcggcatcttttgttccatgacgattaccctccgttgttcatggtgactaccttaagaatatttgtaatgcaaacgctttctgtaaacggtttcattaccacgtgtttgagaatacagggaatgattttaatctacaaggggtctttgcccagaggtcgtatttatccggtcaaaaagtcaaaatcgccacctaatttgcaagtgcaattgtttgacatttacaaaaaaatagccaacccattgcaggttgactatcaccactattaatttgttactggtacacgatctgctgatgcctgcttgtcatacttgttatacatacccgccaaagacatgaaggcaaataggtacaacaagttatcgtagtaacggtaaacaccgtcacgcattggcatgttccagaatagatccacatagtactttgacaactcattgtttggcgttgctaatgttgattgtgccataccagccttcaatgcaactgggtgcttcacgtacaacaagctttgaccatcttcagtctccttgtcgccgacaatcgtgccgtcaatccagtaaactgggatattttcttgttcaatttgacccttgtagaattcttgcaacttaacgacacggtcagtcaattcggcatcaaccttgccagtccacgcagcatccaaaccaacgttcgctgctgtgcggtatgcatctgagaagaatgaaccgtggccacggaagtcatttggcgtaccatcatagttcgcatattcagctgacatccccgtttctgggttcatcgccttcttcaaatattcgcgtgacgcatcggctgcacgctcaaagaacgcacggtcttcttcattaccgtattgcgcgtaaacctcgtagaagtgaggcaagtgatatgacggatctgaaatgtccatttctgcgacgaaacgaatgtacgtcgtctcaggatcgaacatgccacgaccgccttcttcttcatccttgtgcaccatctcgtgcaacaatgacttcgcctcagccgtgtagttaaagatgccttcgccgtcaccccaacggttagcagccatcaacaaagcagccgcaaagaattcttcaccgtccggcgcagaaccttcagcgttagacacacctgaacgttgggctgaccacttgaagaagccgtgcattgggccgtctgtgatcaacatgtacttgttcacccatgcccagaacttgttgaacatcgcttgatcatcaagttgcaaagcaatcatcatcccgtatgacattccctcagtacgcacatcatcgttaccagtatcagtaaagtatgccgtaccatcaccgttgtcgtagtagaactttgtctcttcatttgtaaaaatcgtgtccaatacttgttggaacttttcatcgatttgcgcttgtgtataaccaaagtcagtaaacttactcatttttatttctccgttttcttaattaccaaagctgagtatatggttcgtttatgaccgaaatgtggcctaagcaagaaaagaaagcgctttcataagccctgtaaaaaagcgatgccacctaattcgagtagcatcgccttctactatttaattttttgattctttggtagcgtcatactaaatatcgtaccgtgtggttgattgtccaacacttcaatggtgccacggtgaccttggaccacccacttggcaatcgcaagtcccaatccgtgaccacccgtcgaacgagaacgcgccttatcaacacggtaaaagcgatcgaacaagcgctgtttatcagcatccggcacacccttaccagtatccgaaacttgcaacttaatactgctgtttgtttgggttgcggaaatcgtgacgtcagcaccttcaccagcgtacttttgggcgttatccgtcaagatgaccagcaattgacgcaaacgttgggcatccccgacaatcggcaacgtctcaggcacatcaactcgtagcgtttgacccttttcttcggccgtgaattcgaaaatatcaccaacttcacgggctaccttcgccaagtccatgtcagcaaacgcgaacaacggcacatcagcgtcggcctgtgatagtgtcagtaaatcaccggtcaaattattcaagtgacgcacttcagtcaacgcatttgcgacgttttcgacttgatccatcaccgtatcatttggccgttccaacatgcgctccaagttattttgaataacggtcatcggcgtcttaaattcgtgggccgcgtcagcaacgaacgttcgttgctgcgaccatgcacgcatgattggacgcatgttggcgcgcgtcaacgcaaccgccatcagcaacaatgcaatttcagacaacgcaaaaatccaaaccaaacgattctggaatgaatcaacaatctcatgttctgtcgtaacatcaacgaacgccaattgatcaccctgacgattaaagaaataccaactgccacgatatgacttgaggtataccttattctcacgtttgatattcaatgcatctttaaacgtctcgacataatcggtaatctgtgcactttgaatggttggttcatcatagcgacttgcatgcgagtcaaaggcacgtgccacgcgaccctctgccgtgccatacatcacattcctaaattggccgattgtaaacgtcccaatcaatgagaataccatcgtaaaaccaacgaccatcaagatggtcattttaacttgttgtgacagcgaggcgcggattctctgcagccactttggcagtttaattttggcaaaaaacgcccggacgtgtgcttcaaaccgttcatcccagcgttgtttgttcttttctaccataaaatcaatcttccgttacggctgcgtttagcgtataaccaacattacgcaacgtcttaatcgtgacttgcgcatccgcattacgcaagttcttacgaagatttgacatatacacctcgacaaccgtcaaagatgtatcagaatcaaatccccaaaggcgatcaaaaatttgatccttcgtgacgatttgccccacgtgttgcatcaaataaaccaacaaaccaaactcgcgaccttgcaagttcacttcttggtcattaaccaacacacggtgctgatcaataaagacttgtacatttcctacttcaagagcgccgtcttgaccaagcacacctgtgtgacgcaacaacgtcttcaaacgcgccaacaattcttccttgtagaacggcttggtaatatactcatccgcacccaagttgaaaccttgcatcttatctgctagttcacccttggccgtcaacattagaattggcaagttagggaacatgtctttcgccttcttcaaaatcgtaaagccatcttgacctggcaacataacatccaacacaacagcatcataaacacctgattcaatttcgaaccaaccttcatcaccatcgtgcacttgcgttacttcaccaagttctgagattgtctcacggacggtgtcgttcaacgcaaaatcatcttctactactaataacttaattgtatttcctgccatctcgttaacctcacatattcccaaacggatttcattcatatctctaataatcgtgagcgttggccgctctgatgtcttaaataataggtatcgaaccttaaaatcgacatagcgtagccttgtctgaaccttaaatatttaaggttcaggttcattataactgttttaccccgactaatcgcatcatttggcgcgtaaaaaagcgccatacgaaaaatatggcgctaatccttatttaaattcacgacgtgcttgcacacgggcaacaataattgatgacacaatggccaatgctagcaagccgacaatcacaatcaatgagacggcatttgagatttcaaactcccagccaaacatcttaccaccctcattaatcagcatcttggcgccaataaatgccaagataatcgccaacgcgtatttgatataacggaacattggtaacaactttgacaaggcaaaatacaatgaacgcaatcccaaaatcgcaaagatatttgacgtgacaacgatgaacgtatcttgcgtcactgccaacacagccggaatggaatctactgcaaatagcaagtctgatgcttcgatgaaaattaaggcaaccaagaattttgtcacataatgacggccatcttctttaataatgaagtgaggctctgtgtaatcatccttaatcggcaaaattttacgcaatgtcttaatcaaccggctatcatccaggttctggttggcctctttttcaaagagcattttcaatccggtataaactaagaaagctccgaaaatatacatcaaccagtcgaaacgttgtagcaatgcagccccacctaaaatgaagagcacacgcatcactagcgcaccgaacacaccccagaacaaaacgcggtgttggtactttgcttcaataccaaagaagctaaagaccagaataaagataaagagattatcaacacttaatgattcttcaagcaggtaacccgttacaaaatccagcgcgtggtcactaccggcaaaataccagataccgcccgcaaaaataaatgccaaggctacccacatccctgtcatcatcaatgacttttcgaatgtcggtaccgtattttctttattaaaaatacccagatcaagcgctagcatcacaatcacaaatgcaaaaaacgccacccagatccataaactaacttccataggtgaatcttctttcttgttacgagatattctttatcttactccaattttgtgcaatttgtttgaccaattgagttggaggtgtgtgtccgacctccggtcggagtgacctgccccttctgtagggcgaactgatcaccaactaaaaaacacaaaaaaagacaccaggttcgccgcctggtgtcttccgaccatacatctcaaattgcaatctgcatggccgtccggtagtttcctaccgggctaaatacaattacgtatcgcccttgtttcctatacaagggcgatacgaatcgtttgattgctataatctgacaaaacgtatcaccccctttcctagattgactattattatagaccctcattttagaaattcaagcgcaaaaggtgattactttttgcgacgaataattagcatccccacgaaggccataccacttaatccagcccactttagccaagcattatcaggctgtcgggccgcggtttgtggtaattcaactgccaccttttcaaccaacgttgacgacgtcattccagctaccctattcaaggtcaccgtttcaacatccggtgtttgtagcgcaacaaccggtgccacatttcgatttacgactaacttaggtgtctcagttggaacgtctttcacaggtaattctggttctggattttgtggattaatttgcggttcaactgttggtggcgttggcacatcgacaattgggttttctggcaccgcaactcttggttgtcccggctcatttggttcatccactgtcggctctgacggcacttccggttcatcttctaatggcacggcaggatcctctggttcttcaacatcatcttcgaaactataatctggatcatctactaacgttgccgcataaacataaacgaccgacgttgtctcgttcgccttgccataaaggccagttgcgttgtccgtcacgcgtaacaactggaaatcttctatttctttggctgccgtttcataaggcgtacctgggtttgcaatcttaacctcagtcgcggccaactcatggcccgcttcatcaatgtggaacacacgcaagcgggcttgtcccttaatatcaacaatatccggtgtagtgaccgcacgagtagctttggtcgtgttcaacaattcaccgttcgcattataggttttcaacacactcgtcaccgcattaacagctgtattatcagcaaagtgaatatagaactgatgcccgtgcgaccctgttccttcagatggatttgctccgccagctcgagcgatattttcatctaaagccttcagttccgtcgccgtcaatgtaccgtcggcatcacggttcagcaaaaactcaccaaacgtttcgtcgctaaaattatcaatgccccagtccgcatacgggtttcccatgttgtaagccattgtatatgatccatcggcattcaaatgaatcgtgtatgcaccacgtccaactgtcactaagtcacggacaatctcatcatcagacgtcccttcagcgtattcgatataattctgtgactcaattgattcagtattcatctgtgcaacggtcgccgagataacggttgcttgatacttacccgccgcatttttatcaacaacataataggttgaatacccggcggatgaagaagccgacaataccgttccctgttcaatttgaacgtgttgcaattgaattaaatcttccgttgcaaaagttcccgttgcacgaattttagcggttatagccgcgtcccctcgcaacaaggcattcatatagccgtcatcctgatagtaacttcccacactcacctgatcactcttagtgaataactgctgggtcgcaacaccaggggcatcgacttgaaaacgcgacttaaatgcaaacgaccccgtaaccgttgcatccccgaaaataatttttgccgtgccagttttttcagcccaaattttggcttcaggtagcggcgacgatgttgacccggtgattgttaaatgcgaagacacctcaccaattggcgttgtggtgaaggtgattttcaacgtgcgcccagacacctcgtaacgtgcaaacgtcgcaccatcattttgcaaagcacccgtcgctggcaccaaatcaaacgtttgcttgtgctgatcactcgccgatgtcatctcaccatacaatggtatcgacaacgtgtcacccgtttgatattgcccggtcgtattatcaatcgtcaatccaatcgcatacccattcacaattcgtgcatcaaccaactgtacaaaactgcttcccgctggcaatacttttccatcagcattcaccgcaccattcacggttgtcataacagttttttcaacactcacatcagtagaccattcccagtttttgggatctcgggccccgttttcactacttgcgtcattggccgttcccacaaccatcgtcgacatatgttcagcatcatccgctcgcacatccggcgccatccccaacatcattaacgtcgcgcccgataccaacaagcgcttcttcacaccaaaaactgggcgtttatacggcccaacattatcccccaacataaataagccccttctcatctttcctgtattgtggattaaaactatctcacttattatacgtaagtcaaaaaagaaaagccatataccaaaaaatgagttggtgtataccaatgtcacaccaactcacttagttcttatttaatttctcgcgcctctgccaattggtcacgcaatttatgacgctgaatcttaccgctcgctgtacgaggaaagttatctgtcacaaagaaacgcgccggtaccttatagtgcgccaaacgttcacgaccaaacgtgcggagactgtcaaaatccatcgtttcaccggacttaaatgacaaaaacgctactgggacagcaccccagcgctcatccgggataccaacaactgaaatttgatcaatcgctgtcgcctcgccgtagacgaattcaatttcatctgggaaaacattttcaccacctgatgaaatcatgtccccttcacgaccctcaacatacagaaagccgtcatcatccagccagcccatgtcgccagtatcgaaccagccatcaacaaacgattcggcatatttatcaggtcggttcaagtacccaactgccaaggtcggtgacttaatttgaatacgaccaaccttgtcattgtcagtcgccttttgaatgcgaacttccactgggaacagtggcttaccagctgagcctaatttctgagttgcactggcagcatccaacgcaatgacttgtgaagccgtttcggtcataccgtatgattggacaatttcaatgccggctgcggttgccttttctaacgtcgtcaaatccgtcggaccaccaccaaggagcattgtgcggaaacggtcgtgatattttgcaccctcaggtagttgcgccaataattgcttcaacataactggcaccacagaaatcgtcgtcacttggccagccatcaattcggcattgatttttgcaacatcaaagcgctcgtacaagctgacccccatgccgtaaatcaatgatcgcatcataattgaaagaccactgatgtggaaaatcggcaccgcagccaaccaaacatcatccggcgttaacccaaggttcaaggccgatccaaccgccgaatagaagtggttgccaaaggtttgcataacaccctttggattacccgtcgtacctgacgtatacataattgacgtcaccttatccaagtcgaaatctgcgactggattgatagcctccgcagccgttgccaaaatttcagcaaatgcgacttgcttgaccgctggtagttcacccgtaaagcgatcatcctggataaccgttgtgatttcggcatcatctaattggaatgccatctcacgcggtgacaggcgacggtttagcaagacaaccgttttaccaagttgttgaattgccaaaatcatcaaataacccgttagattattaggggtaatcaaagcaatccgttcattaccatcaatgtgttgcgtgatttggccagcaattgtcaaaacgcgttgtcgcatttcagcaaaagttagcgttgtatcttcaaagcgcaccgccatccgattcggcgtcaacatagcgcgcttcgttagccaattttccattgccatgtcctttcaacacaaagccccacatcagtcattcagcgatgcggggctcgttttttctttttactttatgggaacttagggaattgtgagaagtctggttcgcgcttctctaggaatgcgttctttccttccttaccctcatccgtcgtgtagtacaacatcgtggcatcaccagcgaattgttgcaaaccagccaacccatcagtatcagcgttcatcgctgccttgatgaagcgaatagcagttggtgacttcttcaaaatttcgtttgcccattccattgtggcgtcttcaacttcagccaatggtacaacacggttaatccagttcatgctataagcttcgtcagccgtgtagaacttcgtcaagaaccacacttccttcgcacgcttgtgtccgataacgcgagccaagtaaccagacccataaccggcatcaaatgaaccgaccttaggaccagtttgaccaaacatggcgttatcagcagcaatcgtcaagtcagcaaccaattgcaagatgtttccacccccaacggcccatcccttaaccatcgcaataactggctttggaataatacggatcaagtgttgcaagtccaatacgttcaaacgggcaatgtggtcagggccaacatagccaccgttaccacgaactgattgatcaccaccagatgaaaaggccttgtcaccagcacccgtcaaaataataacgccgattgaggcatcatcacgggcgattgagaaggcatcaatcatttcttgtaccatcacgggcgtaaacgcgttgtgacgagcagggttgttcattgtaaccttcgctacagcatctgaacgctcaaacaaaatttctgagtattccttaatcgctgtccattctacagtcatgttaagtctcactttctgatttcgatattctctatctcaaatatgtgcttagtaaattatagcttttttctactaatttagccaaagacccgttaaacttatatttaacactttaaccatttgtgcgatttcttgttcgctttggttaaatttacaatcatatacaaaataaatacatccatatataggagttttgaaataaaatgaatgcgattgaatatttaaacatttccatcgaaaagatgaccgccgaagaagtcattctaaccatgccaattcgtgatgaaatcaaacagccatacggcattgttcacggtggcatgaacgccttgcttgccgaaacagccggtagcttcggcgccaacatcggactagacaacacaaaacaagtgccagtcggactagacatccacacgcaccatattgctcaagcaaccgaaggtacgttgcgtgccatcgcgacaccaatccacgctggtcgtcaaattcaaacttggcgcatcgacacctacgtcatggaaaccaataaactaacctcgtcatcaacattcactgcgatgattattccagttcgtaagtaggttttccgccgcaaaagacgtataataaccaacaaagaaagagattgcattgtcactatcggtcaaacctaaggagatttgtcatgaaggctttgttgattattgattacacaaatgatttcgttgcaccagaagggccactaactgccggcgagtcagcacaagcacttgcgcctcgtctagtggaactggcagatgaattcctggctaatggcgatgctgtcattttgccaactgatttgcacgtgccgaacgatccttatcaccccgaaacaaaactttatccagcgcacaacgtcgccgacacacctggtcgtgactactatggcgtcttggcggattgggtcgctgaacacaaggatgacgatcacgtttggatttatccaaaaaatcgttacagcagttttgccaacactgatttggataactacctccgctcacgtgacatcaaggatattcacctaactggtgtcgataccgacatctgcattttgcacactgcggttgatgcgtacaacttgaactacaacatcaccgttcacgctgatggcgttgcaagtttcacaccaaccggtcaccgttgggcactttggcatttcaaaaatgtcttaggcgccacagtcacaccggatattgattacaatttggactaacaactaataaagacacgttccgttaggaacgtgtctttattttgttctcccctccccttctatatagaggaaaagagttttttatttaataccgtagtgcgctgcagcggcaccaaaattaaatcgttggtacgtgaccgtcttgaaaccagtatcggtcatcaaattagccaacgccttaaatgacataaattcttctgtcgtcttttcaaggtaatcgtatgaatccttatcgtgagcaaacaccttacccatcattggcattacacccttgaagtacatcttccagaaaggcttgatcactgggttgtccggttgtgatgtttccaaaacaacaagttcaccacccggcttcaacacacggtacaactcttgcatacccttagcagtatcaggtaagttacgcaaaccaaaaccgattgtcaccaaatcaaacgtatcgtcttcatatggcaattccatcgcgttaccttgcgtcaaagttacccagtaactaaccccagcttccacaactttttcgcgtgcgactgccaacatttctggactcaaatcaaaaccagtcacgtggcccttttcgccaagttcctttgctaacgcaattgtccagtcaccagttccagcggcaacgtcgaggatttggccgtttttgggcacatcgattgcagccatcgtctttgtacgccagctacggtgcgttcccaaactaataatgtcgttcatcttgtcgtaatcgtgtgcgaggccatcaaagattccttgcacgcgttgtggcgctttgttcatgtcattaccctcaatcgtagttgttccttacattatacaactattcacaggcagaccccagcccaatccaataccaacatcatgaaaacacctttgatacatcatttgcattatgcaaaaagcctcaatcaagcgcatgaattaaacttgttttaaacggtgtatcaagtaatggttgccacggctcaatcgacacaatcgcagcatcatagtccacaacaacaggtatttcatctcccatcgattgcacccgctgttgggccaagtcatcacagcgcacccaatcataatcacgcaatcgatacaaccattgttctggtggcaacataaacattggtttcaattgaccatgcaaataatcatgcgtactttcaatcatttcaaccggccggccctcccctcgcccacttacagttggcacaacaataacgtgacgaccaacatcaaacacatgaatcccattcccacttgaaaacggacgacaccaaacacgacgaatccaccccatctggataatcgccaccccatattcagcaccatgctgacgaccaaccttcgaccacgcccaatgccaatattcccctcgttgacgtagtgcctcatcaaccaacaaaactggattatctgcccacacatgtgtcacgccgtcacgtggtaacacgccattcccaaagaaaaccggcgcacccgccgaagcatgttgcgtcgcattcaacaaaactaccgtctcaacaccaccatctagcagattttcaacaaacaactgccaatctacgtttccctggcgcaactcccccaaatccacaactaataatcgcatctcaaatcccccttgatccgttaaggccagtttagaggagacaaacgccggtatcaaggcatttaagacacgtcttttatgcaattttgtcattgaaaacatcttgattaacagacctaacaaaaatcgcacgcggagaatcaatccacgtgcgattagtcatatgcctaactattaatactgttaattatcacagcaactattggtctaaaagcctccaacattcccagtcggctttataaatcacccaagcgaccccactttggacgatctgcatcttcagcagcctcctccgcagcttcttccgcctgatcagcgtaatacatttcagctaaataatcttcagccggtgcaggcgcttcagttttaaccggtgcttgagtgccattttcacccgcaagcacgtcgccaagcacctcatacaactttacgatttcatcgtgggtcaacgtcaatcccttccccatcttgctaccgtcaggcgaccacgtacgcaagtcaaacttcggcgtattgtcaccccactgtacaaaattcaattgcatttcccaaccacttttactcgttgagagaacgccaaatttttcaaggacatcatacttcaaatcagccattttcaccctcacttttgcttgtaacgcctgtaacaggcagtttttgtaacgttaattgtattatacaaaatccaggtcgtgtgcgattggtgtttgcatgagtgttttaaccgtctcaagctcacgtgtctgagccagtacccacatcaactttgccacaatcgcttcagtgttcatatcaccggccgtgataccaccagcatcagccacttttttacccacttcgtagaggtaaatatcctgaccctcttccaaaatttgcgtcgtgataatgaccggaatattcgctgcgatcaacttctcgatacctggaattaggttacgtcgctcaaagggcaacccaccatttccaaaactctcgatgatgacaccatgaacatgggtagccaaataatcgaagatatcaaccgtcaatccaggaaaagctttcagcacaaatacatttggatccaatgaaatacttggcgtcaacaccggttcttctggttctggttgatacaacggcaccatattaccctcagacacactggcaatatatgggtagttgatactctcaaatgcgtcataactcttcgacttggtcttcaccgcacgtgtaccagccatcactaggccgttaaagaccaggtagacaccctgcaagtcagtttgactggcaaaggtcagggcatcgtgcagattacgcacagcgtccgtctcaaccatccccaacggcacttgcgacccagttaacacaaccggcttatcaaacccatagaggaggtatgagaggcctgctgccgtatatcccatcgtatctgtaccgtgggtaataataaaggcatcatagttatcatgatgctgttgaatacgtgtcgccaaatccaaccaatcttctggttgcatgttggttgagtccttactcatgacactttcaactgatagattaacacctgggcgtcgctcaaaataaccaatcaacgtttcagcatcaagacctggtgccaaaccgttttctgttttggtcgacgcaattgtgccaccagttgttaatacaaggacgtctttcattgacctaccctcccctacttcacttatttattcactcattatcgcacaggttatcctgtgcgcccaattaattttcacatcagagccatgcaaaaagagcgagtcgcaatcatgcaactcgctcttctatctaacttagattaacccttgttactgtgcttagcaccgtacaagacgtaaacaatcgctccgatgacaacccatccaagtgccaaaatcaacgcatccttgttcaatgagaagaacaatcccaatgatgcaagtgctgagatgattggcaatacaggataccaaggcatcttgtaacctgagtggtcaatatcttcacgcttacgcaacttcaaaataccaactgaagcaacgataaaggcaatcaacgtaccagctgaaaccaagttagccaacataccaactgggaagacagcacccaagataacacccaaaaccgtcaaaacaaccgttgcgttaaatggcaaaccacgtgaatccaactttgcgaatgcttgtggcatcaaaccatctcgaccgaatgagtaaaccaaacgtgatccaccaatcatcaaggcaatcaaacctgagaacattccgaccaaggccacaactgaaagcaagttagctgtgaacaagtgacctgactcacgcaatgcccaagcagcaggctcagcgttgtttgcgtacttcgtgtacttgtacatacccgtcaagacacccgcaacaccaacgaacaagaccgtcgcaatcaacaacgtaccaatgatggcacgtggcatcgtgcgttgcgcatccttaacttcagctgagttagcagcaatcgtatcgaatccgatgtaagcgaagaagacttgcgctgcacccatgaagataccgtggacaccaccaaagttcgtgccaggcacgtgcttaggaacgaatggcaaccagttttgcaattgaattgccgttgcaccaacaacgatgaacaagatgataaccgcaatcttaccgataaccaaccagttttcaatcttggctgcgcccttaacaccacgtgataccaagtgtccgacaaccaacaatgacaaagcaccgaacaagtcgaaccaagtaccattacctgcgttaaacgatgccgttagcgccttaggaagcgcaattccgaatcctgataagaagccttggaagtatgatgaccatgatgctgaaatcagcgccaaggcaatcaagtactcagccaaaacagcccatcctgacaaccaaccaatgaactcaccgtaaataacgtttgcccatgagtagattgatccggcaaatggcatggcagaagcaaattctgaatatgccaacgctgacaaaccagcgataatggcggcaattacgaatgacaagacaaccgcaggacctgcataatcagcggccacgattccaggcattgtaaagataccagctccaacaaccgttccaacacccatagcaatcatctcacgcatgccaaggactggcttcaaatgtccatccttgtcagcgtagttttgcgggtcttcctttcgcgccatgcgcgagaacaaactcttttgttccataaaaactcctcgtttcactactaaaactaataacctaaaacactattattgcactctaaataattaaaaaatgatgtgattattctacatttaaaaccgtttactgtcaacataattaggcaccagaaacgcctaattctcggatatttccgactttttattaaatatttttcataaaaacgtttaaccgtctgagaaattttccgttcctttttagcttgcgaactaaaagtaataatgataaacttctaattattaagtacagaaagggtggtcgtcatcatgatgaacgattttattaacgcaaatcaatttgttggtatgacaaccaccacctcaaccaccatttttgctggttgggatatttaatgtgctgttaacaaacgatattaacagaccgtccaaccagttcgacaccctatcgcggtgcgtgttcggttggacggtctttttgtatacacagaggagaacaggaatatggcagataaaaaaccagaggaagtgcagcttaagcgctccctgacgtcaaatcaaatgcagatgatcgcccttggtggcacaatcggagtcggactctttatgggatcaacttctaccattaagtggaccgggccttcagtattactagcctacgcgttcgtcgggttgcttctttacctggtgatgcgtgccttgggtgagatgattttcatcaacccaacgacgggttcatttgccgattatgcaaccaattacattcaccccttggctggttacctaacaaagtggagtaacgtcttccaatatatcgtggttggtattagtgaagtcattgccgttagtacgtatctgaattattggtggcctaacctacctggttggatttcgggtgtcgtcgtcatcgcgactttgacgctggccaacctcgcttcggccaaagcgtacggtacgatggagttctactttgccatgattaaggtggtgacgattattttgatgattgtcattggtgtaatggtcatcttccttggtctaggtaatcactggcacgcaattggtctttcaaatctttggtcacacggcggtttctttaccggcggtgtaaagggattcatcttctcactctcaattattgttggttcatatcaaggaatcgaagtgcttggtatcaccgctggtgaagcagctgacccacgcaacgccatcgttaagtcagttaagtcagttgtttggcgtatcttgattttctacattggtgccatcttcgttatcgtgacgatttacccttggaaccaattggctgccgtcgggtcaccattcgttgagacgttctcaaaggttggtatcgccggagctgctggaatcattaactttgttgtgttgacggctgccatgtcaggtgccaactctggtatctacagttcaagccgtatgttgtacaagttgtctcgtgacaaggaaacgtcaggcatcttccaaaagttgtcatcacaccaagtcccttacgtttcaatcttgggaatttcaggtggtatcttgcttggtttgattttgaacactgtgctatcaatctacagcaagtctacggctaacatcttcgtacttgtttatagctcaagtgtgttgcctggtatggtgccttggttcgttattttgtggtcagaattgtcattccgccgttcgaacaaagaactgctaaaggatcacccattcaaaatgccgctttatccactatcaaattactttgccatcttcgctttgttgctaatcgttgtcttcatgtttatcaatcctgagacgcgtatctcagttatgattggtgccggattcttgattttgctatcaattttcttcttcgctacgaataagcacaagcaagttgctgaataactaaaaacaacgccttacacacgtaaggcgttgtttttttaatacccgttaaccactgtccaagttaacgtagtctggtagctaccaggcatgaaattattaccgttagcatacagtctcaagccatcatttttctgccaactaatggctgacaacgcttgacctgcgtttgtttggccaatctgtaccccgtcattatccaacgttgtgaaattaccattctcatagtaacgcaacttcgatggtaagacggcattgatattatccgtcatcttgaacggtgcatcttggctaacaaataccttgagcgctgatttgtcacgacgtgtatctttcacatcaacaactgtatttggtgcattcgttgcatctgtgcgatcgaacacctgatccgtattcacaaacggatgcgcaccataatcaatgttcttcggcgtgaatttgagcatattgtcggtgtagtttatcgtcatgctcgttccgtcagtcgtaaacttagtcccgtccgggttattgccggtcacaaatggcagcgtgtcaaaggaaagttgtttaccaccggcatccccaattgtcacatcagcagtaaattcaagacttcccggaccaacaaagttaacgttattaacgagcacgacatccgtggtaccttgatgagttaccgtataatcggtcccagctgtgagcgtcttgtcgcccagcttcacctgattaaataccgtacccgctggcacttcgaagcggtagacaccattcgtcattgatgatgcctcagccgtatttttaatatccgtcacataccgaacttgatcacccggcaaaacactgttaatagttgtgttggctgcattatgatcatccggatacgtcgtattaaacaactgattttgaatggttaacttaaccggatttgcattttcctgcttctgaacatttacaatcgcgtcatttgacaacaaagtcgtcggtgacacgtagtaatttgatccggttgccaaagcggtattacgcaaggcaacatcctcattcaccgtcaccttggtttgaaccgtcttcgttacccgaccatccaccggaacatcaccaaccgatagttgaatgtgtttttgtccatccagcgtcgtaatgccatctggtaaatcatcattgatttcaacattttcccaggtatttccaagtccattcaactttgaattttcaaccacaaattgatactctaacgtatcaccaacttttgcagttgtactatctttaaattcagtctcaccagccgttacattgcgaaccagcttcgttaaattaggttgctgaataacttctgtataagcaacggctccaatcattgattcagctccagttgaaccactgaatccccagtagacattaccattaccaaattgcgatagttttactgtgtggtcacccacattttgaccatcaaacgtcgtattcatcgtcccttgaccagtcgatgtattcggcgtccatgtaataacaacagagtgccatttcgcatcattcatattagccttaaaaggcgaatagtgcttcatatacttcttaccgcctccaaagaagccagtactaccatactcatcagggtggacgtatgcgacgtgacctgaccgcccaagttgattaacaacttgcgaatcactatagtccgcgttgggataggggtcaaattccacacttagggcattgcgaatataaccactgtaagtgctattacgaatcgttccatagacacccagactttcaccgttctgaccaagcgcagttggcccctgaccttgcaaggtgaacgttagtccatcggcatctcctgccatatagatatagaacttggtctgaaagggcttattaatattgacgggatttttataccacatggtttcataggtactttttgtcccgtcagaaatgatttgcatgttgcgatactgatcatcctgtttcggcgtgtaaccattgatataaaaatttccagccacgttcggacctgatgacggtggtgccggcacaacacctgctgccttaacatcgttagactgcgtatccgttagccccggcgctagtcctaccggcacaccaacgaaccccagcaacacagcagccaacatcatcatcgttcgcagccgaccatgtttatgctccatcacggttcctccttttcactaagtaatacccaccaccagcaagaccagtcacgagtagcccgccaccccaataataaggcgtccaattatgcttttcgggtttatccgtcgtgcccggcgatggttttgtattattaaacgctaccgttttttcttgatcatcctttttaaacgtcacagttgctttggtaaacgcatctggacggccatctactggcaaaaaaagcttaaatggcgacttcggcgcgattgtaattggctgcaacgtcttttcagcaactttcttgttgcggttatatagcgtcattgttgcctgaaccccagtcaacaactgcgctgtatcattgtcgaatttaaattcgtaacctcgcttagttgtcgtgaaaacatcagccacattggtgacatcaagaccgcttacagccgtcgtttcagtttcacttgtcgccatcacgatactagtaatgagtgagatattatttttaatatcattctttgatgcctgggctaactctgtcacacgcaaaccgccaattttcaccccgtcaaatggttcttgattcgtttttaaatgaaacgtgatatgtttcgtttcatttggtgcgatggtccccgtttgttttggtttatcagtcaacttacgaataccttgacgcttgtcggtatcacgatatactagttgcccattctgatttgtataggcatcttctatctctgcttgatagcggcgcttttcagtccccgtattcgtgatatcagcttcaacagtatagtcatggtccgcttcatagtgaaaactataaatattcggctttgcctgcgacactgattcgctaatgacaggcgtgacggttaaatcctgacctttcagcgttgtcgccgacacattagtccccagtaacaatcccaataaacagctaaggctcagaatcccccatttcttcatcgctactgtcatttttcttgctttttatcgcgagtcaaataccaggcataacccattgacccaattaaaatcacaaccaacgtcgaaacgccgcccttcatcatggcgctcgtctctggcaattgtgtttgttcaacgatgacagttggtcgattactgtttcttaaatcatcttcagagctttgtgtttgactctgatcagctgttttattttttacaccaacaccggcatctgaatgaccatacgtttctgcatgaatcgtattaactggtgccaccaacagcgctagtgatagcaaccctgacaatagcatccccacttttttacgcatcattcctcctcctttaaaacttaacttgcttgattctgttccgccttctttttacggtgaatgtagtaccaaattgccaaaatcaaaatgatcaaaataacggccaagataatccacttaatccatgggttgtagtgatcattaatcacaactgcatctgcaatatcaacagtaaagtccttctctaacgtccaatggtggccatcagctgtttgtacttcggctttgtagtgatagtctccaggcttaatcgtcttcttgtcccaattattggtaaatttgaaactagaatttggcgccatgctcaacccagtttccgtcgtcttacccatcactttgccatcatctttagtcgtaatcgtggcgttcaccgtcatatcactgataatggctggcttgatattcttgtaaaccgacttcaccttaatatctgtgccaacacgaccggctttaatttcacccaacttcaaatcaggctcagctgttttgtcttcttctttcaaaacaaccgacatcgtgtaagcaaacttattctttacgctcacacctttgtgggttaatggattttcttcagtcgctgactttactaataaaccacctaccacaacaccttcaaacggcttctttggtgtcgtaaacgtaaacggcacttccacaatttcgttagcgggaatcgtgacggtctttttgtgatccgccttgcgaacaatattgcggaacttcaccggtgccgtagtcgttttaggtgcttttacacgatcaatcgacaaaacgcccgaatcagccgtgtatgatgtcgttggctgaatcgttactttttgatcttccttagataaattagcgatcttaagtttgatggtttctttttgaccaggtgttacctttaaattaaaaataccgttctgcgcaatttggttttctggatataccggcgcaatcgctatttctgatgtcccggttgcatgagcggttaccgcactaaacgggaacacaagcaacatcgctaacaccataaataacggcttcaataaacgcttaaacgtcattgtcatgatggttatttttctccctctgtatcagtttcacccctaaataaacaaaaggacccttattcagggtccctaaaaagatgcgaagttttagtttaccgaagcattaggcgttgcgtttagtgtccatgtaataggcgcatcgtattgaccggctggtacgttagcacccatgtccaatgatgccgtgttagccttgttgtagtaaacactcgtgcttccgtaacccgtaccttgtgctgattgcatgacacggtgttgcgtcttgtcacctgaaacaagctttggttggtacaagcttggcatcttacctgacgtgttctcacctgaagtttgcttcaagttgattgcccagtcagaaaggtttgcaacggcagtaccgtcaacgttagcaaagtcacccaacgttgccgtcaattgccaaggcattgtcgtcgttgtcgttgaaccctcttcacctgaagttgacgtacgtgaatccgtaaccttcaaaagtcctgaatcgtttccgtcgtcagaaatcaaaccttggttgttaatcaatggcaagttcttgtttgccgtctttgattgcgccgtcaaaccgaagttcatgtcaggcacagcatccaaagtcaagaatccttcttcaacctttaccgtggcatctgagttacctgatacagatccgtttgcatcgttcttagttgtgcttgtagctgctggcaaagttgaatcagcgtttgcaacaactccagtagttcccactacagctgccaaaacggcagcactagccaaaattgacttgtatgacatagttcctcacctcaaaaatcttatttgtaacttaagtacaagatgatattacctaaattacttacattaagttcgcgccgtttttgccaaaacggaaattttccactaaacaattcataccgttaatcaatatatataggaaaaaggcaatcgtgaacaaatcacaattgccttttcaaattactgcttattcttgtagtaaaggtaaaccggcacgccgacacccacgaagatgaatgaaatcaagaccatcgtaaagcttgagatcaatgtgtttaccaaaatgaacaatgcgcccaagatggcaaccaatgggatgaatgggaatagcggtacgctaaacacttccggatccttttctaaaccagccttcttattacgggcacgcaagatgaaaataccaaagaacgtcgccgtgtagaacaaccagataacaaacacagccatgtctgacaaccagtcagcctttgatgtgaacatcaatgcaccagccaatacagccgtcgtccaaagtgcgccaaccggtgcttgcgccttgttcaacgtgcccaagaacttaggcaacacaccatcatgtgacatggcataaaccattcgagggaatgctagcatcttaccattcaacgttccggccattgagaccaagataccaactgacaacaagcgaccacctaactcaccgaacgctgacttagccacttcgaatgtgacgttgttgcccaacttcacgatttgatcagctggcattgcacggtaaacaccgtatgacacaccaacgtaggcaatcataacaatcaagacaccccaaatgattgaacgtggaatgttacgacgtgggtccttcaactcaccacccaagttcgtcaacgttgcccaaccatcgtacgcaaacaacgttgccaacacagccattccaaagttaccggttgccgttgatgacaattgtgaaaccgtttggcccaacgcatcagccttaccgaagaacaaaccgaacaccatcaacacggcaatcggaatcaacttaatactcgtcgtcgcaacttggaacattgaggcaatgcgattatccaatgagttcatcgccgtcactaataccaacgctgccaaaccaatccatacaacgctgctctctggtaacccaaagaaattcgcaaacaagtaggcaaagtaagctgagattgaggccacaatagctggtgcatagacaacaacctgcgtccagcccgtcaagaagccccaaaacttaccataaagcttttccatgtagatgtagataccacccgtttgcgggatgtgtgccccgatttcagaaatcgtcaacccggctgccaacgttaccacaccaccagcaatccaagcccacaaagcacccgttgtgctaccagcggtctccaaaacttgcccttgcttgaagaaaatacctgatccaataaccgttccgataacgattgaaatacccgtccaaacacccattgagcgtttcaaatgtcgttcattgcctaccataatgtctacctcatctttccttaaagcccctaagtatacaaaaaagccacccaacccctggtatgcctatacagtctgtgtataggggtaccaacatggttgagtggctttgtgaaatacaattattattgcacgtcaaagttactcaaccacaaacgggtggttgagtcagaggacgtcgtcatgatcatagctgtgctaattcgattattcataggtctgccctccttttggcgtttttagtatggttagaactttatcatctaggtatagggtttgtctagccttttctcattttatttacatttttagtttttatagtttttggaatttatataacttgatgtttcgccactggcggttggttgggctggcacgacactaaccacaaaaaaatccatcatccgcaaccaaacgaatgatggattaaagcttatttattaaccggccattgtaaccaagataccacctagcataacaaagatcgcaccgattccaattccgatgatttggcgcttcgtcttgcgctccttcaagatgatgatggctcccatcgttgaaacgatgattcccatttgtgacaacgttgatgccttggcttgtccaactgctggattcaacactgccaaacggatcatcacttcaccagtcccccacatcacaccggcgattccgttcttagccgtttccttcgtcaacaatggcaagctcaagtttccaccgttaaagatgataataccgaagaccaacgcaccgattgtttgtccaatcgcaattggcaatgataatgccattgtgttgtgcaacgtacccgtgtttacgtgaaccaaatcaagaatagcaaccgtcttcggaatcatgaagtaaatcatgtaggcaaagacggagatagctgttagacgaacaccgtctttgttcaagttagatggcttacctgaaatcaagaacacaccaataattactgaggcaatggccaacaaaccaattgtccattggtgtgcgcccgtccattctccaaacacggctgcaccgaccaaggcattcacagcaatttgtccggcagtgttcaaacctgacgcttgtgatacacccatcttcttaaaggcggctagttggaaactcgttccagctgcccaggcaattcctgaaaggacgtacgtcaaccctgccatactaaagacaactgatgtggttggtgcttcaacgtatgcgtacacgccaacaacaattgagaatactagtgatccaagtgcaccacctaaaatttgatttgcgacacggccaccagcccagccgttcacaattcccatcgcaccccacaaaaccgcaggaatcaaagcaaacataattgacatgtaccaattctctctttcaatctcttaatcaatgtaaattactatagcaccgtgcattaaccgcgcgaattaaaaagggaacaaaatagaccaattgtcaaattggcgtataccatttctgacaattggtctagttttattattgaattgcttctgaacctgcatccttaggcagcgtcaaaatctccaacattggtatgatggcgaatacacccaggacaacgaagccccatgagtacgcgccttgcaatgagaaatgcgtttggaacaagtgaataatcaccgtaatcaatgaaatacccaatccttgtcccatactttgcgtaaccgctgttaacgtattggcaccgttacggtcttctggcgcgatttcagtgaattgcaatccgttatatgacgtaaacgccaatgaacggccgacaccagaaatcaaagccaacaacataatccaaacagctggtgacgttggacgaaccaacgccaaagcaaatgaacttaaagctaacatcgagaacgaggcaaccaatgcaccgcggaagcccatcttgcgaataattggattcgtgaatggcttgatcccaatattacccacgaagataaacaacacataccaacctgcacgcgcagccgtccagccaaataccgtttggagcaagaccgtcaaaacatatggcaaactagcaatcgtcacttggaagatggtcccaccagtttggaaaacacggaacgtcggtaccttcatggcatcaactgagaataatggattctcagccttacgcaagtggaagaagacattcacacctaacaagataccaatgactaccagaatcaatccgtaccaaacaactgcaccggtgcgagcgaccatctctgccccagccaacaaagcaaccgatgccaaggccaactcaatgaaaccacgcacgtcaaaggcacgtgcttgcttaacctcatcctttggcaacaaatgcaacccgatcaaaaaggcgataataccgattggcaaattaatcaagaaaatccagtgccaagtgaagtatgtgacgaacataccaccaatcaccggcgccaatgccggtgcgaccaatgatggccacactagataactaatcatacggagtagctgattagctggcgtcttttctagcacaatcaaacgtgccgttggcgtcatcatggcaccagcgattccttgaattacgcgcatcgttaatagcacagcgaagtttggcgctaaagcactacccaaagaactaaccgtaaacagtgccactgccaacaaccaaatgcgcttgttgcccaaacgttgcgcaatccaaccgctcaatggaataaacacggcaactgcaatcatatatgtacttaccaacaaactaattgtggcagcagacacattaaaattctgcgccatttttggcaatgccgtcgtgacgattgtaccgtccatgacatccataaataaactagccgccatcaataaggcaacttttatttctctgctcattttcccacctttgatcctatattttctcaatctgattgttccatgtgaaacaatcggtcggatatctctatcacagcagctgttggtctaaaacctctgacttcagtcaggggcaagaccaaagacgcacctgataagggcgacttggtcacgtcggaggtctaaaacctccgacattcccagtctgctttatgtatatctcccctatatgagagacaaaactacgagaaactatgctacgccttttaattacaccgcgcaagaaatagtgtcatacaacatttttaaaattgattaaacacataatttaacaaatcaccgacaaagcgctacactaataaacgtagacatacacgccgggccaaacacctgacgcgcaattaatgtgcaggaggtaatggaattatgtcacaaaagaataagttgaagaagttgttggaaaagaaggggattgagtcaattaacgttgacggtacaccaacacctgttcaaagtgccaaggagcttgatttgattgaagctgccaaggcaaacggcattatgtaattctgactatgcaaaataggacgcacaaccatttggttgtgcgtcctatttttttaatcgtgcgcgatacgcgcttgtgctgcagcggcaatggctgacacaatatcatcaataaatgtgttcacgcggccaccacggtgttgttcgtcgttcaagcgaccaacaatacctggtttcatacgatcgaggtaaccaaagttcgtccatgaaattgtgccgtacacacccaaaatagacatcacaagttgttcatcaataccatatgttccgtggtcgcggtcgatgcgactttgcaatggttgtggcaattgcttcgcttccgccaaatcatcgatggctagaccagtcataaccgcatcttgcacttcagtcttgtgcaaaacgtgttggactgaatcaatcgcatcatccatcgtcaaatcaggaataatcgcacgttgtccaaacaagactaactctgcaatatccttcaactcaacaccacgcgcattaagcatcgcaacaacatcttcgtaataatcacgttctgtaaataacataataataaatccctctacccgtattgtaacaacaggcgattgtttcacatgaaacaatcgcctgattttaatctttaattaaaaggtaaataccgtcttacctgccaatgaggcttggcgagctgctgcatgtgcttcacgcaatgcttcaactgagaatggcttaatatccccaaccttaaccacaatcttaccagcagccatgtcatccaacaacgctgccaagtttggacgcttaccattttgataagtgtgaaccgcgtcaatatcaaacttgctaattgcgtcttcatcaaaaccagtcaagttacgcaacttaccgccttgcttcaacacctttgctgattgaatggcaacatccccaccaattgtatccaacacagcatcaaagtctgacaagtcattctcataagccgtgtggtagtcaacaggcgttacatcccccaatgactttagatagtcaaagtcagctggcttggccgtcgcatagacaattgcaccacggttcaaggctgcttgaatggcaactgagccaacactaccagcaccaccttgaatcaaaaccttttgaccaggttgcacatccaaatcatccgtaatcatttggtagccagttgccgcaccgacaacagcagcaactgcgtggacatcatcaacaccatctggcaccttagcaactgcagattgaccaaccggaacttcttcggcatacgtttggtggtgacgcgttgcagcaacacgatcgccaaccttaaagtcagttacttcttcaccaactgcgataacttcaccaacaacacttgaaccaggaatcaacggtagcttgtctgcctcacccatcaacccttgtacaaacttcacatcataaggatcaattgcagttgcatgattcttaatcaatacttgcttcttcaaaatcttaggcgtgtcgacttcaacttcctcaagtacatcaacatccccaaattccttaatttgtactgccttcatgatgaaatccctccttggtttgaccaatcttgatttgttgattttattttagcctctttcgtcacgagtgtgcaaaataaaggcattatttttgtcctgaaaacaaaaatgcgtatcgtcacacggacgatacgcattttaatgattgattattagtcttcttcagaacccaaaccaaacttagcaactacggctgccaaagcggcaccaaccaatggacctacgatgtaggcaccgatgttagtcaatgcagctgatgaaccgaagattgcaaggaaggcagcaggtgccaatgaacgagcagggttcaatgatgcaccagttgcttgcaaaccaagcataatcaatgcagccaacgtcaaaccaatgacgaatggtgcaactgatgagatagctgcgttcttcttagcagtaaccatcaagattaccaagacaaagatgaacgtcaagaatgcttcgatcaatgaagctgacaagaatgaaattggtgacgtaaagttcgtttgaccaaatccaacttgcttaatcgttgctgctggagcaccgaaagccttcatgaatcccaaaacaacggctgaacctgcaaaggcaccgatgatttgtgaaacaacgtaacccaagaaatccatccatgagatgcgaccgttaatggcagcagcaaatgaaacagctgggttaaagtgaccacctgagattgaaccaaaggcgtatgctccggctacaacagccaaaccaaaggccaaagcaactggcaatggaccagcttgagttccgacgaagacaacaacgccagttcccatggcaaccaacatcaacgttccgaagaactcggcaagatacttgcgcatgttttccatgataaaaaactcccttaatttacatttgtacgataaccgtacgagattaataatttctgtccctactatataacacaaccagtcttaaattcagctttaaggtttggcattaaaagaattttaagtttaacgaccaataattttgcttgctgcgcggtctagtgcaagccaaacattcatggcatttgccttaaattgctcaatgtagctaggttgttcatcttccggctttgcttcaccttcataggcgttcccaataccgaatacttgtagggcgcggaaatcctcatcccaacgaaccgtaaagtaattaccttccatgcgctcatcgataatgtcttggaaacctagctttagcgcttccttaatcacatcatcttcactaactgggaagccacgcgctgccatcaaagcaacacggtcagccacttgcgtcatatcttctgggattgatccttcattcattatgaatagtccttctttccttcacttactttgtgtcaatctaaacacgctcctaaagacattttagcagtgacttgcgatataataaactgtgaacgtcctaatcgacgtttttgctattatacctattaaattaaggaggttacttttcatggttgaagcagtaaccgcacaagacatgcaacgattcgatcgttacacgattgaagaaattggtgtgccctcattagttttgatggagcgcgccgcaatgtctgtgattgatgttctcgcagctgggtcattcgacttggctaacgtcctcgtcatcgccggtttgggtaacaacggtggtgatggtgtcgctattgctcgtatgttgacccaaaaaggtgtcaacgttgacctacttatcctaggtgacgaacaccgcgcgacggctaacacagctacccaattgaagattgcgcgcggatacggcattgaaacacaaaatcgtgtccgtgatttccgtaattacacggttatcgtcgatgctttgtttggaattggcctttctaagcccgttccaagcaaacttggtgatattattaaacgagtgaatgccgcaaacattccagtggtctcagttgatgtgccatctggcttgcacgcgacaacgggagaaatccttggctctgccattcgtgccacagcaacggtaacctttgcctacccaaagcaagggttgctacaaaacgaaggcttgaagcgtgccggtaacatctacgtgaaggatatcggtatctattcacccgaagaattagcagcatttaagcaggaagagagtgagaactaatgaatattgcattggtcggagctggtcctcgaaacttgacgttggttgagcgcttgatggcgcacgccaagaagacgactgaccccgtagacattacgttatacgacccattcccaatcggaggtcgtgtttggaatccagatcaagatccaacatttttgatgaacactgtgacgcaacaattgacgttgttcacggatccatcagttcctaaccatgcatctactgccctatacggacctaacttctacgagtgggctgtaacttacggtaaggaatatgttaagatgcacaacttcgaaaacgaagcttacttcttggacgagttgacgcgtattaaccctaaccgtttcacttcacgtgccttgtttggtgtgtactcacaatggttctttgaacacttgggtgcccacgtaccagctaacgtgacgttgtcatatgaacgcaagtctgttgcagacgttgtgaagaatggtgacgaatacacggtaactttggatgacaattcatcagttaaggctgatcacgttgttatggctttgggtcacgttgataacgatttggacgacgagcaaaaggttttcgctgccgcagcagatgaaaatgctgacttgttgtacgttgcaccaacgcacccatcagaagctgacttggatgccgttccagctcgcgaaaaggttgttttgcgtggtttgggattgagtttctttgactacatcgccaagttgactatcagccgtggcggtcgcttctctcgtgataacaacggtgttttgtactacttgccatcaggtaaggaaccacacatgattgccggttctcgcaagggattgcctatgcacgcccgcggtgttaaccaaaaggtcgaagctgaaggttaccaaccaaagttctttacgaacgaaaacttggacgccttggctgcaaagtcaaacggtcaagtttcttacgatgaattcttcacgctattgcgtaaggaattggagtacaagcactaccaaaacacgattaacgatttgggtgtgacttggccatttaacgccgaaacgtttatgaacgctttggccgaaagtgacaacttgaatgaaactgcccgtaagtttggtatttccgaagaatacatcatggactgggagcgcattttgaacccagtcaacgatgttcctgcagaagttgaatacagcgacttcatgatgaactacctaacttgggacatcaacgatgcttaccaaggtaacaacgacgcgccatatgccggtgcattcgacatgttgcgtgacgttcgtggtatcatccgtcactacttggacgctggttacttgtcagctgacgagtacgccaagttcctttcaaagttcaacccattcaactcattgatttccgttggacctcctgtcctacgtgttgagcaaatgcgtgctttgattgaagctggcgttttgacgattgctggtcctggcttggccgttactgtccaagatgatcactacctagcaacggataaccgtggtaactcatggactgttaacaaccttgttgaagctcgtttgttctctgtttcattggcaaactcagttaacccattggttgctaacttgcgtgatcgtggcgttttgagcgctgcagagtacacgaaggccgacggatcaacttatgttgttggcggtactcgtatgaacaaggaaacgttggttgttatcgatgaaaacgataacgaagtcgacggcttgtacgtatggggtgtccctactgaaggttggtcatggttcacgacgttcgcacctcgttcaggtgtaaacgacaagaacttgcgtgatgccgaaaacatcgcacaccacatctttggttaataattaaagattaaaagtaatagcaccaactcgcgtaaccatgcgggttggtgctatttttgtgcccaaaacagcgttatatcaagcgttttcacatttgcaaagattttctaaagggtgtatattaggtttatcctaacgttaggataaacctaatatacacaaatagaggtcattctgatggttgatgtctaccaaaaagaaaccgccaggcacgtgatggttatcgactcaaaaagcttttatgctagcgttgaaagcgttgatttagggcttaaccccctcaagtcactcctagttgttatgagccaacaagaaaacacaaatggcggacttgtcttagccgcctcaccccaggctaaaaaagtacttggggtgtccaatgtgatgcgtcagcgcgatgtgccacgtgatcctcgattggcgattgtccaaccccgtatgaattactatattcaaaaaaacaaacaaattaatgacatctatcggaagtttgtcgctgacgaggatttgcacatctattcaatcgacgaatcattactcgacctaactgatagttggcgctatttagagtccaaatatcatcgcaccctgacggattacgaggttgcccgcatcattcagcaagaagttcgtgacgcaaccggtatctatctaaccgtcggcatcggtgacaatccggcgatggctaaaatggcgcttgatttaactgccaagcatgcccctgatttaattggtgaatggcattatgaaaccatccccgatgttttgtggccaatcgaaaaacttgatgacgtttggagcattggctcacgtaccgctaaaaaattacgccgtttaggcattttttcaatgcgcgatttggctgcagctaacccctaccggcttaaagaaaaattcggcgttaaaggcgtcgaactttacgcgcttgcctggggcattgaccgtagtttgattaaacacaaatatcggccaaaagagagttcgtttagtaacgggcaagttcttcctcgggactacgacaatccggtcgaaattgaagtcgtgattcgtgaaattggtgagcaagtcgcgagtcgtttacgtgccaaacacgtggttgccagtcagattagccttggcatcggctttggttatcgcgaaacaaatcaaacccacggctttggagggcaattaacgattgatgcaaccaatcttagtttgccaatcaccaatgccctccgcgacatttttagacaacattacgagggacaagttgtgcgcaacgtttacgtcagtgccggtcgtttagcacccgaaggcgttgaacaaatcgacctttttacccccgttgtgattaatacgcgccgacgaaccatcgataccgtcattgatgatatccgtaaaaaatttggcgttggcgctgtcttcaaaagttccagtgttgctggtggcacaatgcttaatcgtatcggtctggtcggtggtcacaacggaggaaacgcttatggatgatgaacatgatatgttcgaacgggcagcctattttttcagtcatgattatcaagatcgtggcatggttaaatggcaggggtactacctttctgaccacactgaagacgttaaaaagaaggaagccttagaatttgcccgtcaaaatcgtaagcgcatgccagaaatgagcttagctgatatgactgccatcatattcgatgctttcggccgacacgaagaagtagccgtgcaagaaaattattcagatacagatggtgcggtgccaccgattataaccggtttagtcaccggttataccgaatcagacatcattatcggcgacacccgcataccgttagccaatttatggtgggcacaaaaaacgcagtgattcaatcgcgaatcactgcgtttttcattaattaagcttcaaccaattgcttggccaaatagaagcaacctagaataccggcattatcaccatttccgaccgttaccaagtacttgtccaaatcatcaactggtaggtaatctgccagttgttcagcaaatgacttgcgcaccattggcaacaatacttcacggtgtggcaccccaccaccaaatacaatgcgatctggacgcaaaataacagtgtatgtgacagctgcttgcgccaagtagtacgcttcaatttcccaggccaagtgatcatctggcaatgacttagccgactcttgccagcggtcttcaatagctggaccggctgccaatccttccaagcagttatcgccgtggaacgggcagtgaccaacgtaagaatcttgtgggtgcttacgcatcataatatgcccggcttctgggtgagaattaccacttaataactgcccatgttgaataatgcccgctccgacacccgtcccaacggttagataaacaacattttcaacgtctttagctgcacctgatacatattcagaccagccggcaccgttcacatccgtcgtccagtagtacgggatgtcacgccatgccttcattgcaccgagaaaatcatatcccgaccagccacgcttaggtgtgtctaagacgtaaccataggtgcgactatctggattgatatcaatcggaccaaacgccgcaatcccgatagctgcgatgtcatcatagcgatcaaagaaatcgattacttgtgcaatcgtgcccgcaccgtccaacgtcggaaaactttcacgtgcgacaacgacatctggattttcaacctctgctaccgcaaccacaaactttgtaccacctgcttcaatagctcccaaaagtgccataattttaattcccccaatttaaaacacttacaatactgacaactttgaaatcaaaattgccccgataattaccaacaccgttcccaagaaaatatatcccatttggcgggttgttttacgttcaccaagaatgaaaatagcgccgaacgtccctacgataattccagtctgagaaagcgttgttgctgttgcttgccccacttctggatttcctgttgagatgaacataaagacgtttccaagtgcccaaactaatccagtaataatttggcgtgccgtaccaatcttgaaaatgttgcgcgtctccttgaagtaaaaggccacaatcagcaaggcgcctagaatttgtccaatcgactgtggcgcaacaattgccgtcatgtaatccaaaccattattttggttgtggatggcatctgaaatgtaaccccacttattcaacaagttcggcaaaacaaaatacatcataaaggccagcgtagagacgatgaccgccgtcacaccacccttaaaatcacgttctgggttggtttcgaccggtgcattcttatcgcgtaccgtcgtcaaaagtgctccaccggttactaacgcgattgatagcaatccaaagaaccacatgcgacccgtgtgccattcacccagcactgcagctgccatcaaggcatttccaacaatttgaccagatgtcgataacggatttccaatcgacacccctaatttcttaaagccaatcagttgaccaacctgaccaactgcccagattaatcctgagataaatcctaccaaccaaatacgtgaattaaatgcataatccatgccggcatccggaataacaaaaaatgccagtgtaccaaaaccaagcaagatggccccaatcgtcatccccatgattccttgagcagccgttccaccagccttggtggtcacaattcctactgacccccaggctaacgctggtaccaacgcaatcaatatcgacatgtcaataattcctcctaatcaaaaattcctatcaacacgtattacgctactcgtatgaaaacgctttcacaagtttcattttttaacgagtcgtcatttttcagatagatgcgtaaaaaagctgggtgacattgaccattaaatcaatatcatccagcttattaattacatattaattgtttacttttcaaacaattctaaaccttcacgaccaacgtaaatcgcaaatagaattgctgccactgcatcagcccaccataggccaaacaatgccgttaacaccatgccacccaacacaaggccagctagcaccgcacaagtgacgttacacatcgcatcatcacgcaatgcttcagattggatgcgatcaccaatgcgacgcttcatcgtcgtcatgattggcatcaagataactgacataatcgcaataaccaaaccaacgccactttccgctggcatttcatggttaatcaaattcataattgaggtaatcaagacatagcccgatagcaatagtagaattcccttcaccaaacggctagccgtgcgttcaacccgtgccactgtcttggcatctgccccgttatattcagcacgcaagcgccaaattaaaatgccaccagcgactgtttccagaaatgcatcaagaccaaatgcaatcaacaaaattgacccagcgtgaatccccgcagacacgccaagcacaaattcaatcgccatccatgccattgaaatcacttctaattgaatgccccgcgctaataatttctgtcgtacttccatttcattttctccccgttcaatacatgtcatttatttcatatgtttattataacataagtttgagaaaaagtgcacaattcaaaaaaacgaccctggttgttaacccaaggtcgttttttgtttcacgtggaacaaatcgactaattcattcgtgaatgtttcatgccgtacgttaagtacaaaataattcccaatacaaaccacactagcgctgccactaatgtctcaagatgtaattgtgtaatcaagaaaaacgtgaacaacgctgacaaaattggcaataccggatagcctggcatcttgtaaccgtcttggcgcacatccgcacgcttacgcaatggtaagattcccaatgacaccaccataaacgccaacaatgtacccatattcaccaaatcaaccaacttctctagcggtacgaatccaccaaagaacgccacgacaatcgttgcaattcccaacgcacgttcaggctcaccttgcttgctcagcttgcctagtccacctgggagcagaccgtcacgaccaacagcataaatcaatcgtgaagaagcatatagcatcgtcaccatcattgtgaacatcccaatcaacgcaccaattgtgatgattaaggcggcccaatgttgtccaacttgttgcatcgcaaatgctgccggatcagcgacattcaactttgagtaatgcaccattcccgtcaaaactagtgcaactaacccgtacaaaacagcggccacaatcaatgtcccgataattccaattggcatatcacgcttcggatttttcacctcagcagccgtcgctgacaaagcatcaaaccctagaaaggcgaagaacaccatcgacgttccagcgaagacaccttgaataccgaatgcaccatccatgcgcttgggaattaacggggtcaaattatcagctttgataaagaaaaatccgacaataatgaacaatataataataccgatttttaagagcaccatagcattttgaacgcgcttagactcggtcattccccctcgcaacagcagcccaattaacaagacgatcacaactgccacaatattcacgaccgttccttcagccggattataagcacctgacaacgcggttggcaacttgaagaatggcgacatcagattagcaaagtaggctgaccatcctgtcgaaacagctgccacgcccaaggcatattccaaaatcaatgcccagccaagaatccatccaattacctcaccaaagataacattaccgtatgaataagctgatccagctaccggcattgccgaagccgtttcagaatatgccatcgccaccaacccagacacaacagctgcgataataaaactaaaaatcacacctggtccggctgtcgttgcagcaaccgtacccggcaaaataaaaataccagttccaataaccgccccaattcctaatccaattaaatctttagccgttaaagacttcgaaaaatgcgcatcactcttcaaataagtctctaacgattctttacgaaacatccgctttagtaacgacatataaacacacctcttcccaaatgacaaaagccccagtaaataaaaagcacgcatcagataccaattcagtatccgatacgtgctaaatgagtttcatacaaactaattgcttagtcgtctgatgtctcacacactcggatactttaccgtcatccgagtgttcaacgcaaaataactttacgattgattcggatgactaaccgaaaaacgtaaagtagaaaaacgcttgcgttgatgacataactaattgcatgaatttcattccctttgactttgattaacgccgattcactttgaatcaacggcccctttaaatgaccccctaagcatatgatatccctgacaattcgtcaacaacttatcgacactgactttttgtaaccataccgaaacacattgcaagctggatactcgtttttctacaaaaaataagtttataatagaaatcaagtagtttggcgctgaaccaaactgagtctaaaaatgaggtggtttcatgtcgattcgcacgtatcataatgcgcaagtctacgatgttgcgcaagaaaaatttattcctaattcatggttcaccgttgatttgaccagtggtcgtatcacatctaccggtgttggcacagctcctgcggaaggccaagaacttgtcgatcttgaaaataagtttgtaacacctggtatgatcaatacccacgttcacatcatcaacaaggtgttcccatacggtcctaaggcatcgcgtgagccatttgagattgcgatgcaagcccaagctaacttgaacgagatgttggcttctggtgtcacttacacgcgtgtccttgcgacagccaatagctttgacatcggcatccaaaagatgacgttgaatggtcaatggcgcggtactggtgttgtggcatctggtcgtgccttttcaaccattggtggtcacgcttcaaagatcggtgaagcattgactggtccggaagaattccgtgctggtgtgcgtcgtcgcatcgaacaaggtgcccatgccatcaagtacatggcttctggtggtatcgccttcgatcagttcgaacaacctgatatgccacaaatgacggaagccgaaatggccgctggtgttgatgttgcccaccgtcgtggtatcaaggttgccgctcacgctgaagcattgcaaaccgttaaggaagctttgcgcgctggcgtcgattctgttgaacacgcctttgtcattgacgatgaagcgttggacttgttcctttcaactggcacttatttgacaccaactttggttgcaccatacgtcatcatcaagcgtggtgatggtttgttgccacaatggatggttgataaggcttacaagtgggttgattctcacttcgaagctttcggtaaggcagcaaagaacggcgttaatttggcgcttggaaccgatgccggttcaccattgaacggttatgcggatacggctttggaagctgaattgtggtcaattgcaggcgcaacaaaccaacaaattttgcgtgccctattcaccaacgcggctgatttgcttcaaatcagtgacgattatggtgagctagtacctggtaagatggccgacttcgttatgttcgatgccagcccacttgctgatattaaggttttgcaagatccaaagcgcgttgctaagtttggtgaattcgttgatacaaccggattccaaaacccatttattttgccacttgataagggtcacttggcctactaaaatgcagacaaaaagacgagacgaacagattgatgttcatctcgtctttttactttgcccagactttttgcatagccgcaaagactgctagcgttgcgcgtgaatctgccaacgcacggtgcttttgcgtgccaatttcaacttcatattcgtcagctaagccggccaatgaaatatcatttggattaccattcaatgcacggtgaatttgttgtgtatcaaacaccttgccgttggtcttccacttacccaaatcgttgtagcggagaccttccttgattaattggacatccccatcaacaatcgcgtgaccaacaaccggataatcgccgacaaatttcataaaacgtgtcaacgcgcgttcttcagccataccgttttgaatcatttccaacgtaatccagccatcatcaccgcccattgattgtgagatgaacttaaatgatgccatcccgctccccattggcggattgttgacaatcacggaaaacttttcaatatcttgcccggttgtcacctttaaagcaccgatttcgataatttgattactgccgttcatttccaaatcaaaaacgacgtaattttttagttctgtaaaaagcataccctactcccaatcgttaactatgttaacagtataacccctcaagaaaccgaatgcttgcatttattaaagggaggcgtaaagttatcactaacaatacgtaaagaaaaggaacttttttcatgcgctctttagcaaaattcaataagctacgccgcaacttcaacatggaaagccaccgcaagttgcaactcgacgagcatggtgtaaccgatgtttacgacggtgttcaagtaaccgttctagttaaggacgatcaagcaacgatgatttttatcgactctgaagacgccgataacgatgaagctggtcgcgctttcgttgcctttgagcacggtatgagctggtcatcacaagaattctacaacgcctacatggccgttcacgagaatccagatgaaccagctgtcgccacggccaacggtattcaagtgactcacaaaatcgacgctaatggcttgcacatcaagattgtgccagctccttaaaaaaattccgtctcggttgagacggaattttttgtttttattatgacaatggcacaccgttgtattgtgtatcaactgcggccacattgtccattagataatgttcaaccgccaccttgtatggtacttcgttttcataggcaaaagccgttagcttcgtgaattcaggtgaattcatgtgccaaacttgcttcacaccaacttcaagcaagtggttgtgtagtaaaccaacaatcgcctcgaattgacgtaattcgcgtgcgttcgcatcgtaaatgttgtacaagttaaatgaacgattttcgatgttggccaacatcaccaaaccttgggcagcagtacctcgcgtttggccagtcaccttatacattgttggggttggataagcgcgattgcttgggtaagccacagcttgtgcttccaatgcatgcaactttgcgataacttgtccagcaacttcaggtcgaacgcccgtcttcaccaaaatgtttccgaatgacatcataaatgcttgtgtgtgtactgtccctgccataattaacttgcccccttgttaacgtgttctctgttattacaagtctaagtttatgacgcaaggcatagaaaattcaaaaagttcacagaatgaaacaaattagagtcatttttacgcaaaaagcgtcaaccacgcgggttgacgcttatttttagtgcattaataacgtaattaaaccaagcgctaggacgacttggaaaatgattgtcaccaagccatatcctaggaaagttgccccggaagacttgattatggcccacttcaaattcagaccaatgccggccaaattgacaataccaaagaaactcgtgacttcatgtgctgtgccggttagcacatgtggcaaactcacgaatgaattgatgactaccaagacgataaacgtcaccacaaaccatggtactttgacctttgacgtcggcgcgacaccttcaaccggcgtcgctttcgtggcataacgtgacatcaaaatgacaaccgctgacagcaagacaacacgcaacatcttgaagattggtgcatacgtcacaacgtcaccaccgaccaaagaagctgtacctgatacttgtccgaccgactgcaccgttccaccaatcaatgcactgaccaacatgtcgttatggtgcaacaactctggcccgataactggcaaaacaaacagcaagacaacaccggctagcgaaaccgttgccacggccgtgcgacgttgattatcactcgccccaattgctggtgcgactgatgcgatggcacttgatccacagactgcatttccagctcccatcaacatcgctgattgtggtgccaccttaaagacgcgcccaccaatccacatgacaaatagaatcgtcgccgtcatttgtagcaagatgaaaatcacacctgaccagcccaatgtcgccatattattaagcgtcacatttagcccaagcaccgcaattccaatttcaatcgggtacttttcggcccacttcacaccggcattccagcgttcgtgtgcaaacaacgtgtttcccaaaacgattcccatcaacatcgctaacgcctcgccacccagcgaaggcaaatatggtgataacaatttcgccacaatggacaccgccaaagttagcaaaatacctgccaccatattacgtttaattgccataatacttctctccttgaataaactacttttcctagtgtactactattcgactgaagataatggtttattccactgaacgttgcatatgtgtgtaatgatgctcaccaatcatgagctcgctaactggttcaaatccttcgcgttcgtacaacgcacgcgcctttgggttgccatcatccacattaagcccaatgacttgttcaccttgtgcttgcgccacagctggcaaagcagccaataactgtgtcccaacacccttaccacgggctgtctcggacaccgaaatcgaatcaagataccattcttgtcccaccgtttctttgtccgggaacaactccgctaactcgccaaaacggtcagccagaaggcgttgcaaagatacatccaaataaggctcttgcttcgctggataaccaaaggccaccccgacaatagcaccactcatttccgctaccgttgcatgcttatgtgagtaacgtgccgtgtcatcagctaatgcactatcatgtagtaattgttcaatattgtcacgaccaagcttttccaccattggaatttgcatttggtcaataattgtcatttctaaatggacaattgcccctgtatcagcaattgttgctggtcgaattgtaatcataatatctttccccccatcactctagtttaacggctttattcaggtctgcccactagttttttaggaattgtctactttggatatgtaaacgccttgaaaggacccgcaaaaccctttaatattgtaaatgtcccagtttggattgcggaagatcgagccgcataaatgaaaatataaatgtttagagaaaggatttagacatggttaaagcaaagtcagcttactggcaaggcgttgtcgatgaagcacaaaatcaccctaaggttcctggtgttgagaagaccccattcttctcactagcaccaatggaagccgttacggatacggttttccgtcgcgttgtcgagaaggcagctgcgcctgacgtttactacacagagtttacgaacgcccgcagtatttcacaccccaaggctaagtttacggtccaaggtcgtctacacgttgataagagcgaaaagatgcccgtcgtacaaatttggggaaaccgtggtgaagacttcgaaaagtcatcacttgaattgcgcgaccgcggctacaacgccatcgatttgaacatgggttgtccggattcaacggttatcaagaatggaggcggatcagatttgattcgtcactacgattcagcaaaggaagttattggcgcagctaagacagctggtttgccagtgtctgttaagactcgtttgggctttaacgacatcgaaacgttccgtacttggattccattcttgttgcaacaagacattcaagttttgacagttcacttgcgtacgcgtaaggaaatgtcaaaggttccagcccactacgagtacatcgatgaaatcgttaagctgcgtgatgaaatcgcacctgatacgttgttgcaaatcaacggtgatatcaagactcgtgaagaaggtttggaactagttcgtcaacaccctggtgttgacggtgtcatgattggccgtggtgttttcgaaaacccatttgcctttgaaatcatgcctactgaacacactttggatgaaacgttggctttgttgcgtttgcaacttgacctatacgatgagttcacggctgagttcggtccaatgcacttccaaaagttgaagcgcttcttcaagatttatgttcgtggctttgcctacgcctcagatttgcgtgtggctttgatggacacgaacacaactgacgaagttcgtgcacttttggacgaattcgataagcaatgggaagccaagaaggctgaagatgctgtcgcaatcgaagcaaagtaaataatcataaaagcccgcacgcgtgcgggcttttattgtaagaccagaaaactagaggtgctgccatgacagaactacaaaccggtgatttactttttgtcggatcaacgaccgagcaattttcacaaatgattgcccaaagtactcaaccgaaagcccaaacaatcaattacacccacgtcggtatcgttgaattagcagatgacggcgtatttgtgttacacgcttcccctgaacttggctccgttcggcaacccctaaattcatttctggctgcgcaaaccggtaatgtcgatttgtatcgtttgaaaacatcatttgatttcaattcggtcattttcaaagccaaaacccttttagggcaaccctataactggtctttcattgccagtgaaccaggtttttactgctctgaatttattgaaacagctttttctgtagtcaaaaatccgttcaaaaaaatcgccatgacctttgggcctgacgattcaatcttgccagaatggcaaacttattatgcaaagttgggattgccggtgccaaatggcgagccgggcacaaaccccaacgcattaattagcaatcaacttgaacgggttgtccgcttacgataatgcttagcaacttgccgcttggccaaagccggacgacgttttgcaggcaccccttttgcagccagcggtacagccgctggctgtttttcttcgggatcaaagaggatgctaaaccaggctattaaaatctgaccaacaaccataatggtcccaaccaaatttagatagaccatcaaaaccaatagcgatcctaatgactggtagaagcccacgctcttaaccgcaaattgcgcataccagctaaatccagcgttcagcaataccaagatgacgacttcgatgccggaaccaagtagcgttgccttccatggtaaacgcttagctggcaaagcaacgttaaatacacacatcaacaaccacaatccgatcaaggcaaacaatcgactttgcttagctaactcatccaaccaaggcaagtcaccaggaattgcttggataatcgccggcataattgctgtcgctgccataacaattcctgccgtaatcaagataaccatcaaccacagaaaactaaacacacgcgtcagcatgccactcacgcgttccggcacatcgtgcacaccattaaacgcttttcgaatgactgccaataccgcactagctccccaaatagttgtcacaattgagaatgacaaaattccaacaccaccactcagtaccgacttaataatcggtgccaaaatagacatgatgttagcaggcagattggttttcaacgtggcaattaactccgttgacgagatgccaaccagaccggcaatcgcaccaatactcattaacactggtactaacgacaacaacgtgtaatacgtaatggttggaccaaccatatttaagttagcgcgactaataaatgtttgtaggtccgcaaagcgaaattgtttacgaaatttttcgatatctacttttaacccacgcatcccccttatctccttcgcttttcttacagtatcgcagttatcgcgtcgccgggtcaaaacatttgcttgattggcaaacaaaaacgagcgaatgttccacatgaaacattcgctcgttttaattttgtggtcgattgtctttgatgtaattccaaaaactaaccaccgctgatagcaaatcaactgctggcaaaatggcaataaaaatccatttcatcgttgggtcagttggtcggaaaatcaaaaaccaaaccgtatcaataattaattgtacaaataattgttgtggtgtcgccctaaaaaacgacttaccaaacgcaccaaacatggttgccccctaaatcagagccacttctccaagaaggcaatcttctcatcggtgaactctggcgtcatgtatgacgcaggtccgtgtccagttccctcaaccaaatgcaacactgccttttcttcaggaacatactgacgagccgcgtcaatcatattaactgtctgttgataaggtaccacagcatcggccgttcctgcaaatgccaaaataggtggcatttgatcattaaagtacatttctgggttgtagttcttaacgcgttgtgggacatccttaggcgcttgcttgttaaacatttgaccttcgaatgattccgctgtacctgtttcagcgtactttggcgtcacaccactctcttcaaattgtgaaacaaattgatcaaaagcgtatggtccatacatcgcgataatcgcatttactgtttccggttgattgttattgtcacccataaatggattttgcaacgcatcaactgacgctgatacaccagtcatcacagccaagtgtgcccctgaagactcacccatcaaagcaacgcgatccatatccaattgatactcatcagcgtgagcacgcaagaaacgtagtgcagccttaatctcgtaaatttggaatgggaaatccttttgatgaatcaatgagtaatccacgctcacgacagcatagcccttatccaacatacgcaaagctggttctagcttgtgtgaactcttatcaccaaagatcaagccaccaccgtagatatcgacgatgactgggaaaggtccttgaccgtcgtttggtaggtaaatatccatgctgtgacggtcaccatccatgtaggccacatcgtgccattgttgcttaatgtagtcggtttcggctgggaccttttgatagtctcgctcaataaacttttctgccatgtgtttcgctcactttcctagacaaataaaaaaggtgaatgcatatctgcatccacctttatcatacactattttattctttaactcggcgactaagggcaatcatgatgataaaccagataatagccaagaccgttgttggcatcgttgacttcgtaaatagcaaaatcaagaagatacctgctaggaaagccatcgttaggtaatccgtaaatggcgctccaggcatcttgaagtgttgttcaccgttcttgaagtcatctgattgacggtaacgcaagtgcgcaaacacaagcacgccatagataaccacgaaagcggccgaggcaaccgatgtcaccaaatcaaacgcgttcgatgggaacaaaacattcacaacagctgccaaagcaatcaaaatcgttgaaatgttgatggcgttacgtggaatgtaacgacggttcaacttaccagcgtagccctttccattagacaatgagaaaagcatacgaccagttgtaaataatgaactattcaatgatgatgcagcggcagtcaacacaacgaagttaataattccagccgcagctgaaataccaattccggcaaacacttgcacgaatggtgattcgtttgcattgtaattcgtccatggttgaatactcatgatggcaatcaatgcaccaacatagaagatcaaaattcggataataattgaattaattgacttcggaatcgtcttcaatggatcttttgtttcagcagccgtcataccgacgaactcaattcccaaaaaggcgaagaagaccatttggaacgctgccaaaatttgatgtccttggtgtgccaccacgccgtgttgccataggtttgataggctcgttaccccggctgacgtcttcgtgtgcatcacaatcataataattccagtcacaatcattgccaagatagcaacgatcttaatcattgagaaccagaattccgtttcaccaaaggcagaaacggcaatgatgttgattccgtaaagggctgccaagaaaatgatttcccaaatccacactggaactgatgggaaccagaacttcatatatgttccaacggccgtcaattcagccatcgcaatcgtaatccagccaatccagtacgtccaaccgatgacgaagcctgcctttttgcctaggtacttctcaacgaatccgacaaaagttggcttatcaggatcagtaagcaacaattctcccaatgcgcgcatcatccagaacatgaacaatccagtgatgatgtagattagcagaatagctggccctgctgtactaattgagtgaccagcacccaaaaacagtccagttccgattgttccaccaagcgcaatcatctcgacgtggcgacttgatagtccacgctctagcttctgattagaagcttcttgctgtgccatagttaacactctctttctgactttttatttaattttcttttccaataacgctgtcgcaaagttgcaacactctttctagtatataagaattcactcatttttcaagatttcgccgacttacggcaactaatatttcttttttcgcaaacaaaaacggctaggttcaatcgagcctagccgttaattgattttagtaatttggacctgggaaatcgtccggcgtcatgtcgttcaaacgcttcaataagcgacgcaagatacccttctcagtcatagctgcccacataccttccaagcgacgctcaccgtaaatgacaacagatgtcacagcgcgcaagtcgcggaagtctgagctagtacgtgaaatttcatccacttcttcttcaggcaactcttggtgtcccttttgcttcaacgtacgatcgaagttgcgatcaaagtaatctgaccactcaaaagccttagcaagctcaatcatgcgttcgtcgtattgtgggtgtccatctgcgacagcccccattacccaaggaatttccttgccttcaatttctgccaaaaaggcgtcccacttcttaaaatcaaaagggtgttcttttgccattagttgcctccttcattttgacgagagagcccaatgtttcgaccgtcctctcgatatcacgaaagctattgtaacactttacttccttttagtcagtaaattaggccggtaagatttctgggaacaattccgtcaggtccttggactcgtgcaaaacttcgacatggtcaccgactgatagcgtcacagtatcgcgggtacgctctttaacacgtacacctaactcatacgcctgcttaatgacactagctaattcaccacgaccaaacaaatcctcaaactgttcgtcatgtttcacgtggaacaaatcaccacgttcatttcccaccttcgtcgcccacgcttgtagctcatctggcgttttagccagcgccacaattttagcagctggcgtcttgcttggcgttaggatgcgttctgcaatcagtgatagtccatcgttaaagcgcataccaaaatgatcggcaagctttgacacttcacccattaaggccattgcctctttttgattaggcaatttatccgtcggtgactgcattgcgatttcatttgctaactcatcggcgtgcgccaaatcatctgctgaatagacctcatcttgaagtaacaagtaaataattaccaagtgaatgatgttcagcgcattttcagaaatacccgctgggtcaaaggggtcagcatccaaaatacgcaattctaagtaatgaaccccttctgtaaccatcgcttcttttgtctccggccccttaaatcgaaccgtgccatagaattcatggtttgaatataaatcccccgcctggatatgctgatcgatttggtccaaatgatctgccaaatttgtcgcataattaatctggatgtttgcatcatttgcaaatccaaattgactcgttcgtagcgaacgtactgggtgctcaagttcaggcaaacgtgaatcagttgaattcaaactaaatggcgttgccccaaacaagtacacaaacaaccaccgattagctgaaatggcttgtgccaacttgaaatacacgcgattcttatacgtcacatagtcagtttcatcgctaagcgcaaacaacttttcaagcaacgattctggcaatgaataatttaaatgaagtccggtgataatttcgtgggttgacccatatttatccgttaaccaatcgcgatattcactaatccatggtcgatcaaacgtttcatcgacccactgcaaatcgtcaggcgtcaaacgtggtggcatactcaatggccaaatcgtttcgttttcggccatgtgatcacgcaaaacccattgtaattgcaacaacaagtcgcgtgccatctcaaatgacgtagctggctcagtaacaatttctgattgcgtttcactataatccgtctgtaaataggggtgcgtggcccgtggacctaatgtatccggatacacacgacggctcaagcgtccctcttccgtaacgcgatgctcttcaatttcgatgccgaaacgaccacccagcaattcgtgatataaatcattttcagcaactagcttgccgatttccaactggttttctgccatatttctcatctacccttctgcggtatttaagaattattataaatgaatgagacgactttaacagcgaaatcttttttgaccctttttatttgtccacttttataaaagcgactattataaggcttgaaaaaacagactggagtatgcacatgaagattggaattatcggggcaaccggaatggccggttctgcctttgttatcgaaggttaccaacgtaggcaccaagttactgcaatcacacgttcagccggcaaggtgacgcgtatgtttggtaatgaaatcccttctttcgaacgtcaaaacttcgaattgacgcgcgaagacctaacacaatttgatgttatcatcgtcgcttcgaacttcactcgcgctagtgatcacgttcgtttcgccgaatatctacacgaccaattggctggcactgacgcccctatcgtcgtcttcattgttggttcttcaactttgcaaatgcctgatggctcagtaatggctgatcgtctaggtttgatgcgtggacaagcaccttggattgaagcagcaatcgagcaagctaacgaatacaagtacttgcaaacggttgatgatttcgcctggatggcaatttcaccacaacaagcctttatgccaggtcctgcaacgccaacatacttgaagtcagacgacgctttgatcttcaacgcacgtgaggaatcacgtgttacgactggtacgttggccaaggctttgtatgatgagttggaagctcctactcacattcacggtcgtttcacggcagctgacaagttctaacaaaaacattaccgtgtctatttaaaacatatacaatccaatccaaaaaatacggtaattaaaaagctggcaatcatgaagattgccagcttttttgtactatttaaaacttaccgttgtcgttagcccacttgtctcgggccggaatttcttcaataatgtcccagtgttccgcaatcttgccgtcagcaacacggaatagatcgtagaatgtcactgccttaccggcaaattcaccatcccccatcaccaagacaaagtttccttggcccaaaaccttgaataccttgtcataaaccatggcaacgccttgttcagccatcgctgcaaaggccgtcgtaagtcccgtcaaaccatcagcaatatctgtattgtgttggatgtagtcctcaccagcaatgtattctgggagcttttctgggttttcaccacgcaaaacgtcgcgaacgaagtctgataccaattgcttgttttcgtcagtcttgtccaagtccgtcacggctgtttcaccatcgaattgcgtgtgacctgatgggtttggtgccaccacgttggccacgttatcccagtgttccgcaatcttgtcaccttcaaaacggaaaacatcaaaggcaacttgatcacccgaaccggcgaagttcaccacgttttgcaaaacaacaaagtcgccatcttcaaatgaacgaaccgtttccaacgtggtcttcacaggtgcttcttgcaagcccttaaccgcgccaataaacgcatctcggccatccccaaagttcaaattgtgttgcttgtaggtaggcaacgcgcttgcctcagcaaccgcgatatcacctgaaacaaatgtaccaaccaatgcttttgcaatatctgtatgggtcatagttttgtacctccaagtactttttcaaaatcgttcttgtctatgcctataatatagcgcacgtggataaattgcataagtaggcactttaaagtggcatagtttccctaaagaaactattgtgtgatacattagcttcacagaaaaaaacaaggagacacccgatgacgtttagtatcgacatgacaccagaaattgctgagaaactcgtaacccttaacgaactgcatcgcaatcgttggcgtccagacatcgttaacctcttattagaggacgggacgctccgctttggcgaattgcaaaagaagctgggcatcacgcaaaaagtgctgactagcaatttgaaatggctggaagaaaacaaaattgtaactcgcaaggtttatcccgaggtgccaccccgtgttgaatattcattgactgacgttgggcaacagctgcaagacgttcacgaagcaatgcgggtttgggctgactactacgtaactcacgttaaatagaaaaatggcgctacttcttgcgaggtagcgccattttttaggcttctgttcgttgttgtttttcgatttgccatagttgccaagcgtaaacgataaccgttcgcacaaccgcatagaatggcacggccaaaatcataccagcaataccggcaatatttcctgctgccaacaacaagataatgatcgtcaacgggtgaatgtttagcgatgctcccataatacgtggatagattaagttactatcaatttgttgcacaatcaacaccactacaacaacccaaacaacttgccaaacatcttgggtgaaagccacaaagatggccggcaccaacccgatgtatggtccaacatacggaatcaagttcgttagaccagcaaagataccaagtagcagcgcgtaattctgatcaataataaagtaaccaatcgtcgtcgcaacaccaacgaaaatcatctcaatggcttgtccgctaatatattgtgcaatcgtcttgtttaaacgacccaaaatctcagccacacggccctcatttcggccagggaagattttttgcaagaatggcaccagcttttgtccgtcattcaacatataaatggtcataaccgggacggtaaccgccgtgattgttacactggtaatcgtcccaatcagcgtactcaaactacttgcagtaccagagattaacgtttcaccgtacttttgcacttgagcctgcaaatcctgcaaattagcattcacgccaatgtcttttacccagtccgtttcgcttagctgcgcaatccaactttgcgatgtcttaatcaatcctggtgcattatcaaccagcttaccaagttgtgtggctaatgctggcaccaaggccataaaagcggcaacaatcagtgcgattaataacaccatcacaattgcaattgacgcaacacggtttaggcgaaatttgccaacgtgaattttttgaagtaacccaacaatcggattcaacaaataatagaagaacccagatacaattagcggcacaaagaccgccccgataaatttaccaatcggttcgagtatgaaactcaattgcgttacaaccaagatcaagagggcagcagccaataattccactgtccaatacaagagtcgtgattgtctcaattgctgtaacacgcgcctacctcttttcatttttgatagtttccccgcggttgccaacgcaaaagtaggcaacctaatgaattttattataccaaaacgtgccgtaaatgcccgtttatgggcgttgtgattttcttcacttgttaattaagtttaacctaacaagtggttgcgcgtgacatttgtcatgcgaacaaactttccacaagttatccacaggctttttgtgtaaaataataagtattaacatatcgaggcattttatatgaaattgcatactaaagatggtagccaaattgattatcaaacatatggttcacctacaaaacccgccttgctgttattacatggtaacaacggatcacaacaggactttaaggcctacctccccctcttcgcgcatgacttctatgtcattacgcaagatgcgcgtggtcacggtcaatcaactaataaccagctacaactcaattaccagctactagcatcagatttggaagaattgcgtgtcgcggttaatatcccgacatggagcatcttgggctatagcgatggcgccaacttagctttacgttatacgctggataatcctgcgcacgttcacgcattagtcttaaacgcgcccaacctaaccatcaacggattaaccaagccaatcgtcttgatagccagctgggttgaatggttactggggaaactgagaaatatccatccattcttcgaagcgcgctggcagcagactgggttgatgtttaaaacacccggcatttccaagcgagatttgcaggctgttatggcgccaacgcttgttttagttgggcaattcgactttatcaagcgacgccattcgctaaacatcgcacacgctttgggtaatggcacactctacgtcgcaccattcaaaacgcatttattcattcaattttcgccgttggttttctcaaacatcgtgcgtcaatttcttaaggagcattaattatgaaatctagttttctaaatttcaggcgaatcttcattatcggtgtcgcattcgtcgcattgttcgaactgggggcattagtcaaacacattccgcccgaaagcatcctcgccatcttggcagaattgccaatcagcctaactatcagcatctttttgattggtttagtcgccgctagcaccggtgtcttgtcagactgggttctgcgcaagattttccaggataacgatgcggataacgcacctaaaggtcgcaagttttggtttgaaagttggacaatcgccaacttaaacaacgcattcggcattggtgatgtggtcatgagctggttacgcggccgcgtgtttaacagccgttcgattcaagactcagctacaatccgccagcactggtggcaaggtacattcggcttgggcatcgccagcttgttgagtttcggtgcgacgcttattttctggcccaaagcacccgttgccgattactcatttattttgttagttggtatgttgctgccgttcatcggtgtcgcggtcacaattcgcaattggaaatcacttgcattcccagttacgaagcacagattcgcacagacagtcggcgcttcattagttgaatggcttggtagcaccgttgcattcctagcattcggtgccgtgatgcacctgccaacgcctttacttgagctcgtgccattatttattgccgctcgcattatcggcctcattacgctagtccctggtggctacggcacattcgatatcttcatcttcttcggattacaacatcttggcatcgactcagcagtcgcattcctatggattatgttctaccgtttggcatacaccgcaattcccggcatcatcgccgtaattgcagccatcagtagcgccctagttaatttgaatacgtcattccgtggtgtaccaagagccatcgccggatcaatcattcaaaaagtcgatgccgtcttactctacttgatgggtatcgcgatgattttggtcggtgcgctccctggcacactggaatcaatcacattcttacaacgtttcagcccttggacgagcaacttcctaacacaggtgcccaacatcttcttagggttcatgctaatcatggctggacgtggtatcgctagcaaagtaaagcgcgcctacgtgccgacgctaattttgctagccatcacatttatctacgtctttatttcacgcagttacatcacaccagttattctggtgggcgccttattcctagccacattgttcatcaagccacgtttaacacgtgagcagcttgtgtacagttgggaatctcgtctaatcgacggcgccatttacagtattttgtttatcgcttatctattgattggactggccaacttgccagttgtgtcagcgcacttccacatccgttctacagggctgttgttgttaccatcattccattggtgggtgattggcttcctaacaatcgtcgctgtgagtcttggggtattgggctttatcgcctacttacaaggcaagcacgaattactcggtgaagcgcttgatgaagaacgtgttgaaaaggtgctcgcaatcggcgataaccactacacaaacttgattttcttaggcgacaagcgtctcttctactaccaacctgaggaaggtgctgaagattccgtcgctattcaattccgtctcatcaacaacaaagccgccgtcatgagtgatccatttggtaacgcgaatgacttcaaagctgctatgagcgccttcatcaccgaagccgaccgccttggttacatgccaattttctatgaggtctcagaacaaattgccatgatcgcccacgagttcggttataacttcatgaagcttggtgaagaagctcgcgttgataccgtaaacttcaaaacggccggtaagaagttcgcgaatatccgtagtgaaatcaaccaggcagccgcagccggctttgaatatgaagttttgcaaccaccattcagccctgcgctaatgaacgagttgcgcactatttcaaacgaatggttgaacggccgtgaagaaaaaggttattcattgggattcttcgatgaccattacctccaacgtgacggcattggcgttttaaaggctcctgacggccatatcgtcgccttcgcaaccttggttacgtcacacacggaaaatcaaatgaccgtcgatctcatgcgtttcacgaaggaatcgccaaacggcacgatggacgtactgttcgttaagactttcgaatatgctcgcgatgccggttatcaaacattcaaccttgggatgtcaccgctagccaacgttggcttgtaccaacacagtttcatccgcgaacgtatcgccaacctcattttccaatttggttctgcgatttattcattcgaaggtttgcgtcactataagcgtaagttcgctagtgattggcaaccttactacattgcttattcaaaccactcaaacatcatcttcgtcatgattgccttgttgctgattgataaccctggtgttgaattggattaacacaaaaagctgcccgctctcaaattggagcgggcagctttttcgcattgttcaaaatattaaataaatagcgcaacaaccaaaccaattgccaaggtcaatgagatgaccaccgcattcttaattgcttgcggaaagtttggcttaattgggttcgcttgaaaggctttcgtattcttcataacgattgggaatgagaccaacgtaatcaatgccggccatggcaaaatacgcaaaataactgccaaaatcaacacgatatagccagccaaataaatccagccgaacaccttaacggctcgttccttgccgaggtaccaaaccaatgtgtgacgattctcagccaagtcttcctcgtagtcaccgatgttatttgccaacatgatgtcaccaattgcgaaccaagaaatggctgatgcaacgatagcgtgtaacaccaattcagtcgtaaacgttggggcaacgtttacgtaggttgcacttaggaaaatcaaatatcccatcgtcaaaccagacgccaattcaccaaaaggcgtacgtgacaatggcaacggcgtacccgcataccagtatgcaacaacgaagccaattaagcccatcaccaacaatggtatacccgtctgtgaaaccaaccagagacccccgacggcaacaatcaaaaccaacgcaatcagcgtcgtccatccttggcgtggcgtaatgccccctgacccaacaatgttgttcacaccgttcttccattcctcacttgtggccgacttaaagtcctgcaaattgttccaaacattcactgccatctgcaaggcaaatgcgacgatcacaaacacaatcgctagcactgcattcatatgttgataagtaatcgccgcgtataagttacccaataccaacggcaatacgcttgcaaccaaagattgaatttcaacgaatttcaaccatgttttcaaagtcattctcaaaaacctccaaaaagtttttccgacaattcagcttacccgaagtacccgatgtaagcaagaaatatcgagttatccacaggggtagggtgggggaaatgacgccttaataacttcattgtataatgcaatttcgccaaaccaaggcgctaaaggcagagtttacacgtgttacacgttacatctgttgaacggggcgttcagttaaaaatgtaaaggattttcacgtttttacaccaccaaggcgacgtttttacatgcatattccatatgcatttatatgcaaaaacatgtatgcagtttatgcattcggttgcatattaggaatcgtcaggatgacaaattccgacagtaccacacgtccaaaatcaccgacatttgcaaccgtcaatctaaagaaacgcaactcatcccatcaaaaaacaaacaaaccgcaacccaaaatccaccccgatcaaccatcaaaacaacaccccagtaaatacaaaaaagcgacaaaaaagacgtcaatccacaccacaaaagtggtggatcaacgtcaagctcaactgctaaatttcaactaataaaatggccgattctcaatttaaaaacatagattggtatacgtcactaaatcgccttaaaaattcgtctttctggcgatacagtaatcgcctcagatgtgaccgaatcaacccgaccataaggtgaaggtgacacactcaccccattcacgaagtccttcattgccatctcatcaccctgcgcttcgattcgaacagagccgtccgaggcattccaaaccacacctgtaacacccaagcgatcagccaatatcttcgtaaaataacgaaagccgaccccttgaacacgccctgtcaccacgatgctttttgcttctaccatagcctttcccctatcaaaaaagtcccatggataatggttatccatgggactattatagcgttttacttcttctcagtggtcaaatcagaaccgaagtacttcactgacaacttcttcatcgtgccatccttttgcaaagacttctctgtctttgtaatttgagcggccaacttcttatccttcttgtcgagcataggtgcggcagtcgtctcacccaaagccttcgttaccttagcttgcaagtccgtctttgggtgggccttcttgtaaacgccccatgaatcttgtgagttcaacgtcacatcagccttacctgaatcaaccaagtccaaagcttctgcaaaaccaggtgctgacacaatcgttgccccagccttagtagcagcttgaccaaaatcagatgatgacgtttgtgccgccttcttacccttcaagtcgctgtaatccttaatctttgaacccttcttcgtaatcatcactgactcagtgaacaagtattcttgcgcaaatgcgtaagccttcttacgttctggtgtgattgacatgttgttaaacacaacgtcgtacttcttagcatccaaaccggctaccaatgagtcaaacttggtttgtacaaacacaggcttcaacttcatcttcttagcaacagccttaaccaattcaacttcgaatccagtcagcttacctgaatcactacggtatgagaaaggtgcgtacgtaccttccaaaccaacagtcaacttgcccttagtcttcaattcgctcttatatgatgctgctgaaacagtcgttgctgatgcaacaaccccaccaatcatacctgctgcaaccaatgcaacggacgtcttcataatcttgttcatttttatatcctcgcctacatagctgtatttatcatcagtgttgatcccaagctaaacgcaacaaacattacgcttaacgcaatgtttatacgcataacccagtagcgcttacgataatttattgacgaaaccatcatatcgtttcacttcctcaactcttattctgttgagtgagtatatgcgcgtctatttgttaacgcaaacgaaaaaggaatcgttccggttactttcaaataataaccaaaacgatccctaaattgcaaatgctaaatcttacttggctggattgctgtagtcagcatccaagtacttttctgaaattttcttcatgacaccatccttacgaagctcgtgttcagccttcgtaacggccttatcaagggcaacggacttcttattcatcataggtgccgccccagttacaggcatgtactttgatggtgaaggaatcgcaatcaaatcagtatcagggtgcgccttcttgtaaactccccaggccgctgcatcattcaatgttgcgtctgcatgcccgttttcaaccgtggcaaccgcttcagcaaatcctggtacagcaacatttgtagatcctagcttctcggcgtacttcacatagttaccaattgctgactgagcagtcttcttgcccttaatatcagtaacttgcttgatacctgaatccttcttagtgacgacaactcccccagtataaatgtacttcgcaccatagcggaataccttcatacgtgctggcgacacagccatatcattcaagataatatcgtatttgtggtcttgtagacctgcaaccagtgaatcccacttcgttggtacaaagacgaccttaatccccatcttcttaccaatttccttggccatatccacatcaattcctgttagatcacctgaatcggtacggtatgaatatggtgcatacgtaccctccaaaccaacagttagttgatccttgtgtagaaggccgaggttcttagtagaatccgcattagcggttacacaccccggcgctcaacaatgttcctgcggcaaataccgctgcgactagcttaattccattaaagctgtgcttttgcataattatcttacgccctttcaaaaagtatgttgcatagcataaacccactttgccatggttgtcaaatacctttttaatgtttatttaattcagcatcgagaaattttatcctaaaacgcttgcatttagtcagtgatgtctctagaatgaaacacagctattacaaatcaaaaaagacggaaggaaagttaaccatgatgacgatcaacacacaaattactgttgcttgcatcagcctagcgcgctactcgcggtaggtcgttttggtgaacttatcattccgatgaaccgttaagaagagcgcgctaggcctttcctgtgtcacacagaaactgtcggcgcgctcttttttgcgctcatcctcagaaagggaatcttcatgtttgaatttattgccaagtatgccccacaattgattatggcgggtatcaagtacactgtgcctctagcacttatctcgtttgttattgccgtcatcattgccgcaatcgtggcgatgttgcgttcatacgtcccacatgcaactggtatcaaatccattggttggcgcattttgaagttcatcctttggttctacgtttggttgttccgttcaaccccaatgttggtccaattgttcgtggtcttctatggattgcctaagctgggtatcagctggctatctccttcaggatgggcagccgctatttgggttttgtcattgaacacagctgcatacgcttcagaagcaatccgtgcagctatctcatcaattcctgatacgcaacgtgaagctggtgcagcacttggtatgactgattcacaaattttcttgcgtatcatcttgccacaagctgctcgcatttcaattccaacgttggcaaactcattcatttctttggttaaggatacgtcattggcatctgttgttacgatcgtcgagatgttctacctttcacaacaattggcagcggccaactttgaaccattgcaaatgtacttgctagttgctgcaatttacgcgctattcgtttcaattttgtctattccacaacgctacatccaacgatgggctgatcgtttcgtaaaggtacaggggtaatttattatgttgaagttagaacacattgataagcaatacgctgagcaccacgcactaaaggatatcaacgtcacgttcaatccacatgagacgacggttatcgtaggaccttctggttcaggtaagtcaacgttgcttcgctcacttaacttgttggagcaccctgattcaggtttgtacacgttggacgatcgtacgattgatttgagccaaccaatcacaactgaaacactactttgggtccgtcgtaagactggtatggttttccaacaaccacgtatgttcgatcacctaacaattttgggtaacatcatcgaggcccctgttcacgttttgaagcaaaataaagctgaggcaattgctaaggcccacgaattgctacaagctgttaatttggataacacggctgatcgttacccttaccaactatctggtggtcaaactcaacgtgttgccattgcccgtgctttggccatgtcacctgattacctattgcttgacgagccaacctctgccttggaccctgaattggaagcacaagttttgcgtgtcttgaatggtttggccaaggatgatcaatcaatgattatcgtgacacacaacatggaatttgcgcgtgaagctgctgatcgcatgctgttcttggaagatggcgagattgtctttgacggtacaccagctgaattcttcagcgaaccaactgatcgcatcaagcacttcctaaacgcctttaaatttgaagattaaccacgtgtttcacgtgaaacaaaaagaccttcgagattttttctcgaaggtcttttttcttacttcttaactggcaattgtagttgccaacgttcattaaagaacttacggtaggccataaaactagcaaagacagatgaaataccggtcgctgaaagcaacatgaacacaaccataatttgatacttaatggcatgaattggatcaacacccgccataatcaaaccagacatcatacctggcaatgacaccaatccgtaagtgcgaaccgtgtcaatcgttggttgcataccagtacgaatagcttcatggacgatgctgctagccgacagcttaggtgaaccaccaagcgccaaacgctcaaaaacttgtccctgttgatcacggaactgttggttcaaactgcgataaacaagtcccacagcggtcattgaattcccggccaccatacccgtaactggaatcatttgataaggttcaaacttcaagacacccgtcaaaaccaaaatgctcattgtcaccgtcgttgatagaagcaatccccaccaagagatatagaaagcccctggaattccttggctacgcttcttaccattgcgtgcagcgttataaacaatgaacaattgcatcacaatcgtgaccaaccaattatccaagttaaagataaacttcaataggtatccaacaataatcagctgaataatcgcgcgggcaaccgaaataatcgtatctttttcaagccctaatttttgccgataactaattcccaatgagataacaaccaatacaaacgcaagggcgagcgaccaattgctaacattaatctgactattcatgcgtcaataccccctcgccttcgtgcaacgtcagtacagtttgtgcttcagcaatctcttgctcatcgtgcgtgaccgacaagacaatattgttctcacggtcatgcaaggcgtgaatagcttgccaaatcgccgtcttggtttcgctgtctaaccctgtcgaaatttcatctaacaacaaaacctttggtggaaatagcaaattacgaaggaccccaattcgctggcgttcaccgcctgataattctgaaaccgccttatcaagatagttctctggcagtcccatcttcaccaaaccctcgcgttgggtgacttcatttaccgtttcttgacgtaccaaaaacggaaaatccaagttgtcacgaaccgtctcaccaaataattgagccgactgcgtagcgtatgagatttgttggcgcaccgttccaattggcatggtcagtgtgctggtatcatccagcacgacatcaccatcagtggcatcttggaggccagcaataattttcaatagtgtacttttacctgttcctgacggtcccactaccgtcacccaatcaccggatgcaagcttcaaatttaagtctttcaaaatagtccggtcgtcaatcgcataattaacatgtttcaattctaaagtcgtcatagatatccccccacattaaacctaatgacattgtaaaccaaaaagcgttggtgcacccgtcaccaacgctgatcgatcaattttcttcttcatttaagacaattccttgctccacaaccggcaacatttcttgccacgttgtttcgaacagcgttttaaacaaattatcatcccacttatccgcaaaaaacgggtgatagaaatatgtaaacgtctgcataatggtcatgccacgctgatttcggaatgtatcccaggccatgatgttttcaacagccagtgcaaaatcctgcaagcgcggatcaagcagcacatcacggttagccaattgttcttcgtaaaaagccatcatttcaggctcacggctaaatccttcgcgtcgacgtgatgccaacaaccacaaccaatcgtgcaaggctgtgacacgttcttcttccggggcgcgaacattcgcttcccagaccggaccatcaacctgctctaaccaagccgtattcatcgcttcaaaaagcgcttctttatttgcaaaatgcttgtataaagccgccggcgtaatttccaactttcgggcaacgtcagctaaacgtgacttttcaaaacccttttcgtcgagaactgctcgtgcggcatcaaaaatggactctgtcgtcactttcgccatggcgttcacctccgttctggtttatcacagcagctgttggtctaaaacccctgactttagtcaggcgtaagaccaacaacgcacctgataagggcgacttggtcgcgtcggaggtcaaaacctccgacactcctagtctgctttattatagctgaagcttaaaaaagtgcctaattttttaaacttctcaatatttttgttatcattaaggagtagttgtgtaacttatttttatttagtaacgttacacgtcgatgcacctcatcaatttaataggagtgtgaaatttaatgactatttcatcattgactgatacttacacgctttcaaacggtgttaagatccccgttgtgggatttggaacttggcaaacgcctgatggtgatgtggcctaccaaagcacgttggatgctttggctgccggctaccgtcacatcgatacggccgctgcttacggtaacgaagaatcaatcggacgtgctttgaaggattcaggcattgcccgcgaagacatcttcgtaacgtcaaagttgtggaacgacatgcacggatacgagtcagctaagcaagccttggaagacacgttgaagcgcttggacttggaatacttggacttgtacttgattcactggccaaacccaaaggctaaccgcgaaaactgggccgaagctaacgctgagacttggcgcgcgatggaagaagcctacgaagctggtaaggtacgtgcaattggaatctcaaacttccaagtatctcactttgaggaattgttgaagacggctaaggttacgcctatggttaaccaattgttcgttaacccttcagacatggaagctgaaatcgttgccttcaacaacgaacacaatgttttgactgaagcttactcaccattgggaacgggtaagatgttgacggtcgctgcaattcaagaagttgccgacaagtacaacaagtcagttgcccaagttgcattgcgctggtcattgcaacacggcttcttgccattgccaaagtcaacgcacaaggagcgtatcgttgaaaacggtcagctctttgacttcgagttgtctgctgaagacatggcaacgttggataagcttgaaggtgtcgctggtactcacactgacgccgacaagacaaacttctaattatgcataacaaaacgcccctaactgaaaagttaggggcgtttttgtctgtaaggaatgattcaattgaatgatttcttgctcgctgggtggctctctcaccaaccgcccagtgatatatgattacttcttaagacgcaaagcgacagaaacgctacctacgactaacaaagcaacaaaggctagaacaacatctagctcaacttcaaacgttgaggcgttgccctcagcgctaaatagcaacatcaatgctgcgaatacagcaatcgttacgatagcggcaatagctgacgcctttgctgacatcacatacttcatctcttgcattattcaaacctctcacaaatataaatctcacacgagttcttattataaacgttacttacttttattcaagagcaaaagaggaaagtcgtccacaataaaagatacccaggttaactaattttgttccacatgaaacaaaaagcgagtgtaattatctacactcgcctgcaaaaacatattaatcttgattgaattgtgtatcaacgtactcacggtacaactcgtgattagccaccaattccttgtgcgtaccagcgccgcttaccgtaccttgttcgataaagtaaatcttatcggcatccacaatcgtactcaaatggtgcgcaatgaccaacgttgttcgtcccttcatcaaagattccaacgccttctgcaccattgcctcagactctgaatccaaactggcagtcgcttcatccaacatcaaaatctttggatcacgcaaaaatgcacgtgcaattgccaatcgttgacgctgtccaccagacaccttcacaccacgttcgccaacttcagtatccaaacctgctggcatgtcgcgcacgaacttttctgcaaacgctaatccaagcacgcgccacaaatcatcatccgagtattcacccgttaatccatacgtcaaattgtggcgaattgttccggccataatcgctgaatcttggctaacaaacccaatttgttcacgccaattagccaaattcacatctgatacatcatgattaccaatcatgatctcaccggccgttggcgtgtagtaacgctcgagcaaactaaagatggttgacttaccaccacctgaaggaccagcgaacgccacaactgtattgggctgggcctcgaacgacacgtcgctcaaaatcttcttgctgtcatcataagcgaaatcaacatggctcatcgccaatgtttgtccttcaacgtcgacgtcgacaccagacgtcaaatcttcttctggctcagccaacaacgcttggacgcgttccgttgaaccgctcgccttagccaaatctgagaaaaattgaccgagagttgctgatgggccaagcaattggaaaagatacatcaagaatgagaacatcgttcccatcgtcattgtaccttgtgacacacggtgcgcaccgtaggccaatacaccaacaaacaatcccatcataaccgccgtcatcaacggaccagcaaccgaatcatacacggcctcacgcaaaccaatcttatacaaagattgaatcgtcgtatgacccttttcagtttcaaacggttccgcattagatgactttaccaaacgaatttcacttaacgtttcaccagccgcgccattaaagtcagccaatgaattctgacgatcacgaccaaccttgtgtgattgacgcatcactggcaacatcaccaacatcaccaatggaattgccaatgccataatcgccgtcatacgccagtccttcaagaccatcaacgtcaacgcacccaccaccgttagcaaagacgtaatcatacgaggaaatgagtttgccaacaagtctttaatttgcgttgaatcattaatcaaacgtgacgtcatttcgcccgctttagtttcatcaaaatatgcgacacgcaaacgaattagtttatcccacaaggtattacgcaaacgactaaccacgttttcgccaaagattcccaaaacagttcctgacaaggcgctaatcaccgcgctcaggataaacataccaattacactgacgagcaatgttttatcaatcgacttaccaaaaccgttaattaaatcacccgcaaaatgtggcacggccaactgaatacccgttgcaataacgcctaatcctagccccaatcctagttgccagtaggctggttttgtttgacgaattaagcgcataaatgccttcatatcaaactttgctggtcgttgaaatgcttccgtttcaacgctttgtccacgatccatctctttgcctcttatctcttatcttttatcttttatcttttgacggttagaaccagcccttgaagcccttgtgcaagtcgtggtgcatcttgtgcatctccttgcgcatttcacggcggtcagtgaagtccatgttttggaaacgctcggcgaatggtccaaacgcatcgcggagcatctcaggatccatttcaatgtcctcagtattggctgcgatgcgacgcaacatgtccttcaactgcgcctgctcggcttcagttagcactgagaaagcacgttcactcatttcgtcattaccgttatgcaaaccagccagcgtctccttgccggcatctgtaatgaaaataagtgaaacacggccgtcattctcagaagcacggcgttcgatcatccccgtttcaaccaagctcgtcacttgcgcactcactgagctaggacgaatatccaacttttctgcgatttccgcattcgttagcccgtcttccttattcaacaaagacaacaagcgcaaacgaccacgccccaattccttatcactaccgcgcttagtacgcatattcattgacattgctgccataaagaagcgcgagtgcatcaaacggctgaatgattccatcaaatcttgtgtttcatctgtcattttattagtacctcaaatagtcattagtaaattagttagttttacaacagccaacctaacgaaaaagaagtataaaccgttagttaggttaagtcaacaaaaactaactaattaatttggcaattaaaaagtcgcacccaatttgagtgcgactctcgtctagtcttcacgtagccaaacagcctcggaagcttcattatcattaatcacctgatgaacagtcttttgcgcctgtggcacaaacatctcgggttcagggcgcaccggtacgtatgaaacaaccaacgtttcctcaccatcttcacgcagcgtgccaccgaccgcttcaacttcaaagcccattgcaatcgtttcttgcgcatcaccccagcggttctcactgacgatttcagacgatacaccgagcaaccgcttcacacgcacatcaagtcccgtttcttctttgaattcgcgtacaatcgcttcctgtggcgtttcaccgtattcgatataaccacctggaaagccccagcctttttgaatatcagaacgtttctctaataagattgccgaacgatccgcctgccataacacaccgaataccgtgttaaaaatcatgccttcatgaccaactttttcgcgcattcgtgcgatgtaatttttctctgccatatgattcgccctcttttcaccacccattattccacgttaaggatataatgcaacacgctatccacgcatatgctggaaaaagctattcacaaaattgactaggtagtaaatacctgccggcacaataatgataccgacaatcaagattgaaaaatgttgttggaaaaacgtcactgagcccaaaaagaagccaattacggttgatccgagcacccaaattaaggtccccgccacattctggtttttaaatcgggcagctgcatactgactttcgcctgcgataattgggataaaaatacccagcactggaatataccggccaaatagcattgctaaggatgcatgactgttgaagaacgcgactgtatcgtccatacgcgcattcttaatcttatgcttccgaccacgcttatactttgcctgccagccaagatacaccatcggcagataaccaagccacaacaaccaaagttcaatcggaatatctggatgcgccgctaaactaccagctaaaaacatcgtcgtttcggctggcatccaggcgaataagacgaaataactttcaagcgccacaattgcccaaagtactggataaaccagccaaggattatccataatcggccgaatgaaaacgatcggattttggatgacagaaataatatctgctaattcaatcatgacttaacccaatcatctggcaatactgccatgaaactaatgtatgtcgttactgtatgctcgtatgatcccatgccaccattagccatatgttcgaacaacttagcatacacagggtgcgtctttgcatatgccataacattagccgttcgctctggtatttccaatccttgcggtgccatcatcatatcctgcacccattgatatggggtcattgtttgaccgtcccaccacggcgttgtcgcatggtaaaagtcatgcacgctaggcgccaaagcgtagtacagctgcaagccacgatctagcatgtcagcatcttgcttggcatctcccttaaatggcaccccattaattcgctcatattccttagccacttcaggcaatactgccactggcaaaatgtgttgctggccaatgtgcgtgaagccccactgaaccaatgggaatgttggcgcaacatctaacggattgatgatggcatgaaccgcttgatacttcactgcatagtcaatattatcagcactcttgtaggtcgtcgttggtgcaaaagcatacgcgaaaacgcgttcttccccggcatcaatcaacatttttccaacgacttctgtcgcactaccaccacgagaatgacccgttacccaaaaaatgttctcctgaccaacattgtcgaattgcatcacgaattcgtgtaattgcgccgcaatcttttggccgatataaatcatgttatccatgcccggtgcatcttcatcaccaatcatgaagtcgcctgaccattccgcattttgtggcgtaccacgaataatcacggcaaacaaattgttcgcaccaacgcgcttgtaacccagcgtaaacgccacgttatttggatcatcaaccacatgatagccatgtgattctgtcttaaagcccaaggcacgcaaattttccgtcgcatatcctggccctgcaacttggctatcacgcgtgtacgtcgaacccgccatcacagcactaactcgcgccaaatcatgttgatactcagctggattcttatcaaaaagcgcatcactatatggcacatccatctcgcgcgcttccggcaaacgaccctgattattacttgttataaatgttaaaacagtcatttcattacccccaccactaattccgtcactgtcatgattaaaaacgttacttgttaccctccagtctactcgatttgtattctaaaaacatgaagaaacattgccatacaactaaaaaaatgcttgcagagcattagctccacaagcatttcgtcatttcttaacgacattcataatcaaaattgcaccgagggtcatgacaatcccaacgacttggaaagcatgaaatgaaacacccaacacaagcgctgataaaatggtcgcacttagtggctctaacataccaagcattcccaccgtttccggcgccactttacggagactcgcaatataccagacaaatgccacaatcgatccgaacaccacaataaagaacagcaatatcaaatcaatcgtatcgaaatgataggccgggtgatagagtggtgccacaaaattagcagccaagccacccataaacatgccccaaccaacaacgacgatggcgtcattctcagccaacaaagaacccggaatcaacgtgtatgcgactaaccctagcgctgacaaaatgccaaagaacaatgtcttctccgagatttgcaattgcgtcagattgccattggttaccaacaacacaatgcccactaacgacagaattactgcgattaattcttgtcgttgtggccacctatggcgaaagatagctagaaaaataacaatcaacgccggtgccatatactgcaaaacggtcgcaaccgctgcattaccgtaatacaacgttcgcacgaaattggactgggcaaaatacaccccaattaacccaaacgataccaataagatggcgtttttcggctgccgccaaatcgcaaaaatattttgccgacggatcaacgaatacaacagcaacgctgcaccggaaatcagcaaacgggcggtcgttaaccaatctggcgaaatggcaatccgatcaaataacatattcgacaagattccattgataccccagaatagcgcgccaccagcagccatccccacataccactgcttactcacacaaacacttcccttactctaaaaatagaaacttatcgctaagtataccacgcaaaaaacggctatcagaccttaatctgatagccgttacgccaaattgttttaacagtcatgaaaatgacgaggcctatccaaagtacagcgtttcctaaaatgatcattttaataactggtgacacgtcatacgaaatcgtcacgttattctgaccgacccgtggtcgaacctgcaacgtcccaatacgtgttgtttgtggttttgccacctgatgcccattcaaaatcaccttggaatgcgcatagacagcaactggcaccgttattttattgtcattttgactatgccaacgatacgtaagtgcatcgttaccttgcgttatctgcgcttttagcgggttctgaataacctcacgcatatacatgtcatagctattatcccctgattgcaaaccgttattcaccagataatcaggggtcgctttttgcacatccgctaaggcgttctgcacatcaccatagcgccattcccgtgcaatctcggccttcgatttcgtctcattgaatgccgtatgcttcgtgacatggactagctcatccgtatgcaaccgatgggcactcttggccaaaatacctgaggaaatcgcaactggcaccacgatggcaatcataacaatcaccaatcgtaactggcgatttaggtgtttttgcacatccggcactaccaagagccgtggcaacaacagtaccaaagccacgttgctaactaccgacaaacgcgacggaaattgcatcgtatcaacaatcgttggttcgatctgttgaatcgcattccacgggaacaccgtcaatgacaaactgaaaaagacaactgccagccaaaataagaagcggtattcacgggccagctttcgataaaccaacacggcaacaattaagacaaccaccgcaataatgccaagccaactatagtttcgaagtgttggcgattgcgataatgtgattcgcattccttcccgactaatatctaacggcgtatatggcgttagaatctgattgcttcccatcacgtcagccatgcccactaaaacattagcgactagcaacccgtataagacaaccgcttttagcaaacgttgcatcaaagcaatgattgttgccttgttcttaccaatcaccgtcaccacaaataaaatgcctaataccaagacacctaatagtgccgtgaataaatgggcttgtgtcagtaccgccaacgatatcgccagaccaacccaagaaaaggttgtcggctgtttagccattgcaatgccgtaatacaccacatacggcagtagcgcagcgccgataccagtaaatgattggctcgtttgccaagttgtcgttaacggtaacgccatatagataaccgcactcactaaactggcatatcgactagatttcaaataacggcctagtcgataaatccccacaccggcgactaacaagatagcaatgtcagttacaatttcaaaccaaaaccagtttggtattagcatgaggacaaaccccatcaaatacgatagccacggtccatataacggtgtgacaatccgtccggaatgttgatagccatattctgacatgaagtagttaaattgcccgtgtttcatctgttccgcaatatcatagaaccgattaaagtgaaacaacgcatcgataccgataatcggcatattcgatatcagttgcggtaaaactaatacaactgacgttagtaataacacgccaccaggcaatgccagtgatcgccatgaacgcatctcacacctcctatttacgactaatatatcaccttatagcgtatcaataagttgttaatttattttgataattaactaatgtcatcacaaaaaggtcgtcagtcaaaaactaacgaccacagtattatgctttttgatattgcgccaaataatccttcaaatactgacctgtaacactttttggcatcgtggctagttcagctggtgtcccagtaccaacaatttgaccaccgtgcgtaccgccgcccggacccaaatcaatcaaccaatcagaattagccattacttccaaatcgtgttcaatggtaatgattgtcgctccttgtttcagcaacaaatcaaatacgtgaagcaagttctcgatatccagcgggtgcaacccaactgacggttcgtcaaagataaacaagctagcgccctgcttttggtgaatttgtgacactaactttagtcgttgcgcttcaccacctgataattcaggcgtactctcacccaaaattaggtaatccaagcccaattcttgcaacgtttcaagcgtcttaagaatcttcttttcatccttgaacacttcaagcgcgtccgtgacagacaacgccaacaaatccgcgattgatcggtcatgccactttacgtccaacacatcagcacgatagcgtgaaccttggcaggttgggcagacttgcgtcacatctggtagatattgcacatcaagcgtaatgtgcccgacacccccacaagttgggcatgcgccagctgcattatatgaaaaatcactcgccgtaaagccacgttctttagcatcaggcaagccagcaaacaacttgcgcaagttatccagaatgttggtgtatgtcgcaactgttgaccgcgcattcttaccaactggcactgaatcaaccatcacaacattcgcaacacccgccgcatcaagagacgcaacaccctcaggtagtggttgttgttcattttgcgccaaaatacctggcaccaacaaatctagaattaacgtcgtcttaccagcaccgctcatccccgtgacactcgtcaatcgattcttagggatatgcgcgctcacatcatgcaaattattcttggcagtcactgcgatatcgatactaccgtcatcaaacaaagtatctcgtgatgcaagcgttcttgtctggatatcagccgttccgtttagatacggcgcgaccaatgcatcggacgttttcgcatcagcagaactgcccgcaaacgtcaccgtcccaccgtaatcacccgaacctgggccgatttcgataatgtgatcactcgcgccaatgacgctcatatcgtgatcaaccacgaccaatgtattaccttgttccaagagtgttttgaaaatcgtaagtagacccgcaacgttagctgggtgtagtcccaccgttggctcgtctagcacatacaacacaccggtcgtttcattgcgaatcgttcgtccgagttgaatacgttgcagttcaccagttgaaagcgtacttcccgcgcgtgctaacgtgagatagtccagaccgagcttaattggcgcatctagcaattccaaaaactcatcaactagtttttgccccatcttgtgcatctcatccggcaacgttgctggcaattcagcaataaataccgctagttcttcgatggtgtactctgacaactcagcaatattcttgtctcgtagcaactgtgtcagtaactttgggttaaaacgcgttccatgacaagttgggcaagtttggaaagtgtaaaactgattcaagcgcttgatggtgcgctcatttttactgctcttcatactgtcctcaatagcgttcgtcgcattttcaaagaccgcgtgatccatgtgaaacaccttaccgctcttgcttggaatattaatttcatattcatcgcggtcaccgtgcaaaaccaagtctttttggtcatctggcaaatcttcatatgggatatcaatattgatgcccgctgcctcagccaccagtggcataaacgttcgtccaggggtacgccatgaattcaccgcaccatcgcgaatagtcagcttttcattgattaacaatgctggattaatctgttgcacctcacccgtcccctgacaagttggacatgcgccagccgaattaaaagcgaaatcttcggcaccgtagggcatgaaatgcacgccacaaactgggcaatccatccccgtcatatcaacatccatcgcaacggctaacgttggtccgattcgatggccatttggacacaccatcgaccctaaacgtgaaaacatcaaacgtaacacgttcaaactttcggtcatcgtcccaacagtcgagcgcacgtctggcacctgtggtcgttgacgtagcgccaaagccgatggcaaatggtgaatacttgtcacgtcagcacgatttgcctgtgtaattcggcgtcgcgtatatgtcgacaatgcattcaaataacgccgcatcccctcaccatacagcgtccccatcgccagcgaactttttccagaaccactgcgaccagtaattccagtcatttgaccaagtggaatatccacatcaatgtttttcagattattagtttttgcaccccggacttcaatcgaaaatgtcattttcttaccaccccttagttgtcgtgctcgttttccctgttacctttcattgtatcgcttcaacgcatgaaaaacagttctcctcaactgaaaaaaggacgcgcaaataaattgcgcgtcctctatcttacttgctcttcttcgtaaacttaacaataccttcccaacgagcagtttgtgggaacatatcgattgattggatgtattcaacatcataaacacgcgtcaagtcgaccaaatcacgggccaacgttgatgcattacatgacacatacacaaacttatctggttgggtttccaaaattgtccaacgcaattcttcatccaaaccagtacgtggcggatcaacaaccaaagcgtcggccacccagccttcatttgcccagcgtggaatcaaatcttcagctgcacctgtgtagtaggcagcattcttaacaccgttatccgccgcattttcattagcgtcatcaatagcttcaggcaccgtgtccataccgcgtacttcaccagcatgatcagccaatgaaataccgatggttccgactcctgagtaggcgtcaatcaacttatcggcttgtgtcaaatcaagcgctgagatggcctcgttgtacaagcgttgcgtttggcgagggttcaattgcaagaatgcacgtggtgacaacttgaacgtcttaccgttaattgtctccgtaatgtattcgctaccccacaacaacttggtatcttcaccccaaacaagtgacgtcttgtctgagttgatattctggtgaacagacacaacttcaggcaattccttgttgatgcgggcaatcaattcatcagcactaggcaagtacttgccgttcgtgacaatcgtcaattgcacatcacctgtcgtttctgacacacgggcaatcaacgtcttaacaattcctgagttcttgcgctcgttgtaaattggcatttccatatcagccaaaatatcacgcaccttgcgcacaaccttcaatgttgccgggtgttgcgttgaaacctttggcaaatcaaccaagtcgtgagaattacgcttgtacattcccacggccaacttaccatcaacttcacgaaccgggaattgcgccttgttacggtatccatctgggttttccataccaatcgttggacgcaaatcaaacttttcatatccttcaggcttgtacttttccaaggcctgacgaatcacatcttgcttaaattctagttggccatcgtaagacaagtgctccaattcaaagcccccaacttcttggttgtcaactggatcaacacgctttggtgagcgttgcttaatcttacgaacacgcgcttcgatgaacttgtctgtgacgttcgttacaacaacatcaaccacttcatcaggtagtgctcctggaataaacgtaatcttacgcttatagtaaccaattccttcaccgttgattcccaatcgcttgatggtaatcaacagcttgtcaccaacgttaacttcgacgttttgttggttgcgattatcacgacgaggtccacgtgttccacgtggaacaaacttgccgcgattttgattgttgccacccttaccttggtaaggacgacgcttcttttcttcagccatttcgttctacaaagacttatcgtctgctctttctataagatatttctattctaacatgtaggaagtaaaaataaccgattagcccttcacgactaatcggttattcgtatttaaattaaaccactgttcaacatccaaggcagcccataccctaccattaatcctaaaataacaacaccaatcaaactaccaataaaatcatgtcgcttacgacgatcaattgcttctgcttcttcacgcatttgttgttcaatgattgggcgtaactccgggtgctcgatcatcatcacttggcgacgaagttcgaattccttatgactcaattcattttgagttgctagttctgccgcctgctgtgccaaaagacgattttgctcttctaccgcataagtgttttgctgcaattcataagattccatattcagcttacctctctaaaagtcatagatataatacgcttctagaaagtaaattgctgagttccagcttgtgaaatagttagataatttacccctccgatgaggacatcactacacctaatgaaaccttatcgaccttatccgacgtctccagtgcctttaaatctgcaatgtttcccgtaataacaacaccagggaatttcgctaaagccaaatttggtacctgatttggccatgacatttgcgatttgaaacgattataagactttaaataatatcggtagtcacccgttggatcttcttttccgattggaacacctacatactctgcgttaccagtggcaatccctgaccacagccaagtaacagccacgcttccgggcatcccccgtttaatttcgtcataggtcaactcagatttaaatgtcacagcaagctcagcaacatcgttatcatgaaattttgaaaaatcagctctaacaaaacgctcctgtgttttcccgttaaactgcaataatcgctgcccattctcactatctagccaactaccatcaacgtagctttggctattttgcctaaattgatctcgacccatagcgttgtacaaataggtctgatttttccaatgaatagcctggctcgagatttttttactggcgcgataatcaactcgacccatcaatcgcccaataccagaagcaactaaataattcgtctgaacattaggcgtggtgatgttagtccaatgttcaacatccgctcgcattaacgcaccttgcttatcagtgcggtgaaacaagaacaatacagctacactccccacgaccaatactgcaaaagtaaatccaaacaccctcttcatattccagcatattccttgtccactaatattttgcgcaacatcttgttacctccatagctttcttggtatgtctttcaatataggggtttgtttattttttcaccacgatgaattttttatattttttaaaataaatctcgcgcataaccgttaagaccttgcgataactgaaaagggacccgcaaaaatgcgagtccctaaatgagtttttttaattaccaccaaccgttagcaacacggaatgacacggcgttatcgattgatccgtaacgtgtcacagcgtagttaaccataccagctgtttgttctgaaactgaaccagttccccatgattgcttggtttgacccaaacctaggtaaccgtttggtgatacggcatctgggtttccacctgattcaggcatcacgatgtttgaccacaaagcatccgttccgccggctgcaataaattgatcataaactgaaccagttgctgctggtgctggcgtttcagccgcaacttcagccgtttggtaagccgtcgtaacacctgagtccgtcgtttgcgtgaatgaatcagcttgcgttggtgcaccgacgtagtttgacgctggagctgccacgacaggcgcctctgaagcttcttcagcaactggggcaacttctgatacgtctgatgctaccggtgcctctgacgtcacaactggcgcagcactttcaacaaccggtgcagcttgggcaaccaagttgatcgtttgaccgatgaaaatcgtgtcgttagctgtcaacccattaatggccaacaaatcagccaacgtcatatcgttcgcttgggcaatggcgaaaagcgtatcaccgttcttcaccgtgtatgaaccatttacaccaactggggcagctgttgtcgttgccgtcgcatctgcatcggcttgcactggcgtaaccgttccatcaccgttaaccgtcaatgacacacccgtcaaaatgaagttcgcatcttcaatgttgttatcactagcaatcttttcaaccgtcgttcccattgcattagcaatgctcgtcaacgtatcacccgccttaaccgtgtatgtatcagctgatgcattcacaccaacagcaaccgtcgcaactcctgccgttgtcattgctgtcaaaatttgtttattaatcatttaatgtctcctattttcgtagaggtctacaatcctacaaaatattcactctctatgataccggtgcattattcagaacacgttacaaaacctcgcccttaaaccatttttaactaccataagaattgactatgaaactttagaaagttattttccgggcaataaaaaaatcactcacaaccaaattttttggtcataagtgatatgccagttagtggcgacgttgttccacactgtaaataatcgtgcctaatatcgcaaaccaaataccgaccagaactgtcgtaaacgcaaaggttgtaaacaaatacgcgaccaccacaatcgtcagataagtcatccatttaccaccaggtaacttataaccagttggcaatgtcgcatcaccacgcagcttaatcgatgagaaaattgttcctaagtattgcacgaaatcactcagcacaatcaatttgatcaaaaatagatagctaccgctcaaaatcaagccacctgagattgcaatcgtcagcaagatggccccaaccggtgcgccataacggttcaaacgagagaattcacgcggtaggaagccacgttcacgggccattgaggccaattcaattggtgaattaaatgatgtcgcgattgcaaccccgataatcgacaacatcatccccgtgatgataatcgtacggccgacacgtcccaaaataacattaaaaatgtccgcgaccggcaaagctgagccagccaaatgatcacccaaaactgtcattgcgacaacttgcatcaaaacgaaaatcgccgtcgtggctaacatcacggtcaaaatcgcacgtggcaacattttgccgggattcttcatctctttagccgcgattggaatcagtgagaatccagtaaacatatagaaggcatttccaaaggcacctgaaaaatcatgcaccggtttcgcttgtgcgattgagaattgcgatgtgctacccaacagcaaccacacaactgtcgcgatgaacaccgccagaatcacgccgatttttatcaaactggacgcatcatctatgcgactcgcgatcccggttccgaagtaattcatgactcccagtagcaacataatgccgatagccaaactattgtagactaacggcgttccgaccgcaggcaccagtcctgttaacgtttttaaaaaggccgccgtctcagcactgatggtaattaccccgaaaagccagccaaaccagccgaccaagaatcccgggtaatgtccaaaggcacgtttggtgtacacccacgcaccaccatcttcatcaattcgcgaagacatgacggcataatgcatcgcgattagcgtcgctgaaataccggctaaagcaattgccaataagacgtattggccgccctgcttgtacatcgtactcggtagcaaaaacagcccaccaccgataacaccgttaatacctagcagtacaacgctcgggaatccaataccttttttgaattttttcattgttcaatcccccctaaggcccagtctacctaaatttcgtgcctttttcttttacaagttgttaaggacgaacgataatgatggcaacaaaacaaaggaggccaccatcatgatgactttaggacaatatgaaacgcttgcatctgcatataacaacacgagtaccatcacgtaccccattcctgcatcattaccagttggaactaccgaagttatcaatgaagatggacttcaaatgagcatcacgaataccgcagacggcgttactgaaattcgttttgatgctgacgcaaatgatcgtcgctaccctggcacattccaaggattcgagttcggcatgcactggatgcacccttcatttatcggtgctttcttggaagccaaggataaccacaaccaacacttccttggcgataacggtaccgctgcatacgatgctttcgtcgattctgataaccacctaactgttacgcttacgccaagtcactaacagtttggcgttgcttttaaaggaaattccccgtatgctatcagaaataatgcttatggaggatttgccgatggcgagtcgcaaaacacgtcgacaacgacacaatccagttaaaaacctgctgaaatggctggcaaccatcattgtcatcatgctattagcgggcggggcctacgttggttacgccattcatcaagcgccaaccattacggaatcagccctcaaggcgaatcctagccccggtgataatcaagtttacgtcacctacgacaacattccggacgactatcgtaatgctctgatttcaaccgaagatcgcacgttcgaaacgaacaacggcgtcagcttgagtggcgtattcaacttggttgtttcaaacatcaaggctcgctttggcgatggcgtcgctcgtggcggttcttcaatcacccaacagcttgttaagttgaccgttttctcaactagcaaggcggatcaaacaccaacccgtaaaattcaagagatttatctagcacttcaattgaacaaaacacataccaaagcacaaattttggaatactatgtcaataaaatttatgaaggtcactaccaatacggtgcgcaaacgattgcctactattattttggtaagccactgtctcaattgaccttgtcacaaacggccatcatcgctggtttgggtcagagtccatcaaatttcgacttgtacagcaatccagaattagttgaaaagcgtcgtaacatcgtgctggccgcgatgctagataatgacaaaattaatcaccatgaatacgaagatgcgaaggcaaccagcgttactgctggtttaattccacgctaaaaaaccgcgatgaactcaagttcatcgcggttttcgcttatattaattagttttcaggcgtttctggaaccttgatgtcgccagcaataatctttgcctttgcatcttcaacagccttcttctcgtctgcgttcaagttgttagttgtgacaccaacacccttttccttcaaaccgtagtagaccgtcttaccaccagggaacttgtccttttgggcagcttcagtaaccaattgcacaccacgaccgattccagtcaatgatgatgtcaacgtcaagttatcagacttgccatcctttgtcttgtaggcacccatgtcagtttgatccatgtcgacaccgataacccataccttatccttagagtcggcagccaacgttgcgtcttgatccttcgcagcttggaagacaccgtttccaacaccaccagcggcttggaagatgatgtgctcaccttgtgcaatcttagccttcgcaatcgtttgtcccttggcagggtctgagaacgtaccagcatacgttgcatctaccttgatattagggtcaactgacttcacgccggcttggtaaccagccaagaatgcttcgataactgggttcttcataccaccaacgaagccaacagtgttgtcgcccatcgtcttagccttcgtagctgcagccacaccaaccaagtatgatgattgctctgaacggaacattactgacgcaacgttcttgtacttagcaccagcaatttcgtcaaccaacacaaacttcgtgtctgggtacttctttgaaacagtttgaactgagtccttaaacgtgtttccgattgctgcgacaacatcgtacttagccgttgcagcttgcgtcaattgcgtgttgtaatccgcaactgtcttaggttggaagtagttgtatccgttttggcccttttccaagccattttccttaccccacttctccaaaccttcccaggcgctttggttgaagcccttatcgttaacaccgttcgtgtctgaaacaactgcagcagtgaacttatcacttgagccaccgttgcttcctgacgttgctgcgtatgcaattcctgcaaccgcgacaagcgctactccaccaataattaagttacgacgtgaaaccattttcctaatacctccaagtataaaatccctcgacccgaccactcgttttgtcggccaaaactggccaactcagagtccatataaaaatttaatttttaccactataaaggggtatttaagataatgcaagggctaagtcattacaaaaatcattggttttgaattattaaaaacgattaacctgattatcaacgtatgaaccctttaaaataagtatttttcgtcaataacttatttttagtaactataattatgagaacattgtaatatgtgaacaaattacgaacattcccaaaagttatcattgataaatatcgacaagtacgtataattagaaacaacttattaatgggggacatcatgggaaacacacaagcacacgacagtattcttgttttggactttggatcacagtacaaccagctcatttcacgacgtattcgcgaattgggtgtgtactcagaactaaagccacacactttgacggcagccgagattaaggaactaaatcctaagggacttatcttctctggcggaccaaactcggtttacgaagacggcgccttcacaattgacccagaggtgttcaacttgaacattcctattttgggtgtctgctacggtatgcaactcatggcacacgttttgccagggggaaaagttgcaccagctaacgattcagctgaatacggcgaaactgaaatggatgtgacggacgatagcgcgctattgttcggtaacacacctgagaagcaaactgttttgatgtcacacggagactatgttgaacaagttcctgatggcttcaaggcggttgcaacgtcagacagcacgccaattgccgcaatggaagacacgtaccacaacttctacggtgtgcaattccacgcggaagtgcaacacactgaatacgggatgcaaatcttggaaaacttcgtcgacaaggctgttcgcgctgagcgcaactggtcaatggatgatttcatcgacgaacaaatcaagcaaatccgcgaaacggttggcgacaagaaggtcttgttgggactttctggtggtgttgattcatcagttgttggggtgttgttgcaacgcgccatcggtgaccaattgacatcaatcttcgttgatcatggtttgctacgtaagaatgaagctgatgaagtgatggcatcacttggtggtaagttcggtttgaacatcatcaaagtcgatgctcaagaacgtttcctatctaagcttgccggtgttactgaccctgagcaaaagcgtaaaattatcggaaacgaattcatccgcgtctttgacgaagaagctgcaaagcttgatggtatcgatttcttggcccaaggaacgttgtacacggacgttatcgagtcaggtactgatactgcgcaaacgattaagtcacaccacaacgttggcggactgcctgaagacatgcaattccaattgatcgagcctttgaacacgctcttcaaggatgaagtacgtgctttgggtgaaaagttgggtatgccacacgaacttgtttggcgccaaccattccctggccctggtcttggaatccgtattatgggtgatgtcactgaagacaagcttgaaatcgtgcgcgaatctgacgctattttgcgtgaagaaatcgccaagcacggcctagacggtgaagtttggcaatacttcacggtattgactggcgttcgttcagtcggtgtcatgggtgacggtcgtacgtacgactacaccattgccatccgtgctattacgtcagtcgacggtatgacagctgacttcgcaaagttgccatgggacatcttggaagagatttctcgtcgcatcgtaaacgaagtcgaccacatcaaccgcgtcgtctacgacatcacggctaagccacctgcaactgttgaatgggaataatccttaaataaacagcaaagccctgcatcaaggttcaaaatgaccttgatgcagggcttttaattattaattcttacggttataaaccaacaccgttagcggtgcgaagattgcaaccaccaacacaccagcgcctagcacaatccaggcttggtttgaccaaacaccttggtttagcatgacacgggatgccttaatgacatatgttaccgggtttaggtttaccaaaatttgcataacatgtggcaacgtcttaacaggtacgaatgcgcttgataggaatgttagcaaaagcatcgtaatcaatgagacgctttcgaccattgttgaactcttggcgaccataccgtacaacgcgaatacccagctcaaggcccatcccaagaatacatctagcaacacaacgacaactacccaaccaaatccagcggctggacgccagcccattaggaatcccgtcgtcaatgacgcaactgcagcaataaacaaccgtaaaatatctgcgaatagttggccagccaatggtgcgatgtgggcaattggtaatgacttcaaacgatcataaatacctgaattcatgtcgtcactaatttgggtaccagaacctgatgcagctgaaatcaacgcttgcataagaattcctggcacaattgttggcaaataagcgtgcacgttaccggcaatcgccccaccaaataggtaaccaaacatcaacatgaacatcaccggttgcacaatcacatccaaaaacttgtctgggttgtgtaacgtctttagcaaattacgatatgccattgtggctgtgttcgcaataatgtttgtcttgtgtgcttgtacatccatcatgattctaaccttcttatttcccttaattctttccaaccgtcaaagcaaagaacacatcatccatagatggttgttcaacggccatattcgtcattgtgagccccgctacagttagttggctcaagatacctgcaacctgattcgtatcgcgtagtggcgctgtgacggtattatttgccatctttacttcttcatgcaatgcgtcagttacgatttgctttgcctggtcggcctgttgtgcatccgtcatttccaaacgtagctttgcgcccccaacttgggcctttaactcggctggcgtaccaagactgaccaactttccgtggtcaatcaacgcgatgcgatcagctaattcatcagcctcttccaagtactgcgtcgttaggacgattgtcgatccttctgcgaccaactcgcgaatggtatcccacatttgcgtacgggtgcgtggatcaagaccggttgttggttcatccaagaaaatcaacgctggtcgtgaaatcaagctaaccgccaaatccaaccggcgacgcataccacctgagaaattcgaaatcgccttatcagctgatgccaccaatgaaaactcgttcaataattcttccgtacgttccttagcttcgcgtcgtgacaaaccattcaaacgtgagaaaatcatcaagttttcgcgagcagaaatatcttcatcaaccgatgcgtattgaccagtcaagccaaacaatgaacgaacgaccttaggttccttcttaacgtcgtgtccgaaaatttgaatcgttcctgacgttggctttagcaacgtcgtcatcatgcgcagcgtggttgtcttacccgctccgtttggtccaagcaaaccgaacacctcaccacgcttgatgttaaatgacacgttatcaaccgccgtttgcgtgccaaatgtcttggtcaaaccttcaatttcaactgcatactcttcactcatgatatttccttcttgttttcaaattaattgtcagggtacctgacgaaaataataataaggtaccctgattaatatgtcaacggttttgttcaggtaccctgtgtattttagttcatattcgtcacgaaccctgttatactggcattagtagaaaaatttaaggacggcaagatacatggctgatttgatcgaaaaacaccaattagcagcaaaactatttgaatttacatcacttcagcacttggctgatgaacaagttgaacgtcactcacccgtttttcgtgggcaaaacaaagtcttggttgcgttgagtgaaggcgataatatttctcaaaaggaactcgctgagcgcttggatatgagtgtgcaatcaacagctgaattcgttgctaagctagttaaaaaggactttgtcactaagacaaagtccccaactgatggtcgtattcaattaattcagctcactgaaaaaggtcgtcacgaggccgaaaagagcttgttttacatcccagagtatctcgactatctaagccctgaagaatggacgcaactcgcagccatgctagataagatgaatgatggcatccgtgatcacttgaagcttgatggtatccaaaacctcggtacccgtattatgttaagccaattgaatcgtaagactgaagtcgatgataaataatatgcctaatctcgatgagttatcaaaaactcatcgagattttcattttggcaggtgattttagcatgaaacccaataattactagactaccatttatttttttcgtcattataatgatagatataccaacggaaggagccacatttacaactgaatattaccaatgttgtcgtgaacagattatacaaatcaaggagcatactgatgaacgaaaatatttacacacaacttgtcgctgactttgctgcagctaatggcttcaccttttaccaaggcgcccaagctagcccggcactcattcgcaactgggaaaatggttcgctgaagattcacttcgtttcctatggcaatgacagccaaactgctagctggcatttcatcaacgaggggttcagccatccagtttctcacaagggcactggtattgatgaactaactgattggatcaacaatacaatcacacctcaactcgcttaacgattcacgggagcggtcaaatttgaccaccttccccaaacatatggtaaaatcacctgccgtttttaaaacgatacatattcgccaacgtttcacgtgaaacatcggcacccaaattgacatacatatagcaaatcagccatcccccaacacaagttgagagatggctgatttttctattatttaagcgtcttatctaaccattcaaacatgacggtcaaccgcgcattgcgtaagttcggtaatccgttacgagacacaccgtgccatgattgcgggaaacgtaccatttcaaccggcgtatccgtcaacgtcttcaccgccgtgaaatacatttccgtttgcgcaattggtgtccgtaaatcatattcaccatgcatcatgagtagtggcgttttaaccgccccagcgtacgtaattggcgagcgcttaatcaattctgctcgaccagcttccgtatatggcgttgcccccatttcgtcagcgacaaagttatatccaatatcactggcacctgttaggtgtagccactctgttactggtcgttgtgaaacagctgcttggaatcgatcagtatgaccaattgcccaagtcgtcataaagccaccatacgaaccgccaataatgatttgtcgggtagcatcaatcttatccgcatagcgttcaatagccctatctaagcccgctaatacatcacgataatcttgttcaccatagtggtttactaccgcattgataaacgcttggccgtatgttgttgaaccatgcggattcgtaaagacaacgttgtagcccgcttccgcaaagcgttggaattcccagaagaacgcatccccataagctccatgaggaccgccgtgaacatatagcacaactggtgccggctcctctgaatgcgctggcaagaaccatccatccacatccgaaccgtcttcactagcaaaagtgaatttttcagctgccgtaaacgacaacgtcggattagcatcataacgcaccgtttgtgcatgcgtgtctaaatcgactgtaatcaaacggcttgggtggctcgtatcttgttgcgtaatcaccaattctcgatcagcaatcgtaaaatcagttagcaattgtggctcatccagtaatcgcgtaatctcgccagctatcgttccttgataaagacgcgtatgtccgtgataccccgtctcaaagatgtaggtttcggaatctaaccaacgcacatggcgtccttgtccctgcacaatgacatcagaattaggttctgctaacaattcttcgtcatcaaaaaccaatcgtgtttgatgaccatcataataatgcaggctcactgcccgtcgattaggatattgagcatcgttgccgagaatcaaaatctgcgttgcatctggtgcaattgtcgcttcatacacctgtgccaaattagtgggcactgtggtttgcgtcttagtttcaaaatcaatcgtgcgtaattctgaacgatattcgtgagcgtcctcatcattcgtttgcacaatcattactacctgcgtatcagtcgcatctgcaatcttaaccggcaacgagaacgtgcccaataaacgtgtcacccctgaaaccgtggcttgataaatctcaaagcgacgttgctcatcgataaagcccaccccgtcatctttataataccgcttcgtataatatcgcaccgttggtcgctcgctgacggcattaaacgatgcttgcgtttcaacttgaacagcaaacacaacacctgccccatcaggtgttggtacaaaactcgtgatatgatcgctttgatgcgtcaattgcaccgtttcgccagcaacagaacggcggtatagttgcccatcatgctgatagaaaatagcctgtgtcgttccttgcaaatcggtcgcgtcattcaccaacgtggtcgtatccgtctcgttcacaaccaccaaattcgtttgataacgattcccaatttcgtccgcgacactttccgtcgcatatagcgtttgaccaacaatcgttggacgtgcgattcccctgatgtttcctagtgctgttgccattcaaatcccctcgattttttgattagtttgatgatgcagatgacgcatcgctagccgtatcggccgtcacaaccgtagccttaggtgcacccttccaagctgcgatttccgtaccgttgttgtggtcattgatgtattgcccaacttccttcgtttggtatgactttaccaaagccttaatataccacttcttagcatcgtcatgacgcgctgcaataatgttcacccattggtgtgattgcttgttgtttgcgttccaaacgtagatagctgagtttgggttgcgaccagctgcttcaacgaatgtggctgaaataacggcggcgtcaactgaattcaagctagccaacgtttgatccgctgccaattccttcacgtgcaaattcttagaacttgaaacgatgtcgcgaaccgttgggcttgtaacgccttccttgatcttaatcaagccagctgcctgcaacaagaacaaagcgcgcgcctcgttagttgggtcgttggccacagcaatcgtaccgccatctggaatatccttcactgacttgtacttatctgagtacaagcgaccaggtcccaaaaccgtctcaccaactggttgcaagtctgccttgtgtgccttattccaatctgacaagaaggcgtagtgttggaacgcattcgcatcaatattaccttgcttcaaggctgcgtttggttggttgaagtccgtaaaggtaatcaacttaatcttgataccgcgcttctcaccattcttcttaacgatgttccaaacggcttgatctgtcttagatggtgagttaattcccaccttcaccgtcttcaattcctttgctgatgccacaactgatgttgctgggataaccgcgccggccacagccaatgctagaactgcacttgtaataatcttcttgctcataatttccactctccgtttaaacccaattcattaacctatctttgatggctgtttatttggccgaataaacaaaaacccggggaccgtgtcttatgacacaatccccgggacgaaatgactcgtgttaccacccagttttcttattcagtcacccaaataagcttacacgtacgccttcaagctggactagtcgacagccgccggaaatacgttggcgctataacgggcgcacccggtaaccacttacagaacctgctcgcagtcacacactaactcagagaccattttcacgatttgccaatcactagctttcaccaaacgctagctctctgcagatttttcaatcgctactacatctcgtcttcgttgatgttgattatgatatgctcatacttttaatttgtcaacaatttttgtcatcgttttctaattttagttatggtacgctttacagaaagaaagttggaaccaaaaatgacatttgaagaactaactaatttagcaaaagaaaaagcaaatcctcgtgaactgacaccacattgttatgtcgcctccgtcgcatgtgcattagaaaccgaggacggccacgtgtacactggtgtttcaattgattcctcaagcagtttggggttttgtgcggagcatggtgcaatcgccgatatgattcagcataatgaatctcgcgttgttcgttgcgttgctgttcattacagcgggaaaatttatgcgccatgcgggcgttgccgacaattcttttataatattaatccagataacttggcaaccaaatttttattaccggacaacgacacgacggatttagccacgctattaccctacttaaactaaaaaataaggtgctcagtactgctgagcaccttatttcatttagtctatcaaaccatgctgcttcaaataatcacgggcaacatccccagcctttttatgctgaaccgtcacttcataattcatttgaatcatatcatcttctgaaattttaccagccaacttatccaagctcttcttaatgcttggatacttctgcaatgtcgcatcgttaaccaacggtgcaccttggtaaggtgggaagaattgcttatcgtctttcaacgacaccaaatcatcctgcttcaattgcggatcagtcgtataagcatccgtcacatcaacttgcttattggcaactgcctcataacgcaaacttgattccatcgtcacgaccttgctgaagttcaaatcatacgccttttgcaaaccagggtaaccatcggacaacttggcgaaatccgggtcgaacccagctgcaaattgggcatcaaccttcttcaaatcagacgtcgttttcagtccatacttcttagcgtcagccttacgaaccgccaacgcgtacgtgttttgatacttcattggttgcaaataatccaaattatcctgttgcttcaacaacttcttgccacgctcataagccgtgacggggtcatgtggaatatggccatctgtcttaaccaatgattgcaaaaccgttccggtaaactcaggataaatatcaacctgaccactcttcaacgccttatacaagaacgtcgttccaccaaaattaggctttagttgcaccttcaagcgtggattatcttgctgaatcaaatccttatacatattgattagaatttcaggctcaccacccaattttccagcaatcgtaatcgtgccggccggttgaacaattgcacgataaccagcaaccccgccaaaaatcacaatcaagctggcaattacaatgccgatacgctttagtgacaacttgcttagtagcttaataccccaagagaataccaacgccaacaaagctgacaagatagcccccaacaacaattcagcgttgttattggtttgaattcccaacataatgaaggttcccaaaccgccaccaccaatcaaggcagctaaggttgcggttccaataatcatcaccatcgcaatacgcaatcccgacataatcatcggcattgccaacggcaactgaacgcggaacagcttgaagcgcttcgataagccaaacgcatctgccgcttccaacaacgttggatcaatccccgtcaaaccagcataggcgttttgaaaaatcggcataatcgcgtacaacactaacgcaatgactgacggcaccgttccgatacccacaaacggaattaacgctcctagaatcgccaaacttggaatcgtttgaatgaccccggcgatttgaagcacccactcaccggcacggcgatgattcatcaagccgatagccaatggtagggcaatgattgctgcaatcacaatcgctaacaaagaaagcagtacgtgttcacgcaacgccgtcaatatatcgccagattgtgttgtcagcatgtgtaacatatctgctaacatccccacactctactttctctaaaacgcagccaaatactgcaacaaatcttgcaccgtcaacttggttgtcccattaatcaccaccgctggatgatcaaccagttgcttcgataattcagccaaataatcagttgcttgtaactgtggctcgtctcccaattcagtgattggttcaccaaaaccagcatccaaaatcgcttgaatcatggttgccggacgctcactaaacatcgcttcaaccagttcattcgctgggtgcgtcgtaacttccgttggcgtaccaacttgttgcaaaacgccatcatacatcacaccaatgcggtttcctaggcgcgtcgcttcactcatatcgtgcgttacaaagagaatagtggtgtgcaaatccgcgtgcaattccagcaccaaatcttgtagggaacgacgtgacaatggatccaaagcactaaacggctcatccatcaaaatgatatctggctttgtcgctagcgcacgtacaatcccaacacgctgttgttctccacctgagagctcatttggcatgcgatccgcatattgttctgctggcaacccgactcgattcaacagttcgtacacgcgttgtcgacgttgttctagcggtacgccagctgcttccaattgaataccggcattttgaaaaatcgtcatattaggaaataaggctgagttctggagcacatagccaatcccccgacgtagttcaaccaagtcgtactcaatcgcacgcctaccacgtacgtacgtatccccatcggtcggttcaactaatcggttaatcatcttcattgacgtggtcttcccactaccacttgggccaactaagacaaataattcaccgtcagcaatatccaacgttaggttcgagaccgctggcttaccttgataaattttcgagatattgcgaaattcaatcacgtctcttaccattccttactttttgttattgttgccatattaacgccatttgctcagattagccagacgctagtccgaaaaacagaaaagcctgaacgtgaagtccagactctccttctactttgcttcagtaattgccgtcttcacttctgcgaccgtacgaattttccctaagcgtgggaaaatcacctctactgaagcgtcgtgaccttgcactgtgcgatccgtcatagcttctggcacaaacacaaggttataaccacgttgggctgcttcacgggcagttgtatcaacaccaattgatgtcgcaatacccgtcaaaataatggtgtcgatgccacgacgacgcaattgcacatccaggtcagtaccgtaaaatgcaccccagttgtgtttgttcacaacaatcacattttcagccgtttcatcagttgcaatatccaatgacaaacgtgtcgcctcagctgacaatggttgcgctggtgtgtatggtgcatcagttacaggattaaatccttctgcaccgtcattcttaacacgtaccaacacaatttgagctgccgtattcttcatagctgacgccaactcgttgttgcgtgccaccaattgttccggcgtattaggcgttgcttcgcccttaaacgcaatcccatcatgcacatcaatcacaaccaaagctgtgcgtgccaaatcaagtgccaagttcatctcaaaacctcatctcatgctttcgtattagtggcctaagcttacaccagtttgatttagtcccgcaagtttggataattagttccacgtgaaacagcagttagactcaatcgattgacggcttcgtctagctcctcttctgaaaagattcccaacagaaatgtgcgttgccgactgattgtttcttctagttcgtgaacacgttcctcaagattcaccaaagacaaagctgcgtcctcaagtgcagtcgttactggcgcctttggcttcatcacgtcaaaaatggctggattatcggcgacgaacttttgtgccaatgcatcattgttcttcgcacggttccacagttgtgtgattcgttgcctacgtgccatcgaaccaaacattcccttgcccgtcagttcttccatatccatcatcaagcttaccgttgaatcttcttgcattgtatctgtattaatcgttggcattacgattaccatcctaaaaatatttttgcatagcaaaaacgacacctacaaaaccagtaggtgccgttatcattagcacctatccgttaccagtggagcaccttgcatcgctgtaggttgctgtcgggtcatcgtgtggtatcactcaccgaactcttgataggttatcgtattcgtatgtggctttagaatacatgactgccatttttccgtcaacacttttgtttggcagctgtggtaaactgacagcaaaagtatctggaggaaccaattatgaaagtatccgtaacgcttgatgatcaaggcttgttgcctgataagtatgccaagtttgcaccagcggaatatcgtttcgaagataatcccgttgttaatttcccaatcgccgttagcgacgtgccagctggtactgaaacactcgcgattgcattcattgattatgacgcaattccagttgggggcttcccatggattcactggacagtggcaaacctccctgtgggtgacgtgccagaaaacctaacgacatctgacgtgccatttgtccctggtacgaactcaatgtacagcattttcaagcacagcaagcctgaaattacgcaatcatacattggtccaatgccacctgatcaaacgcacgattacacattaacggtttacgccgttgatacaacgcttgatttgacgcccggctatttctttaacgaactccgtaaagacttagttgggcacgttttggcagaagccagcgtcgaattgccagctcgtagcgaataaagaaaaacggctgttgctcaacaaaatgagcaacagccgttttaattattaaattccaaaaatcaccagcaaaattgctgccatgacgaagttcacaaccatgaacaacttcatgaatgacttagatgagtctggttcaatttgacggaacacacggaatccaatcaagttggccattgaggcaacaaccgttcccaatccaccaatgtttgatccaataaacaattcacgcgcatgatcggtgaatgttgaaatcaagattgttgatggtacgtttgagatgaattgactcaagaagaacgttccgaatagaacgtgtgacttggtgtcaaacaatgagctaactagttcgcggataacttcgatgtgcgccaaattatttgtcgcaatgaagaagaaaaagaacgtaactagcaagccaaagtcgaccatcttgaacattgagcggttgtaaatgaaaaacgcaaccagaatcaatggcacgacaacattaaatggcgtccagccaaagattgttgcaaccaaaatcaaaccggtaatcgctaaaaatacaagtgagccatgatttagcttatcagctggcttcaacttaatttccaacggcgtcgcacgcacgaatcgcgtaatgatgaacatcaaaaccaatgacgccaacgtcaatgacactgaccacttgaaaaattgcccgacgctaacgtgatagaacccgtacatgtacaagttttgtgacttaccaaatgggaataagatagcccctgaattggctgccataataaccaatgttgacccgatgaccttcaatcgaactgaaagatcttttgccaatcgtaggtagattggcatcaaggtcaaaatggcaatatcgtttgataggaacatcgctccgaagaacgataggaatgtgacagaagtcatcagcgttcgcgcatggtgactacggctgaccaaccaaactgagacggcgtgcaaaacgcccgctcgttccaaaaagccaacccaaatcatcatcgacatcaaactaaaaatagtatgccaattaacagacccaaaatcaggtgttacaaagaaagacgtcccaacagcaagtatcatactaaccgtgaacatgacgtcatcttttagatacgtaaatacacgcttaatcatttgcttgcttcgctttctcttctaatacttttccgttcgcatttgctagccgaatcatttcatatgctttcgctgccataagtgctgttagacctgcggaaattaccatcgcaggaaccatagcaactgccaagcttcccgtcgttaattgacggccagcttgtgtgtgatgtgacatggtgtcatctcctccaaatagaaaaactcaacttatctattatcaagaaatcttaacgatttagcaaacattgaaatgtaacataaagccccgtgaaacctaggtttcacggggttaattgtttaaagtcgtacaaggacaaatgtctatttattaatatgcggtcattgccgaacttcacttgtaattaacgcataaaaagttaggaatatcgccgtaataatctttacaattattatgtctcaaatacgctacttaccaacaaaattcattagccaatcagccccgtaaagcatccccaaactatacgcaagtattgaaagtggcttaccaagcaaaatgatcaatgtgaattctcgccaagtcattttcgtcaaactcgttaacagaactaaggcatcatccggggcaactggtgcgaaaataagcaacgcaaacgtgatgtgccagcctttcgaatccagacggtgcatatatttatcaagcgtagcctcgctaacgaaaatgtcgattatacggtgtccgaagcgccttcccaaggcgaacaatgccaaagaccccaatacaataccaatataattgtacaggaatccccaccaaggaccgaacatcaacacaccggcagccaatgatacaccacccggtaacactggaatgaccacttggataatctgaatcaaaataaaaacaattggcgccaaaattccgtatccctttagcaattcaatcaatactttcgaattgctaaacgcgcccatctgataaagtttaaacacagcccaaatcgttagtaagataccaataacagacagggcttttaaaatccattttacgtgatataccttcattgccttccccccagacttaaattaaaccatgttttcgtggctttttcatgactcagtttccattattcgattatcagccactctttcatcagaaatatggggtatactgcagttaatcaatcaaaaagtataacaacgttacctttgggggaggataaatcaatgttagctgttctaaattttaaaaacttagtggattttgaacttcaaaagcaatttctaaacgatttagataatgccgaagttcaagttgacttaaaaattgcaccaacgctgccagttgataatgaccacgataaattcgaagtcatcagtcaaaatttgacaatcaaagagcgtaccgtgggtgaaatttcacctagtgtcttgcgttcacttggtatcacgacgagtttcatcggtcacttggaacgtcgtaagtcacttaatgaaggcttgttaatcgttcgcaagcgtctcgaaaatgctttggaaaacgacattaagccaatcatctcagtcggtcaatacagcaacctagaaatggttactgaagaactagacattctgcttttggatcaaaaaatcaccaagccaatcatcatcgcctatgaatcattggcttctactgaaatgggacgtgccctttattcaatcgatgaaattcgcgatgtgcacaacacaattcgcgccttcatgaaaagcaattacccagccattgattaccaattgattctgggcgggcacatggatgaagttggatcaccaatcgccagcgccatcggttatgacggtgtgctaattggtgaccggtaccacacactcgaagcattccaacccgtgttggacgtgctaaataatctcagccgttaaaaataaaaaccaggatgcgcagacatcctggtttttattttttagagagagtattgagtgagtagaaatatatcaaaatatttcccgtaacaaatcatctgtgaagattcacttgtggtcacacaactatcgccttcgcagataggcaccattgtcattcacttgaatttgaacaaaccccaaaaagtcaaagacttcaattgttcggttacaagtttggctcccgcagaagagcacgctcgaacgattggcaaagataatatagcttcccttttctcttgcacatcatttctattacgttatttataataaagacttctcgtgaggtttgcttgtaatttttttgttttttttaacaataaaaaaaacgtattaatttgtagggaaacgtagcttgattccacgctcttcttcaaacttttcaaccttcatttcgctcaaacggcgacgcaattgctcaaaatccaatgaggttggcatcgttggccagataaatgtattttcttcgggaatctgtgcatgattgatgtcagatatcaaaatatcagtgtcgtcatcaatgaattcagacacctcaacattcattgcccgcaatcctagtagcatatctgtcaaaatagcttcgagaccaaattgataattaatatctatcgcaactttaatctttgggaacacacggtgcatatcaaataccgatgaaaatccaacgtaaagaatttcaaaatacgcatttcgtgctgccgtcacatcaagttgacgacgctctgcaatatcatcaatcagattcaacgtaaaatcagccattaatgggaattgttcatacgccgcatcgaagcgcaccaccatttgtcgatcgtcgcttgtcggactaaccaccgcaccaatcaacgtgccgaaaaatacttctcgaataaggtcccgttcacgtgccgtcaactgataaccaaagcaatcatcataatgatggtcaaccaagcgaataaatccctcaatcatccccgccgctgatggtgtcaaattctcatagcgaccaacttcatacccaacgtcaattgaaaatagcgcaatcaaggcataacgtgcttcacgatgtaggtgctcatcagaaatatccggaacacgcagcttcacttgctgttcgaaatacgcaatgaggcgctgtgacttgtcgtttaattgatcatttggcaacaacaaatcatcaattgcatcatcttccacaaaatgacctaattgtagacgttcaagccaaatcgcagttgaaaatcgcaacgcaattcgcttactttgccgaatgttagtttcttcaggtgaaataattttgataatcgctttaatcgcttgatttgctagcgccaactcttcatccgaaaaaggaaaaatgcgatctgcaaaatactttacgaatagtcggaaatacactgcgcgtatttctgcctcgttccctgtcaacgtataatcctgcgtaattgtaataccgtgttgttcaaagaattcgtcgagttgtagtttcccattacgcgctgaagaaacggttgttaaattgcgaacagcaaaatcttcatatgaacgcatcgtttcattaaacgtctcgcgcattagttgccacggaattgattgacgcatgtactgcaacgcaaagacgtttgaatcaacgttacgattctgcgttagttcaatcattttttcatcttctgataatttaaaaaatgatggttcctcaccataaaattcctgcatatcatcaaacaagccacgaattgtcgatagcaccatatactttgaccaatcgaagtattcttggactacctttagtggcaatttaatctcaggccgcgataccaaatagcgtagtaactctactttctggcggtcctttttctcaatcatccactccatatttttctcaccctaaaaaattcgttattaactaaatatacaacctctgacattcaatgtcatgtaatcctcctaaattaaaaactgtccacgcgaacgtgaacagttttgtggattatatttacttcactttgtgagttagcataaatgccggaacaatcatcaaaacaacaaagactgtcccccaagcaaatgcgtattgatatgcacccaacaattgggctgtttgaacaatgtgatgtgcactgacaaagccagcaaccaatgtggctaggacagctgacccgaaggctgagccaacttgttgaaacaagttagatcccaacgatgccttacctgaatcaactcggtcaataccaacataagcatcggcttgaatggctgacttaaccgccgcaccaccgacaccgcgaacaaacatcacaatggcaattaaccagtaggcggtctgggcatcaaagaatacaaaaggcaacgtactaataatagtaagtactgtacccgtaatgacaacccaacgagcaccaatcgtatcgatcaacttaccaattgttccacgtgaaactagcatgccgacactctgtgggatgagtgataccgcagccataatgacgctttcgccacgaacatcttggaaaaagaggggcaacaaaatcattggtccgctagtgataaagccggctagtaggttccctagcatggcacctgaaaaattgcggtgcttgaaaagacgaagaggcaacactgccgtatttggataacgccaagcgtacaacacgtatccgattaaaataacgattgtcaacgcaccgaagccaacagttagattgttgttaaacgatcctttcgtactggcttgcaccgtaccataaacaaacgttactgaaagtgcgactaacaggccgacaccaaagccatcaaaattagcagacggatttttaggggcaatcgctggcaccttcttatataacatcaatgctgagattaaaacaattggcacattaatgaagaaaatccagcgccatgaggtcaattggacaatcaagccaccaataatcggtccagccattggacctaatgtcataggtacaccgataatcgacatcacgcgacccattttgtcaccgccaaataaatcaactagcagcgtgaacataaccggcataatcataccagccgcaaagccttgcacaatgcgcaatgcaatcaacatttcaacattgcctgataggccagcaagcagtgacgcaacaccaaatgcgatttctgaccagaaatagaccatcttgccggaaaagcgttcaactaaccaacttgaaaacggcacggcagcacccatcgctagaataaagccagtaacagtccactgaatcagtgccaggctggtaccaaaatcaatgcgcagttgattaacagcaatattcaccatcgttgaatccaacataggcgccatcgcaccaaggactaacaaccacgcaatgctaaccaaattagcaggtagcggatcgacttgcatcgtctttgaatggaacatatatataaaacctcgtttaattgttgtgagcaagaatcgtcgatttattcgacttttctttttgtttccttgtcaacaaaaatagatattaaacttattttgtttccttgtcaacaaaataagaacaataaaaaactgcaactcgtttaaaaccagttgcagcttcggtatctattcttttgttttcgctatttcagcatccaaaaattggctgtaagtttgggcaaacgcaatcatcttatcaatgtctgctgagctcactgcatcgaacactggcttgtcccgatcgaaaaattcgttgttcaacgactcatgaacttcattcacttcgcgtcccttgtcagtcagcgtaaagtatcgttcttttttgttttccggcttcttataatcagtaactagccctttttcaatcatcttattcgtgattttcgtaattgcgccacgcgtcatatcagaatattccgccaattttgtgacgtttgcatcgtctggatgattcgcaatgaactctagtgtctccacttctgggtgacgataatcagcaagtttttcgctcatcttcgattgattcaatccgactagcttgctcattaatgacatataactctgaatgaaaacgcgttgttggtccataacaaaaccctcctatacccttttcattataggtgggttttgtttccatatcaacaaacatctgccaaataatggctatcattttggttttcatcattcctgctgtaaacttgaagacagtatttttcaatttaacgtaggagaataagctttatgaaatacgttgcaatcgttggtagtaacagcaagaactcattaaaccgtgtcttggctaactttttggccaagcgttacggttctgatgacctatcaatcgaggttctatctattaataacttgccattttacagcgtggatgatgaactaacaccttcaccagaagttgtggcattcaagcaagctgttaaagaggctgacggtgtcatctggttgacgcctgagtacaaccactcaattccaggtgtcctaaagaacgccatcgactggttgtcacgtgtcgacaaggtcatgatcaacaagccatcattaatcatgggaaccacccctggatttttgggaacagtttatgcgcaaatgcacttgcgcgatattttgtttgccctacaatcacccgttttgatggggaatgatacgctagttggtgccggtcaccaaaagttaagtgacacggataatctcactgatgacagcacaatcgcctggttggatacggtcatgccaaactttaatgcattcgtagcatctcactaaaataaatgggcagggttaccaaattggtagccctgcccatttttgtttcacatgaaacaactcattattaatgattagtttgtagcacgtaaacaaagccgataaagacaactgctagtgcatacataattgggtgaaccttcttaccacgaccagttacgatcatcaagaatgggtacacgataaatccgatggcaattccatctgagattgagtaagccaatggcataccaataaccgtcaagaatgacgcagcggcaattgggaaatcttcccagttaacagcagcaagatttccagccatcaacacacccactacgatcaaagctggcgccgtcacgtgagacgtcacgacaaccaacaatggtgagaagaacaatgccaacaagaagaagattcctgtaaagactgacgtcattcctgaacgaccaccaacggcgattccagttgatgattcaacgaatgctgttgtaggtgatgttcccaacaaggcaccacccaacattccgattgagtcggccatcaaagccttaccagcacgtggcaattcattgttgaccaagaatccaccagagcgagcaattccaaccaaagaaccagccgtgtcaaagaatgccactagcaagaacgttagaataactggaatcatctgcattgtgaacacgtcgtgcaaaccgaagatggcttgtccaaacgttggtgccaaacttggcaccccggcaacaatgccagatggtgcaggaatcaagcctgttaccaatccaacaattgatgtaatcacgataccgataaagatagcacctggaatcttacgtgcgaacaacgcaaaacttaccaagacaccaaaaatcgttagcatcacttgtggattgctccagtcgccccagccaatgatcgttgacttgttggccgcgacaatcccaccgtcgaccagtccaatcatggcaataaacaaaccgataccacccgcaatggcagccttcaaatcagctggaatggcgttgataatcgtttcgcgaatgcggagaactgtcaaaatccagaagatgacaccggcgacgaatacgcctgccaatgccgtttgccatttaacacccattccgattaccacactgtaagcaaagaaggcgttcacaccaagtcccggtgcaatggcgaaaggataacgtgcaacggcacccataaagatggttgcaatcgctgcgattaatccagttgccgtgaacacagcccctttatccatccccgcagcacccaaaacggatgggttaacgaaaagaatgtaggccattgaaacgaacgttgtcgcaccggccaaaaattccgtgcgcatcgtcgtcccaagttcagacaacttgaagtagcgttcaaacatgaagcaaaactccttataaaatgtattcacttttctaaaaacaacttaactattgtcgcacattaaaacgattaacacaaaggttttgcaaacaataaataaaaagaggtcgaaaacgacctctaaacacgaacattatctctatttttccgaacattcccgttacttaaattgatttgttggaatgaaaccaaaaatgaacgcaatgatgttgaaaatgactcccaatacgccccaaaggaccacatgcttaacacctgtgtcgcgcacgcgacgaacaatcaatgcccacatcggaatgataatcaacaaaccaaacacaaccgtcgcaattccgaatggcgctgtccaccagtgactactttgtggtcctgccaaaaatcccaaaatcaacgcaatcacaatgttaataatgtacggccaccaaaactctgatcgcgttgaacgtcctgaaaagttaaaatagttacgccaaaaagctccataagcacccataattaagtccccctatataataatttctccatttgtaacattatcgtaacataaactcgttaattaaccttttaaaaagtcctgacagtcgttttgttcattaacacatactgttagaatagagaaagaggtatttacgatgtataacgaaaacggacagctgcgcaatttaagcagtcgtgaaacaggactttattttattgccggcttgctcttcaacgctgtcggtaacggcttaacagttgccaccaacatggggtcagcaccctggacggcatctgcagccaatttggccaacgcaaccggcctatcaatcagtgtgtttttgtttgcatacggacttatcgccgcgattctcagttgcgtccttttgaagagtattgattggccacgtgtgattggtaatttgctattcgtcttgacgtttagtgtcatcattgggtttgtctcatcattttttgccgcacaaggcatcggtgatttgccaatgcccacccgcttactgattgatttgattgcaattgtttcagtcggttgcggggtttcaatcacccagcgtttgcaattcattttgcatcccctagatgacttaacgaacttaacgcgtttcatgttcttcaagggaaacgctggcgtcgcgcaaattgttaatttcgccattccgatggtcatctcattggctgtttgggcctttactggcaacttggtagcggttaacatcggaaccttggtctcattctttttccaaggggtcgtgattggttatgccgataaaactgtttttagccacctagaccataaattaaagttaaataactagttgacactaattggtttgtccgtatgattagtatcaacaaatcaaagccgatttgtttattcaaatcggctttttactttccgcacccatacccataaagaggagacgctaacgatgcaccctgaaacgcttgtatcaccgcgccgtaattggcaagatttcacgttaaatgtcttaaatggtaatagcctcggcattatcattgctctgttaccacctgctttaacgagccaggtcttattacttttcggtcaacatccttgggttcgtctcatcacgatgatgacgaatgtctcacaaagtatgttgccaattattgctgcgtttgccgtcggttatttcctacggctcagtacgttagcgtccgcctcaatcggtctagcgagcgtcgtctcagccggtgtagtgacgattaatccgaacaacacctataccctagccggcaccggcgcgattttgaacattatgctggtcacgttcctttcagctttgctcgtgatcgtgttggaacctcggctcggtcaactaaaaattattttcttgcccactatcacattgttgattggtggtggcattggtttggcgactttgccttggatgattcgcatccaaaatgcaattggtaatgtcgttgcggtggcaacccacctttcacctttaccaatgggcatattcttaggcctagcgtttgcagccttgattgtttcccccatttcatcagttggtatcgcaacggcccttggcatcgctggcgtgggatctggagcggcaaacgctggaatcgtggctggtgcgctgacattagcctggatgagcgcttcagtgaatccaatcggtggcacaattgcccacgttatcggctcaccaaaaattcaaatggctaatatgttgcgtaaaccattactattcattccggtcatgattgctgccggcattgctggtggtgtcgccacactcttgtcgatcaaaggaacgccgttttcagctggttttggcgcatctggcctaattggtcccctaaccgctttacaagcatctgacggcgcctatatttggttgagactgcttggcgcgtatatcatcgtcccggttatctcagcttggttaatgaacgtgattttcgttaagaaaacgaagctcgtaaaccctgatcatgatttaaaaattccattgtaaacacaaaaacggtagaactcagcgttctaccgttttttcatatcagattatactgtgacagccaccgccgctttacgacgcttggcaatttcccatggcgtgtacatgataacccacagcaatgccaaaagtgagagcaccacagtgatatacaaagcaccctgtccaaaggcttgttgcaaaggctccaacggcgatcctggcgctgcgacgtttaggaagaaaaagttcgttcccaattgaccattcacccaaatgacaaacggtacgacaacagccaagaataatactggacgccataattcacgccagtttggcaccatttcgccactcaccatcaacatcattggataggcaatcaacaatgcatggatcaagaaactttgtaatgcccattgattcataattggatagtacgcccaatctgggaaaatttcagcggcgaaagctccccaaatcgttaaactatacaaaatttcgcgggtggttttgttaggatggatggcatccaccgcaatcatcatcaacccaaagccacacaaatgcagtggcaacaaacttggttcccattgaccagtcacagccaaatagaaatccttaaataattccatcgtccaaatggcaatcgcaatcccccaacgcatgtggcgacgacgactgtcagttgctgcagtataatagcggacaatataataaatcaaacccgccattagcaaaagcattgtgccatgggtcaatgaaaattggccaaacccaatgcccgttggaatcgatggttcataagtgaaataatacttaaacatccggttccccttcgaataaaaaatagctgaataattccgttacataacaatttaagctatgatattacataagattaatcgaaaattagggagaaacaatgaagacctacgcaattgtcggaaaccagttcgagggcctctacaccaagccatggtctgaggttcaaaagtacacccacacaaagccagcaccgaagtacaaaggctttgcaacgcgcgctgaagcacaagcttggtttgatgatcaaactggcgcctcaggtgatttatcacgtaaatacgaaacagcttacgatggtaaatttgatgcaaaagatgaatattattacatcttcacagatggtggtagtcgtaacacaggcaatgtagctggtggtcacgtgcgtccaactgacaaagctgcttgggcgatcgctatttaccgtggctcagatatgcagacacccgttttctcagacagtggtgctttttacggtcgcacgaacaacgaaatggaaattctcggtctaatcaacgcgcttttgcagatggccaaagttcctgaaccagtcacgattgtcagcgattcaaagtacgttctagacactgtcacagattggatgtacaactggcaatcaaaggggtggcgtaaagcttctggcgaaattgctaacttaactgcttggcaacaagtctatgatttggtgcaacaagtaaaggggcgtttgtcattcatctgggtaaagggacacgcaaccagcgcaggtaacattctggtagacaaattgcttaacgaagcaatggataatctcaaataattgctaaatcatcgtcattattgacggtgattttttattttatgtcgctctaaacccttgatatgactgttttgtgaaaacattcactaccgtctttataaaatctaaaccttttgttgtgacgttcttcacaaataacaattagttgtttgtatcatacatttggcaggtgtttttgaccgtgtcttcagccgataatttacctaccgttaccggcaatttttgcagcgttttttctttaaaatcaccattttcggttagtacaccaacacttttcaacgtataaaaagcgccatagagcttaatcaatcgtttcatcttggcaacaatctgttcatcagcccctaaaacatcgaatccagatcgttcttttggttgttcaccatcatatacagtgcatgatacccgttgtgcgccaactttaaataccatatatgccatggttattcctccttgaactccgatgcgaacaaacatttaacttcatctttaaattttaaatcaacaatgttactagtttgtgaacttcacaaagtcgctttttgaacatcaaactaaggggtgatttccgtatacaaaaatacgtttcaatatgcataattttgcatattgaaacgtattgccgtcttattatttatttaataaattttccaaagttgttaaaactccgtcgtggttattatcagcatccgcaacagggtaggttgcaattaaagttttatcaccatttggcatggcaaatggacgcttcgcttttgccaacatttcagcatcattcaacccatcaccaaacgcaaccaaatcttgctccaaattaagaccataatgcttggcaacatacgccaacccattagccttattaacatctggtgccacaatatcgactgatccgtaacccgaagtggtcacgtgggcgcgattacccaacgcgtcacgcgctgcagcgatgaaatccatcatttgatgctcagcatacgtaatcgtcaccttcaaaattggttcgtgaatctcatctaatgaatcaatcatcttaacatttgaaaacatcatcaaaactagcgattgatgggccaagttcaaacgaccttgatcgcgcaacatatacaccgcctcatgaccagtaaatagcgcgccttgacgtggatcaaatggtaaatcagccacaacttgcatcattgtttcaacttccgctacagacaacccggacacatttagcaattcgcctttagccgttcgaacaactgcaccgttatcagccacaacatcatatcgaccaacaaatggcttaaattgcttgtggatttgctcttcatcacgaccactcgcaatcacaaaatgaccatttgtcgcttcaagtcgctttaaaatttggtcaaaaaagtcctcgttaatcctttttgtatcactcaaaaacgtcccatccaagtccgttgctaccaaatcaaccttcgtcatgatttcccccgtttcaattcctatgtttaagactattgtatccagaatgcacataaaaagcaccgacaaaatattgtcggtgcttaatttctaaccaatgataatttcttcagttgggtattggaagctcgttggcttttcacgaatattcatgaccgagaacataaccgtgtacaaaccaacacggccaatgaacatcacaatcataatgaccaccttaccaaaatcagtcaggtgaggggttagacccattgaaaaaccagttgttgaaaaggctgaaatgacttcgaagacaatgtattcaagaccttcacccttaggaattgattccgtgatggttagcaacaatgacacgccgaccacgaatacgctggatataacagccaacatcatcgctttaatcacaattttttggctaaaacgacgaccaccgaaattaaccgtttcctgacctctgagggctgccattgactgcaaccataaaataccaagcgtagtcgttttaataccaccagacgttgatcctggcgttcctccgacgaacatcaacagcatgataatcattaaaccagccgccgaaatcgaactaagtggcacaacttcaagtccagctgttcgaggaacaaccgctaagaacagcgtatccatcacgcggtgaccaattgaagtcgaattagccaacggcgccaagcctttttcggtaaacaagaagaataagaatcctaatccggttaaccacgctgagacgtacaacgccacgcgggtgtgcaaactcaatcggcgttgcttgtggaataagagcaaatctcgccaaaccaagaatccaagtgaaccggctgaaattaacagcatccagaccaataaaatgtatggatcattgcgcaaaaagaatactggttcatcgaaaaatgtaaatccagcattaccgaatgccgaaattgacgatgcaatgctcaaataaataccgtgcgtccagccgaagcggggaataaagtccggcatcatcaaaacagcgccaatgacttggatgatggcagatagcgagaagacatactgcagcacactcttaacatccgctaaattacgcagattcaaagcctgttgtgccatcaaacgcgctttcaaatccattcgttgcccagtgattgcaaataacaaaaccgcaaacgtcataaatccaagggcaccgatttcaatcataatcaatagaataatctggccgaatagtgaccaggtggtcgcggtattcacaacggtcaaacccgtaattgcggttgccgacacggctgtgaataacgcatccataaaactaatatgaacaccttgttgatgtgaaattggtaatgtcaaaatcaaggcgccgacaaagataattgccaaaaaacctaacgttaagacttgtggcggtgttaaaccactgaatcgttttttcataatattaagtatcccccaacttgatttattatacaggaagcgtgatgaaggttttacacagaattttgtggataaataggggataaccgcatgcttttccccacaacctgtggaaaacttgtggataaaatggccatttgtgcaatgaaacccactatccacgggggaaaagtcagtgtggaaaacctgtgcgaaactaattgttacatgcaatacccctaaatatgggcatttctgaagtgttgttaagtttaaccttaatgaattttagagattttggtagctttctgaattcacatgccaaaatgtacgccttttatcgacaaatatcacgattttcatgtatatgatgctaaatcatcctgttttccgaatattacaaacttacatccttttcatactttgtattcaattatttcaggcaaaaatggggtgtgcaaaactgtttttactccagaattttttgtggcttaaattgtgaaaaattatgatcaaatgccgagtttctaacgtttccagagttatccacacgatttttacacatctgtggataaatgtggataactatccacgtaaaccctatgaatctttgatataataacgtttgtagccaattcacaacctgttagtaacatgtggaaaaggtattaattgcaatttgtttaaacagttatccacaactgttaaaaactatgatgaaatcaataaatttcttaagaaaggtttaagacggatgaatattaaaatcattggtgtcggaaaattgaaagaaaaatacctgaaagatggtattgcagaatacgcaaaacgtttgcaaaagtttgcaaagttcgaaataatcgaggttcccgacgaaaaagcacccgaacaattgtcacaggcccaaatggaccaagttatgggcaaagaaggcgaacgcatcctatcaaaaatcaaggataaggaatatgttttcgccttggccatcaagggaaacgaacgtagcagcgaagaacttgctgccgaaatcgataagttggctcttcgcggtgattcggatatcactttcgtcatcggtggatcactcggtttggcgcctgaagttttgcaacgcgccaatacacaaattagttttggccgatttacgttgccacaccaattgatgcgtctggttttaactgagcaaatttatcgtgcgtttatgattaacgctcacagcccataccacaagtaaatttagaggatctgatcatgcccgagaaaatcacgattacgctatccgaagaaacagccaacgctttgccagaattgtttggtacaactgacttatctactggaattgccaagtaccttgattccttagtcgaaaacactaaagctcctaagaaaccagcaaaagcgcaacaccgttttaagcaagactttgcagatgtgccattcttcattgattacaacggtgcaaaggcaaccgttacttggcgcaagcgtgatgaaatggtcatcgctgcgggcgcaacattgcaaactgatatgccactgaacaaagatggatcagtcggctttgcacagcgattcgctttaacattacgtgaagaacacgctgacgccatttctaatggtcacactactaaggatgtggtcttgaagagtgctaatgaagtcggccatttcctgtactttgccggtacaaacacttggcttcagctaaaagatgctcagggcagaactttaaacgaactttcacgcgcttagaccacaaaaatagacgaatcgcaattgcgattcgtctatttttttagatattccttgttaactacattgatacttgttgatatacaggtgccggcaattgatatgccactgtttcttccgctgagccaacttggcgcaaatccacattttggccatcattggttgtcgcaataaaatcacaaatggctgggtcgtaaacaaactttgcataatccaatgtactatagctaaacataacgcgttcctccatttggttcaaaagatgatttctgctattcaatgatttaatcgtagtttgaaagccttaaagaaatttttgatgaaactttttcaaccttaaacgagcactttattaaatctgttttttaatagctgtgacaaatttatcgctagtgatttccgagtatgtatgttgtaattgcacatatctttacaatctggaaagtagggcaggcttatggatgaaacgtacacgttcaaacgtggtgtattagatgctgcaccaaccatgttagggtacttgagcatcgggttaacggttgggattctgggcgtcagtgcgcatttgccaatttggttcattgttggcatgtcaatttttgtttatgctggtagcgcacaatttttaatgaccagtttggctgcttccatggcaccagtatctgcgattacttcattagtatttctagttaacgcacggcacttattgatgtcgctatcggtggctcaaaaatttagccatcaatcattgccatcagccatcggcatgggatccctgttaactgacgaatcctacggtgtgtttgctagtaatcataccaacaccaacatcacggttagctggcagcacggtgtaaatgtctcgtcatatcttgcgtggattattgcgacattcgttggggccttttttggtcaatttattccaaacccacagcaatttggtttggattttgctctagtcgctatgtttgcggcgctttggtattttcaaatcgatactgccaaagtcatcacaactcgtcgtttaattatcacgactgtcggtagtacggttttgatttatctcatcatggcaccattttttggcagtgctagtgcagtactgattgcgactgttattgctgctggactaagtgcatatttgaatgctaaacgcccaggaggttttgtatgacaagttattacgtcattgtgttaattactgccggattagctacctggttgcctcgtatctcaccatttgttttagttcgttttggtaaattaccaaactggctacaatcttttttagcgttcattccactaagcctgatgacagcgttattttttgaaaatctagtcgtgattaaagcgggacaactacctggcattaattggttagccgttttcgcaactattccaacattgcttacaatatggcgaacgaaatcaattatgtggacggttttagtcggtattatcagcatggctattttgcgcgctatttaaaaagcaggcggattttaatgtccgcctgcttttataatttacagcttagtattatttcctgatctgcctgcttcaaaaacgcgacaaacgcttctgcatcgactgctgcagccaaatgaacatagtgtttatccattttcttcagcaattcatagggtaatataactcgcttaccttcagtttcatagtataggttacccggcactaaatcacgtgtcgtcaaatcatctgatgaaaaagcttctgccaaatcgccttcgtacaatcgcccataatgatctaacatcgtgactttcaacttctttttactcactaactcatcaatcacctgactatctgccagctcaaattcaaatgcctctaaatttaaatgcatggtcacattcataatgtttacctcattcactatcagtattaagtgacgtgattgtagcatcgttactcacctggttacctttgtgacaacttggtacttgaattccttaaccttttttgaaaaaaagcggtcgcacgttatcgtgcgaccgctttatctttatttcgtattcatcttatcttccaaacgactcatccaccaaccaagccacgttccaagtgctagcagtaacgctgaaatgacaacgtgaataatcgtaaagtcgttaaaatcattcggcacaatcatgattgttgacgctaaaacaattccaaaaataccgtggaataatttagcatacgcaaccttgaaaatgtaagccatgaactttgatagtagtgcaatgatggcaaacaatccaatgacaattggtaccaaaacacttaagtcaccatgcttaataccgtcactcatgcctttatataaccctaagtaaatcaagaaattggatgggctcagccccggcacgattaagcccagaccaattaaggcacccgctaaaatccaagcaccaaaacttggctcaatttctgaaaagagtggggcaccaaacagcaaaaatgccaacatcgcagcaaatgccacaatcataattgctacatcgactttggtacgtccttccttggcagcgtcacgccacaaagatggcaacgtcccgatgattgcacctacgaagaaccaaagggcaacgctttcgtgcttaccaagcacaaaactaatcgcaaaagatagcgcaaaaatacctaaaattgcgccgataccaactggcaagaaaaagaaaatattttccttcaggcgcttaaatgggtgcgccaagaaattgataattcgctcatataatccaaatacagcagctaatgcgccaccactaataccgggtaggataaacccagatccaatcagtgcacctttaacagcacggaagatccaatctcctggttgtttttgcatgtcgaaacctcatgaatttcatttgataatatcaattctaactgagccccacagcgacaacaagctgactggctaatctgttgtcatcttgataacaaatcgacatcatatttcggctagaatagcctattatgtaagaagcaaaccttttattctgaggagaatacttatgacgacttatacccgtcgtgcgcgtttgtcagatttagacgccattagcacaattattgaccatgcgattgcctttttggccgagcaagattcaccacaatggcaacatggggatggtccttctcgtgaagaatttgaaacggctattactgaaggcattgcttacgtgcaagtttacgaaggcaaggtgtccggcatcgccaagttgattcctggaccagaaggaccctatgaagaaatcgatggttcatgggcaggagatgctacgcaatatatgacgattcaccgtgtggggatggacggcaccattcgtggcaagggacttgcgcaacaattcctacaagatttgctggttatttctttggagcaaggctttaatgatattcgcatggacacataccctaagaatgtcattatgcaaaaagttatgactaaccttggcttcgattatcgtggcatggttgaaatgccagttcctcacggtgagcgcatggcttaccaactcattctggactagcccttttgcaaccactattttaattttctgtgctattatttgcacaagaaaatgaggtggtaacaatgacaaatgtactagtacttggtgcaacgggaaatgtcgcacagtattttatcgataattttgaaaacgtcgcgccaaacgatatgcaattgacattgttagcgcgtcgtccacgcggtctaacgcgtgaccaacaaaacagctaccaagtctttcctggtgacatgtatgaatcagaaagcttggtcgacgctgtccgtgatgccgatattatcgtcagcttcgtcggatcatcaccaatgccaacgtacgcgcaagccctattggatgcgattgaccaatctggtacagatgttcaacgtattttgtggctgggtgccggtggtatgaaccaagaaacaactggtcgtgaaggtgaactttggaaggcgatgcctggctacttcagccagcaacgccaagccggtgagatgttgatgaattcaccattcgatactacggttatcagtcctgttatgttccatggaggcgcggctggaaaggcaattatcacagacagtcacgaaaagacgcctgcgcaaactgtttcacgtgaaacagttgctcttgtctacttggaagccttgctacaagataagtggcacaatcaaatgattaccgttggtgatcgtaaataagcaaaaaaattggcagctcgcaaacgcgaactgccaatttttatttttacaatgtttgttgcttacgctttgaccaaagtgtatacccagcaatcatcaaaataaagaagatgattgtagcgataactgagacttgcgttgcaggatccaaaaccaagataaccaaaactgccaagaagaaggcaatcgtcaaatagctcgttgccgggaacaatggcatcttgtatggattagtttctgatgcagtcgtcttcttgtacttgatgtgagccaacataatcaaaatccaaacgaagataaagctaattgttgccacaccagtaatcaaaacgaagatttgtgatgggaagaagtagttcaacaacacaactgccaagaagatgattgatgatgccaacataccagttactggcaccatgttcttagaaatcttggccaatgagtgtggtgcttgcttgttctttgccaacacatacaacgtacgtgatgttgagaagatagctgagttagcagctgacaatgctgatgttagcacaacgaagttaactaaatcagcagcaaacttaattcccataccagcgaacacttgcacgaaaggtgattgtgatgtgttgatgtcattccaaggatagattgccatgataattgcaaccgcaccaacgtagaacagaccaacacgaactggaacggcgttgattgcctttggcaaatcacgctctgggttttccgtttcaccagcagtcaaaccaaccatttcaattcccgtaaaggcgaagattaccattgggaatgccatcaagaatcctgagaaacctgtggcaaagaaaccaccgtgatcaaccaagtttgcaaagcttgccgtgtgaccaccagtgtggaacccagttgcaatcaagccaagccctgcgacaatcaacgcgataatcgcaataaccttaatcgatgcaaaccctgattccaattcaccgaaccagcgaacattcaccaaattcaatgctaccaagaccacaaccacaatcaatggggttagccattgcggtaggaaggggaaccagtaacgaagataaattccggttgctgttaagtcagccatggccaaacttgcccaactcaaccaataggcccagccgatggcaaattcccatttatcaccaagatattcacggacgaaatcgatgaatgaacgcatcttagtatttgatagcagcaactcaccaaccgctcgcatcatcaagtaagcaaagatacccgtgataatgtacgccaggataagcgatggaccggcggctttaattgccgttccagatcccaagaacaatcccgttccgatggcaccaccaatggcgatcatctgaatgtgccgggacttcaaaccacgtgacaattcacgttgctcattttgattttccataataaaccctcactgcatggggtataaaaaaagtccccatgccaaattaaatttgacatagggacgttcattaacgcggttccaccctaattctcaatcaattatgactaagcaacttaattacggtcaattgaaaatctctccaaaagcgccatccccaacgttaacacactcgctttcaccaaccgcgagctctcttaagtcgttaacttcagctgagaacctctttcttcatcaagacgtcaattaataatgttaactataataacttcttatttattagtcaagctttccggcttatttcaccttttcaacgagtgattcaaagtgctttacatcaacactctcaccgacaacggtaagcacatcgccaatttgaatcatctctgaagattccggcgctacaacaactcgtccttgcgacttaatcgcaataacattcaatccgtaattcttacgaatgttcaattccgaaattgtcttattcgcaaacttcaaattggcaatcttaatttcacccaatgaatgcttgtcacccaaatcaatatagttaatcaagttaggtgtcatgatttgttcagccaaacgttgcgccatttcgtgttcaggacgaacaacttggtcggcaccaaccttatctagcacacgcgcgtgcaaattgttttcggctttcgcaacaacgtgacgaacacccatgtccttcaacaaaatcgtggttaaaattgaggcctgttgattgtgtccaatcgcaacaatcacgtgatcaaaactaggtaagtccaaatcacgcaacgcatcttcgtcttgggcatcagcaatcacagcgtgggttgcgacatccatgtagttttcaaccaacgttggattgttatcaatcgctagtacttcttgatcagccgcaattagagattcaagtaacgaaccaccaaatctccctaacccaatgaccgcaaatgtttgtttcatacctaataaccattccccaaatatatttgttgttttcattttaacacttacatatgcaattcctaaacttcggaattgagcttgcattaattcttataatctgcatagaatggtaaaagttaaattgtgaactttctgtgaattttcacaatcgctattatttcagggttttattttattttttaggagaacaatatgaagtatgagtaatttatcacgtactgccgttttgttttcaacagctgtcttagggggagcgctgttaacgacatcagttaccagcactgcaactgtcgcatatgctgccgaaatcactgcatcaaatttgtcatttgatatgaccaactcactggcacaacccgttcaaagtacatctgttgacgagcgggggactaccggtgaagagtcaacacacgcattgcgcattttgcaagctgacaatgatgaagagtcaatggcagctagttatatgctggatacggttaaaataagcaaaaatgaagatggtacttactacgcttatctaacgactcacacaccagcaattatggggaaaactccaattgactttacggacacaaatcatgcagctaagttattgagtaccaatttagtggataactactatcaatcggtgttccgcttaacattgactgaatctgaaattaaggcacccattactaccaacatccatgtggattttacctctccacttgtctatgaccacagatacgatattcgtctagttgttgggaaacaattatctgatgaaacaccaaccgataatcaaaatactgatacatctgttagtgataataatggggcgatttcagattcaagtacgacagcggacgctaatgtattgcaagatggtgtttacaaggtgccatttactaattacaaaactggtacgacgactgcttcaagtatgaatagatccttgaagacgccggccacaattactgttaataatggacaagctaatatcgatattgaaactagtaacgaaatgattatgggcatgatgtctaactaccgtttcaatgatgttaaagcaaccgctaagggcacgcactggttggttactttaccggtcaatgcattaagtaaaacgatcgcaactagcatgaccatttcaatgaacggacgcgtcatcgaaagcccaacggctgatatgctgtttgatattaagaacgcaaccctcactaacaatccatcaacagttcccgaggttcctgattctacaacatcagacaagccggtcccatctcaaccagcaacaaaacccgcgaaaccttctacggatgttactgatgtagaaacagattcaacccgtagcttaagcattttgcaagccgataaaaatgataagtcaatggcagctaactatatgctagacaccgtcaaactaaccaaaaatgctgatggcacgtactacgcttatctaacaacgcacacaccagcaatgatgggccaaaatccaattcgttttaacgatgcaaaacacgccgctgagttaatgagcactaatctagtgaacggttactatcaatctgttttccgtctaacactaagtgaatctgaacttacgacaccaatttcaactcacattcacgtgcaatttacatcaccacttgtttatgacgaaaactatgagattcgtctggttatcggtgatcaattgtctagcaacgcatcagttaacaatcaaaatgagctgacagatacggtaattgttccacgtgaaacagcaactacagcaacaccgtttgagcccgcaccagttacgttcactactgttgcatcatccgtaccgatggcaccaacaccattggcagtgactcatccaatttcgtcaccacaaacggctagcacctcagaattagcgacatctgataagacaatcaaattaacaccggctaagaagcaaactgtttctaaaaataaaaatgacaagtctacatcaaagtctagccaatcagacgcacctaagcactctaaaatcacacgcgcaacaatgattacagctggcgttgtgattacggcgtcagtcggctttgttggtgcttcgcttgcacttaacattttcaaacaccaatagcatttaaatcacggctagataactagaaactggcgctagctgttgctaattatcatgtgcttttcggtgtgctttaaaaaaataatctactgataaaaaaacactcctaaaccttggagccttccttgtttcgccttgaaatttctgcatagaatgacttatgttacggcgtccgctttattcgaatgatcgtacaaaagaacacgtggaagtgtattttaaggttaggagaaacgtatttatcatgcatcatttatcacgaacggtaatgttattttcaacaattattctgggcggaattgtgttgacgacaacatcactggacggcagcgctaacgttcacgcttcagaaatttaccaaccagtttcaaattcggttgatgcttccaatttaaaacctggaatatatgacgtcactgtgtacaactataatcacagaacgcattacacaccgggcgataaaccaattcctggtcgaacaggcttcggcactgaatctgttatcgcgcaatactttaagtcacgacaacaagtaacaattaacaccgatggaacagcgacaattaagttccagttagatcctagcaaaaagaaactggcaactttccggcactatcaagttggtcctgaactcatcgaggccaagtttgatgagcaaacatactcatatacaatcacgatgcccactaaacaattgaacggtgtcattaatacacttgtggattacttacccgctggattggacccaacatatgcaaaatttatgaagccattccgttctgatttatattttgtttggtcatcagccgaaaagacatctgtaacggataacggttctggaaaaagcgattctgtcagtccactaccggatggtgtttatcaaatgccaattaatcactacaagcctgggacgaatcaggcatcaatggtggcgcaatattataagccgactgctactgtgaccgtgaaaaatggtcgtgcaaccatcgatacataagaagtaagcacaccagctatgaaattgtctgactttaccatcaatggtgtggcggctacaaagtccggcacccattggtcagtgtcattacctgtaagcgaattaagcaaggcgcttaatactaaagtaacgctagttattaatgatgccgttcgcatgcctgcgcaaacagacttagcgcttagcctggataaggcagtcaagattaatgacagtaagcccgattccaagccgattccgcccatctcggaatctactcgtgagttaaacatccttcaaaaggatagcaatgagaaatcaatggccgccacttacatgctgccaactgttaagctagcccagaatgctgacggttcttattacgcatacatcacaactcatacaccggctatgatggggcaatcaccaatcactttcagcgatacaaaacatgctactaaagtaatcagtaacaagttagttgacggttactatcaatccgttattcgccttacactgacagaagcggaaatttcagcaccaatcgcaacgaatattcacgtcgaatttactcagcccttaacttacaaggaagattacattattcgtctcatgattgggaaagccaacgatactgataataataaaagttcttctagttcttctcaatctgctcagagcaacggttcttctagctctgagaatgctaaaagttcttcccaatcttctaaaatcagtagttctgctagttccgagatgactaacagttcttctgaatcttccaagattagcagttcttctagttccaaaaaggctgagaactcttctacagcgccgataacaaagcctgacacaccaaagacggatgtcaccgaggaaatgcgtcgtttaactattatgcaatccgataatgacaagccatcaatggcggccacttacatgttaccgacgattaagttagttaaaaatgccgatggatcttacttcgctttcgttacaacgcacacgccagaactgatgggtcaatcaccaattactttcaatgatgtagcacacgatgcgaaggttatcagtactgaattggtcaatggtttctaccaatcagttatccgtctaacattgtcaccatcagaattatcagcgccaattgtgactaatattcacgtgatgtttacacaaccaatgtcttacgacaactattacagcattcgcttaatcattggcgataacgcggacgcaacttccacatcagcaacaagtaatcctgttgctgatcataagccaacggttgtagcgccaaacaccgccattagtaccgcgggtacgcctgacacaacgtcatccagcaccgcggcgtctgttgcaagcatcgcgactacagatgccaatgccgtaacctcggcgtcggctgatgtaatgccacaatcagccgttatgacgccacaacacacagtagcgactacaaaccaggcgcaatcagcaactcacaagagcacatccgagaaaaaacaacctaaaattcatgtcgcacaaaagcaactgccaacgaccaatagcactaaccatcaagcacaagttacggtgactgcgggacattctaagatgaatgccgttatgattgcccttggcgcttcgattgcaactgctattggttttgttggcacatcgctcggcctaaacgtctggagaaatcaccaaaataatgattaaaaaaatattgattactgtcgcgcttagtttaactgccattttgacaccaacctattttgttgctgcagacagttacaccgttccaatgcaaattttagagaatggtacaaataaaacgtcttacgcagcggcttattttgccggttcggcaactgttacacccagtgataatggttatgccatcacctcaacaattaccaccgataccagtttgggaaactatccggtacagatgctaagtgttgatggtgctggtgtttcaattgctaagagtcaagcaggaaacaatcaaacaattacctatactttctacacaaatgacctggcagctcgtcacaacgccaacattcgtgttgatgttgataacattaactatcaccacaattacacagttgggttagttgttgatggatcatccgtgccatcaacacaaacggcgacagttgcttcagaatctgtcgcacaaagtagtcctgctgcgtcaagcgaggctggcacgtcacaccaaccaagcgcaaccagtgtaacagtttcatctgagagttcgaaaattacctcaagtagcgttgagacaagtgcttcatcaactagcagttcggtagcttcaaccagttctagcgctaagaaaaaagccccaacgactaaaaaagaggtgccatctaagtcagtaactcgtgaaacacctttgccaattgcggctatcattggtggcggattagttattgggattgccagtgcaattgccctaaatctactaaagaagaagtaaactatgtcgaaaaaacaattaactggattaagtatcctatttattattctgctcgttttagccggtggctggatatggttagtgtcgcaaaatcccgctaataccacgtcatccccgacaaaacggataattgtcaccacaaatgcgcaagctcaagtatttgatcagttagccatccccttagttggggtacccacacctggtgagcaacaaacattgccaaaacgatatgcgaaattgcctcaagttggtaatcacgttgcaccgaatcttgaaaagatgtcatcactaaaacctgacttggtctacttagatagcgcattagttgatgactaccagcaaaagctagccagtgatcatattgcgacgcagacattagatttttcaacacttgatacgttaaaaagcagcatcacaactgtcggtaagcaatataataagcaaactgaagcaagtcagctagttaaacaattgacgattaagccagttaagcagtcgtcacgaccaaaagttgcactactcatggggatgccgggagggtctttcttagttggtacgcaactcagctatgtcggtgacttaatttccaaggctggtggggatgttattggttcaggcgactcagcgtacaccaatttgaacgctgagcaaatcgccgctgagaaccctgatgtcatcattaccatggcgcatgcaatgcccgacaatgtttttaaaagttttgatgctttgtttgcgcaaaacaattggcaagccattaaagctgtgaaaaatgggcatgtctatcaagccaaagaacccatttttggtatgacggccaatctaaatgcgccaaaagcttttaaccaactcaaaacttggttagacaaatagaagggatgcctatgaaacatctttataactggctattgcttagtttgctaatcataagtgttatcctcgctttgatggttggtagtactgacctgccagccttttcaaacagtgaagcctggcatctcatcataacttaccgattgccacgcattatcgtgagcattatcggtggcgccattatcggcgctagtggcttgttactacagctcgtcttacgaaatcgatttgttgatgcctcgatcttaggcatgatgaatggtagtcagttttttaccacaggccttttggttttagtaccgagcgtattggccaataatgtcattttcggcgcactcgccggtattattatcatgattggatggcgtttggttatgccaactaatcggggtaacttgcaactcattttaattggtattgcaaccgcaatgacttttcaggcaggcacaagcattgccagtgaaggctttggtctgccattacccacgcttagcaccgtaacttggctacaagtcatccaactaaccattagcggtttagttggtagcatcttattacttttggtttggcatcatttaaaatatttcgccttatcatcccagcaagttcgccttctgggaatcaatgaatcacggacaatgtggttcgtcctaattgccatcggtatttggattggtgctctaactagtttaattggcgtcgtctttttcttgggggctattttgccgcaaatcgctcggctgatggcaccaaaagcgaaaacacaacaattaatcgtttcgaccgctttatgggggagcttattattactaaacgccgatacaattgctcgaaccgttttggcaccaaaagaattatcaacaagcgcggtcttactcgcaattagcggtccattattcgttctaatgcttatccgaggtggccgccatgcttaaatttaatcaagttttattcaatcgaaatgataaacgtattctgaatgatatttcagcatcaatagaaccccatcacattacaacattgattggaccaaacggtgctggaaaaacaaccttgctacaattaatgaccgatgacttacagccaacggccggctttatcacagagcgcccaacgaagattgcgttactcgcacaaaagaacgaattgtttgaaccactgaccgttcgtgatctcttaacaattaaacaaccagacttagacaaccgcatcatcagtgatttacaactaaaaccgctgcttgatcaaaatatgatgacgctatctggtgggcaacagcaacttgcttggttggcctttgtgcttcatcaagcgccagatttactaattcttgatgaaccaaccacatatttagacttgcagtaccagcaaatctttctcaaaacattgcgacgcgtccaaaaagagcgccgtttaacggttgtcatggtactacatgatttaaatcaggcgtttacttacagtgatgccatttggttactcaacaaatcgggcgaattggcaactgctgacaagcaaactttgctagatgaggccaaactttccgcggctttccaaacgccactcaaaatagtgtctgtggatgaccaaacattaatcttaccggtataaaaaaatgcgactagcacgtagctagtcgcatttttaattacttctcaaagaaagtcttccattgtgtgttaatgttggccttcttttctgcattaccccagaacggcaccttcacaacacctagaaccttgtcttcgctgacaaagccccagtaacgtgagtcgtttgagactgtacggtgatcaccaagaacgaagtattgtccctttggcaccttaaccgtcttttgacgttgccaacccatgtggtcaccaagttcagtcaagcttgaccagttaccaacgttgttaaccgtattcgttgccgtttgctcagattcaggaatgaaatcttgatcaacaaccttgccgttaaccttgataacaccattcacagcgctaactgtgtcaccaggcataccaattacacgcttaacgtagtccttgtgaccatcaacttctggatcttcaccataagcatcaaataccacgacacttcctcggtgaactttgtctggcttcaagacaaatacgcgttcgttgttcgtcaaattgggttccattgaagttccgtcaacacggaccaacgtaaaccagtaagacttaatcaagagcgcaataattaatccgatagcaatcggaataacccaagacataatctcgcgaaatgctttcatgggtgttctcctatcatatatgtttcttacccataagtttagcacacctaccatgaaaaattgtcccaataacaagcgcctttacaaaacgttcagattttttcaaggttcattcactggtagcaaaaaagacaccgcaataattgcggtgtctttaataattagcgcttgtgaccacgctttgccttacggatggcgcgttcgcgatccttctcggcacgcttcttagcttcacgctcacgacgaatttcaaatgggttttgaatcgtccatgtttgtgcaacttggaaggcgtttgagaccacccagtacaatgacaaggctgatggtacgttaatggcaaaaatgaaaatcataattggcataatgtacgtcattgacgttgtcatgctgttcttttcaggttgtcccatcataaccaagtatgatgaagcgaacgtgaatagggcagccaaaattggcaaaatgaacaagtgatcgtgttgaccaagttgtgcccacaagaaagttcccgtttccaattgcttcgtcgtacgaatagccgtatacaaggcaatcaaaattggcatttgaacaatcaaaggcaagaaactagcgaatggatttacaccagcttccttatatagggcactttgctcagcttgcattgcagccattgactcagtatcacgatttggatactttgcttggatagccttcaaggcaggggcaacttcttgcatcttacgcattgattgcgtttgatataccatcaaaggcaaaatcaaaagacgaatcaatagcgtaaaggcgataattcccaaaccatagttgttaccaaaccaagctgacacacccaaaattgagcgtgagaagttggcgatgataacgccatgccagaaaccagaccctgaaaccgaacccttaaacatcacaccggcgataatcataatgattaaagcgatagctgcggtaactgtagaacgcgttgaaaatactttcttagcagactgcatcgattttctccatataatatgtagtttttatttttcgtcttgatcgacaaacaaatttgccaacttgaagacgtgttccaaattcttcttgatgatcgccatgtcttggtcatgagctgatggacgggcaatcactaagatatcgacatcttggcgcaagtttggcttaaattccaaaacgctttgacgaatacgacgcttaacccatacacgctcatgaccacgcaacccaaccttcttagaaatagagattcccaagcggaagtgggttggttgttcacgctccatcgtgtaaacaataaacattttgtttgcgaccgagtgatgttgatcgaagactaattggaaatcagcttcctttttaacacggtaactcttacgcatatgtttgctccagacttttttgaagacaatagaaaacgcgtgattcagccaaaatggccgaaccacgcgcgatcgttatcagtaatcctaatagaaggcctgacctaattaggctgacaataccttgcggcccttttggcggcgacgtgctagcaccttacgtccgttgctagtgctcatgcgcttacggaagccgtgtacacgctcgcggtgacgcttcttaggttggtatgtacgcttcatgtgaatacacctcccattcgtagttagatttggcctgcggttggcaaggccaaaccacaattcgtatttcagtttatcacgtaactatctacttagcaagctttctaaagcactttatttatttttaataactattaagaaaagcagcttacaaatagtttatctaaaattcacagatccaccgtcgaattctaaagtgcttaacaatttctttaaaaaatttaaatttaaaagtcgcaggagttttccagaaagtaacggagcgttatgttgataaaaatcagcaatataacagcctgttagtttagttttccccaatatccacattttttccacattctccacatggttgtacaaaacagtcgcaacccccttgtgaatatgtggaaaactcccgaaaaccttgtgttatatgcactggcttttgcacaaatccttgtaaataactcaaaatcaggtgacttatccacagatttccacagaaacctcgtttttcaaattcacaccaagttgataacctaaatttagatttccacagggtgttaatatcacaaaatgttattgaaaattgcggtaacccttgatacataggcaacattacttgtggaaaacttttccacaacctgctaaaatggaatttgtcgaattgcgtcttaattatttcattaattttgacgaacgtattgtggaaaactttccacccaaagattccgataccgttatttgttatttaaggaggtcgtccaaatggatcctgtccaactttggaacgccattaaagaagaactgcgtgccacaatcgcacaaactttttcctatgctaactacgtagaaacattaacgccagtagcagtaatggaaaacgagaacaacacgctgactttacaacttgcaacgaatcacgagcaggttgctgaagaatggcaagataccaatagttcttacaatcaagcattcattcaagcggcaatgattgcgacaaacaaattgaatggcacaccaacatttgtcattccatctgttacgttcctaaagccacaaccaacctcattatttgaggaaacaccaactgcgccagctgctgcaccgcaatcaaatgttgagatttcagcatctgacttcgttacacaatcaattttgaatccagaattccgattcgaaacgtttgtgtcttcagacgaaaacggtgaagcctacgctgttgcacaagccgtggccgacaatcctggtacacaatggaatccacttcttatatatggaggagtaggtttggggaagacccacttgatgcaagccattggtaataaagttttggagcgcaaccccagtgcaaaggtaaagttcatcacgactgaggactttatcaacgacttcactgatgcgttgcgtcgtggtgcgaatgcaactgaagcattcaaacaagaataccgttctgccgatcttctattagtagacgatattcaattcttagctgataaggacaagattcaggaagaattcttccacacgtttaatgcaattacgcgtgagaatcaccaaattgttctgacatctgataagttgcctaaggaaatccctggtcttgagatgcgtttggttacacgctttgctcaaggttattcagcaaacatcacaaagcccgatttgccaactcgtgttgcgatccttcgtaataaggctgagcaagaaaacctaaacattccaaacgatgtgattgatgaaatcgcagcggccgttgatacgaacgtccgtgatttggaaggtgttttcaaccaggttgctggtaagttgcgatttgcaacggctcctgtcacggttgaaacagcgcgcgatatcttggagactatgaacttcaagcgtcaacgtgcgattacgattccaatcattcaagaaacagtggctaagttctttaacgttacagtacaagacttgaatggtaagaagcgtaataaggaaattgtggtcccacgtcaaatcgcgatgtacattgcacgtgaattgacccaagactcattgccacaaattggccgtgcttttggtggtaaagatcacacgactgtcatgcactcaactgaaaaaattgagaatgcgattgaaaacgatgccgtgctagctggccaagttgaacaaattcgtgaagagttgagcaattagtatcaatgcctattgtgaataattcacgaactacttaaaagttttccacaggtttgtatacatggaccaatccttggtgtaatggtctagtttgaccttttccacagtatgcacaccccttattattattattatctttttgtttataaataaatcagtcattaaggcgacgcatgcgcagcatgccgagcaaaaaaagcttgaggagattatcatgcaatttacaattaatcgagctgttttcatcaaggctatgaataacgttagccgtgctatttcatctcgtacatcaatgccaatcctaacgggtgttaagttggttctcgataacaatggtttgacgttgacaggatcagatacagatatctcaattgaaacgttgattccagttacagatgatcaagcatcactaacaatccaagaaccaggtgcattggttttgccagcagccttcttctcaaatatcgttaagcgtttgccaggtgaaacattcacgttgtcaaacacaactggattccaagcaaagatcacttcagagaattcagaatttgatattaatggtcaagatgctaataactacccacacttgccagaaattgaagtgcgcaacgatttgactttgccatcagaaacgttgaacgaagtaattggtcaaacggttatcgctgtttcaaagcaacttagccaacctattttgacaggtgtgcactttatcttggcaggcggaaacttgactgccgttgcaactgatcgtcaccgtttggcacaacgtactgtcgctttgagcgaatcagatgttgatgctgatatcatcgtgccaggtccttcattaaaccaattgcaagcgatgcttgatgaagttgaaacagttgatgtccgtgtggctgaaaaccaagttattttccaattgggtgccaacacaacgttctactcacgtttgttggaaggtaactacccagatgcgtcacgtttgattccaactgagaagcgtacgactttgacgattaacgcacgtgacttgttgcaaacaattgaacgtgccgctttgttgagtcacgaaggtcgttcaaacgttatccaatttacggttagcgatgagaagtcattgatttcttctaactcacctgaagttggtcgcgttgaagagcaaatctttgctgctgaaacagctggtgatgaattgacgatttcattcaaccctgactacatgcgtgaagcattgaagtcatttggtgatgagcaaattcaaattggctttaagacagctttggatccatttacattggtaccaactaataacgaaacaaacttcattcaactaattacgccagttcgtacttactaaaatgatttaaaaagccgaaaatcgccgtttaacgaaaaaacagcgattttcggcttttttgtttaatttaatctctaaccgctcagacgccctctgaagccggaattacattgaataatgctagaaaatagcgtataatagatttacttatggagacatttctcagctggatttttttcggcagaaaggacaatgcaattggctactgaagtgcatattcaaacgccctttattacactagggcaactattgaaggaagaaagcattatctcaacaggtggacaagctaagtggtacctacgtgagaacacggtgcttgttaaccaagaacctgatgatcgtcgcggtcgtaagttgtaccctggcgacatcgtggcggtaccatccggtgagcgctttgtgattaacgggatgggtgctgaagcagactaatggaactgcttgagctaaaactgaataatttccggaattatcaagatttagaggtgacattttcgcctggtgtaaatgtattcctgggaccaaatgcgcaaggtaagacaaacttacttgaagcaatttatgttttagctttggcacgttcgcaccgaacaacatctgataaagagttgatcggttgggaaggcaaagaagcgatggtttccggagttgtacaacgtcagtacggaaaagtgccactttcattagctttcactagtaaaggtaagaaagcgcgcatgaatcacttggatcaagcaaagctaggtacttacattggtcaattaaacgttattttattcgcgccagaagatttggcgttggtaaaaggtgcacctactgtgcgacgcaattttattgaccgcgaattcagtcaaatgagtccaaagtatctatatattgcaaatcaatacaaagttgtgttgaaacagcgcaatcagtatttgaagcaattgcaatccaagcaagccaaagatgtcttgtatctggaagttttaacagagcaattaactaattttgctagcgaacttatcatgcgccgccaagcactcatcaaagagcttggtaaagctgctgcaccaattcatgcagatattacacaaggtggcgaaaccctttcgattgcttatgtgtcacaattatctgaagaagaattggttgatgaacagacggttaagtctgccatgatgaagcgttttgagcggttacaatcacgtgaaatcatgatgggaaccacaatgctagggccacaccgtgatgacttacgctttgacgtaaatggtcatgacgtggcgacatttggttcgcaagggcaacagcgtacgactgcgttggctgttaagttagcggaaattgatttgatgaagcaagaaaccggagaatatccgattttgttgcttgatgatgtgctatcagaattagacacaaatcgccaaacacatttgttaacggcgatgcaaaataaggtgcaaacctttattacgacgccgtcactaagtgatgtggcccgtcaactaattaatgaaccaaaggtctttaatgtgcgagccgggcaactggttgaaacaaatggtttaggggaagaagctagtgcagactagtggtatttaaggaggaactcatggctgaagaagatgtaacacaaatgcatactgacgcagatgattacgatgccagtcaaatccaagttttggaaggattggaagctgttcgtaagcgtccaggtatgtatattggaacgacgacgagtcaaggattgcaccacttggtgtgggaaattgtcgacaacggaattgatgaagcactagcaggttttgctgatcacattacggtggcaattgaaaaggacaactcaattacggttactgacaacggtcgtggaatccccgttgatatccaagagaagacaggtaagcctgctttggaaactgtcttcactgttttgcacgccggtggaaagttcggcggtggcggatataaggtttctggtggtttgcacggtgttggtgcgtctgttgttaacgccttgtctactgaattggacgttatggttgtccgtgatggtcaaggttatgcaatggactttgaacgtggtcacgttaagacaacgatgcacagtgcaccagttgataacgcacctgtttcacgtggaacaattgtgcacttcttgccagatccagatatcttccgcgagacgacaacatatgattacaagattttgatgaatcgtgtccgcgaattggccttcttgaacaagggactacgtatttcaattactgacaatcgtgcggatgagcctgaaacagagtcattccactacgaaggtggtattaaggaatacgttcgtttcttgaacgtcaacaaggatgtcatttttgatgatcctatttatgttgagggaatggaaaatggcattgaagttgaagtatcacttcaatacacggacgattaccacagcaacatgttgtcatttacgaacaacatccacacgtacgaaggtggaactcacgaaactggatttaaggccgctttgacgcgtgtaattaatgattacgcacgtaagaatggtcaattgaaggaaaacgatgatgccctttctggggatgacgttcgtgaaggtttgacggccattgtgtcagttaagcaccctaaccctcaatttgagggacaaacgaagacgaagttgggtaactcagatgcgcgtacggccgttgaccgtatgttctcagagacattcaaccgtttcatgatggaaaacccagcagttgctaagcaaattgttgaaaagggtatcctggctggtaaggctcgtatggctgccaagcgtgcgcgtgaagcaacgcgtaagaagtcaggtttggaaatcgctaatttgccaggtaagttggctgacaacacgtcaaaggaccctgaaatttctgaattgttcatcgttgagggagactcagccggtggttcagcaaagcaaggtcgtgagcgtttgacgcaagctattttgccaattcgtggaaagattttgaacgttgaaaaggcttcattggacaagattttggccaacgaagaaattcgttcactatttacggccatgggaactggttttggtaacgaatttgatgtcacaaaggctaagtaccacaagttgattatcatgaccgacgccgatgtcgacggtgcgcacattcgtacgttgctattgacgttgatctatcgttacatgcgtccattgttggatgctggatacatctacattgcgcaaccacctctatatcaagtgcgccaaggtaagtttgttcaatacttggattctgatgaagagttggaagcattgttgccaacgttgcctgcatcacctaagcctgttatccaacgatacaagggacttggtgaaatggacgcggagcaattgtgggaaacaacgatggacccatcagttcgtcgcttgttgcgtgttgaaatggacgatgccgttgatgctgaccaagtattctcaatgttgatgggagacaaggttgagccacgacgtgagtttattgaagagaacgcacaatacgctgaattggacgtttaatgttgtgttagccacagcgttaaacaactagaaaggaacaaaaatggctgaagaagaacaaaataacagccgcattaagcccgccaagcttggcgagcaaatgcgaacgtcattcttggactacgcgatgtcagttatcgtggctcgtgctttgcctgacgtccgtgatggattgaagccggttcaccgccgtatcttgtacggaatgaacgaattgggtgtgacgcctgataagcaacacaagaagtctgctcgtatcgtcggtgacgttatgggtaagtatcacccccacggtgactctgctatttacgaatcaatggttcgtatggcgcaagattttagttaccgttacatgttggttgatggtcacggaaacttcggttctgtcgatggtgacccagctgccgccatgcgttataccgaggcacgtttgagcaagattgcgacagaaatgcttcgtgatatcaacaaggatacgattgattttgctgataactacgatggtacggatcgtgagccggttgttttgccagctcgtttccctaacttgctagttaacggtgcaaatggaatcgccgttggtatggcaacaaacattccacctcacaatttgggtgaagtgatttctgctatccacatgttgatgaacaaccctgatgtgacaactgctgagttgatggaagccgtcccaggacctgatttcccaactggtgcgattgtgatgggaaagtctggtatccgtaaggcgtacgagactggtaagggtgtcgtaacggttcgtgcgaaggttgaaatcgaaacggaaaagtctggtaaggaacgcatcatcgtgactgagttgccatacatggttaacaaggcaaagttgattgagcgaattgctgaacttggacgtgagaagcgtattgaaggtatcaccgctgttaacgatgaatctgaccaaacaggttaccgtattgcaatcgatatccgtcgtgacgtttcagcttcagttgttttgaacaacttgtacaagaacacgttgatgcaaactgggttcagctttaacatgctggccgttcaagatggtcgtccaaagttgttgggcttgaaggcaatgttggttgcttatcttgagcaccaacaaatcgtggttcgtcgtcgtacggaattcgaattgcgtaaggctgaagcacgtgcgcacatcttggaaggtttgcgtattgcgttggatcacattgatgcaattatcagcattattcgtggttcagaaacgtcagaaattgcgaagaatcgtttgatgtctgattacgcattgtcagataagcaagcgcaagccatcttggacatgcgtttggttcgtttgacaggtttggaacgtggcaagattgaagaagagtatcaaggcttgatgacagcgattgctgactacaaggatatcttggctaagcctgagcgaatcgacgaaatcatttacactgagttgcttgaaattcaagaaaagtacggtgatgagcgtcgtacggaattgcaaatcggtgacgtgacaagcattgaagatgaagatttgattgaagaagaagacattatcgtgtcattgacgagtggtggttacatcaagcgtatggcacaaactgaattccgtgcccaaaaccgtggtggtcgtggtgtccaaggaatgggtgttaacgatgatgacttcattgatcaattgattggtacatcaacacacgatacgttgttgttcttcacgaacgctggtaaggtctacaagatgaagggatatgaaatccctgaatacggccgttcagctaagggtattccagttgttaacttgcttggaatcgaagctggtgagagtgttcaaacagtcatcaacgtgcgtggggatgctgccgaaagcaaggattacttgttcttcacgacgcgccttggacgtgttaagaagacgccggtatctgactttggaaacattcgtgcccacggtttgaaggcgattacgttgaatgatgatgatgaattgatcaacgttatgattactgatggtactgagaacttgttgattggtacgcatggtggttatgccgtttcattcaatgcggaagccgttcgttcaatgggacgttcagcagccggtgtccgtggtattacattgcgtgacgacgactttgttatcggcgctgaagtcttgaaggacgaaggtcacgttttggttatcactgaaaagggatacggaaagcaaacgccagtctcagaatacccaatcaagggtcgtggtggtaagggtatcaagacagcccaaatcactgaaaagaacggacctttggcaggtttggcggttgttgacggatcagaagatatcatgttgacgactaacaagggtgttatgattcgattcacggtggattcagtttctgaaactggtcgtgcaactcaaggtgtgcgcgtaatccgtttggatgatgacgctgtggtggcaaccttcgctaaggttgaacacgaagatgagtcagaagatgcaacacaagacggtgtagcaacgacaccagttgttgaccaagctggcactgatttgccggatgcaccagcagctggtgaacaaccagctgaagtagctgagctactcgcacgtgctgaagacgattcagattcacaagagtaaaaataaagagacatcatacaacgtactgtgtgatgtctctttttgtatatatgcatctgtctaatatttaggaattgttatttttgatttatagatatcgactgttatttggctgattaatatactaaaatagtaattaataataatgaaattgtatgacattgacgtgtagttataattctaatgtatcatctgtgggacaaagaagtttgcataatatcacacttacattatgtagaggagtatacttatgggtggttatatgagaaaagttaacgataagtaagaggtttatatggggaagaatcgagtgccggtggatgcaattcgtgacgcgatgatttatttcatcaaggaacgaaacatttcagttccggttgttttgaagacggttgatatttcacgctcacgtttgtacgactacttgcaaggcaatggaaaagtcagtgcaacaacgttggtgaatttgttgatgacgattggtgtgtcatttgatgaattgatgctccacatctatatgaataatcctgaattgttggatccagcaattaaggaacttggtttggacgcgcactcagttacgatgacgccaacggaagacacggtttatcgtacactttcaatgtatgatgagacgcgcgatgtccgtttgctagttaacttggtacgtgcaattaactctcaagtggttgatgaagttgagaagtaccgtttgattgaaatggttcgcccaacaatcgttaagttgctctcatcacgtgagttctatacagcaaatgacatgttgatgtttgcaaacattattcgccacgaaccatacaacgcagctaagcttgtcgtaaagcaaatgtctgatcaagcacgccgtatggctagtcttgaaggatatggcttgatggagttggacaacttctcttcagctgaagtgcgtaacgtggctttgttgcacttccaattgttgattatggcattggaaaacaaggatgatgaaacggttcgcaatacattgatgttcttgcgtgagtaccgtttgccagctttgagcacatactttggcttcgttaagaagatggcgcaagttgttgaattgtcgttggctgatgatgatgaagctgctgaggcattgtggaatcaagcaactgaatcagcaaagttcttggttgatgaacgcttctggccaatctattcattcattgcccgtcgctcatatagcgaattttcaattcctgtgttgtcataccgtcaacacatcaatgaaggtaaataataaatatgaaaaagcaccgcaacgattaatttcgttgcggtgcttttgtctgctttatgaaagttttagaaccatgttgcggtgctcaatgccggcatctaggaaaacgtcaccttcagcttcgaagccaagcttttcgtagaaaccaagtgctgaaacttgggcacccaaatcaagggtgtgtacaccagcttctttggcatccgcaataatttcttgcataatttttgcagcgtaaccgtgaccgcgggcatcagatagggtcgcgacacgttgaatgtgccaattagaaccatcttggttcactaagacacgcgctgtggttactgcgtggctttcggtaaagccaacgtagtgggttgtagaatcatctaagtcgtcaatctctagttcgagcggtacaccttgctcgccgacgaaaacggtttgacggatagcaagcgcttcacggctaagtgcaccagcaccgtattctttacttacaatgagttcatttgacatggactgatcacctctgggtaaattcgtgcaacaatactcaaactattttagcgcaaattacgttaaacagaagactataaggtatgaacttaaaaattacgctataataggacagatgcagtctaaatttggctgattgaaacttaaaatctaacgataaaaagaaaagagtgaagtatatgaggcattatggccgtttcagctgggtaaatacccgcttggggtttgttttgctgctggtggcattggtttgggctaaaacacagttagccaatatcatggatttccacttgtattcgggagcgtcgccggttcagtatgtgacgatgctactaaatccgttaaccgtatcaacattgttgattgggttagcgttttacttccgatcagcaaagttattttatccagttgcgacgattttatatgtagtcaacgtgctgatgattcagttgaatgtgatttactatcgtgagttcacggactttatgtcagttgcgacgatgctaggttacaacaaggttaaccaaggattgggagcttcgggctttgcgctaactaatatccatgacattttcttctggattgatgtgccgattattattgggttgttcatctttaaaaagatgcgcattcaaaaagagggcacgacgaagtttatgagttttgcgatgacgacgttttcgattttcgcattcatggtgacgttgacgctgggtgaagctgatcgtccacaattgattacacgtcaatttgatagcaacatgatggttaagtatcttggtattgatgcttacaccgcatttgatgcgattaagacgcatggtgtttctgaaatgcgtaagtcagctaagaaatctgatattgataatgtgctgagttatgtaaagggacactttgcggattcaaatccacaatatgccggtatcgcaaagggtaagaatgtgtttgtcattcacttggagtcgttccaacaattctcattgaacctaaaaatcaatgggcaggaagtcacgccaaacttgaatgcgatttacaattcaaactcaaccattgcgtttgataatttctttaatcaagttggtcaaggaaagacgtctgatgcggaaaacatgctggagacatcaacatttggtttgccacaaggatcattgtttgccacacaaggtaatgatcaaacattccaagcaatgccagctatcctgcgtcaaacgcagggttactcatcggctgtcttccacggtaacaatgctagtttctggaaccgcagtaatgtttataagaacatgggttaccaatacttctttgatgctagttactatgacacgtctggtgataaggcgatgggctatggcttgaaggataagttgttgttctatgattcaattccatacctggagcacatgcaacaaccgttctatgccaagtacattaccgttacgaatcacttcccatacagtcttgatgaacaagataaggatccgaacttcgtgacaacgacaaccgattctgacgtggtgaatggttactttgaaacgaatcactaccttgaccaatcaattggtgagttctatgactacttgaagaagtcagggctatacgacaagtcaattattgtcttgtacggtgatcactacggtatctcaaattctgaaaacaagtcattggcctctgtattaggaaagagtgcggatgattggactgattttgataatgcacaaatgcaacgtgtaccattcatggtaaatattcctggatacacaggtggcggtattaaccacacgtatggtggtgaaatcgatgtgatgccaacgttgctacacttgttgggtgttgatactaagaatgatgttcaacttggccaagatttgttgagtacaaagcgcgatcaggtcgttgctttccgtgataaggactttattacgccaaagtacacggtaatcggcgagacaatctatgacaacacgacaggacaggtcattagcgatccatcaaagcaagttcaaaaggaagtagcagcggcgcgcaagaaggttaataagcagttatcaatttctgacgatattaatcagaaagacttgctacgtttctacacaccaaagggattctctaaggtagatgcttctaagtacaactatgcaaatggtttggggaagcttgagaacttagaaaaccaaaagggtgttggctcgactagtctttggacagaaaacgataataagacgacgcagtcactttatacaacggatgcgccagaaaaggatgaacctaggtcagatacgtctcgtatcaagcaggttaacccggacggtggcgattcgaccgatggtggggatgacacaccaaacccataattgaatagctaaagcatctcagacatccagttaattaatgggtgtctttttttgagagtaaagcggtttgcgcgccttgacatttatgttaaataacctgacaataataaacggcaaaatgagaggagggcgagacgatgacgtttgtatcaaagcaacaatttcataagaactttttgaagtctgaagtgttccaatttcgtattggtgagttagcaacgatgactggtgtttcgactcgtcaacttcgctattgggagagcaagggcattatctcgtcgcttagtcgtgatggagaacaagatgcgcgtgtttataactacaaaacgtatgtcgcagtggccacaatcaagaatttcttagatgaaggttatacattgaaggctgccgtaaagaagaaggaagagcttgagcaatcatggaaggttttgcatgatgttatgagtcgagctgtgcaaggaactgctgaaattgatggcattccggcagttgatctgggattctttgatgcggaacaaacacaacgcttgtttgcgacagtagatgatcaaaacgtggtgaagtaccgcgtacaaacgattgaagaataatggagacggttttggtaacgattaccaaaaccgttttttgctttaaacgttgaaaataactgttaaactataagagatattagaaaaggaaactttagataatggcagattggcacggtttttataagttgtcttggcgagagcgactagataaaacgattgaaaataagcaactgactgctgagcaagtggctttgattgaagcgcaatacgatgcagttggtgaacaacaggttgaaaattatctttacaactttggagtgccaacgggtttgttaccagatttgccagttgatggtcgattggtaacggtaccaatgagtaccgaagaacctagcgtcattgcggctgcaagtaacggtgctcgcatgatgcgcgctggcgaaggggttaaaacgacgattcaaagccgcttgctacgcggccaggttattttgactgatgtagcaaacatggatgcgctacaagaatacgtttcaagtaataaccaagctttgttgcaagctgctaatgatgcccacccatcaatggctaagcgtggtggtggtgccaaggcgctaacggtagaagtgttggatgaacaaacagccattgtaaatgtgttggttgatcctaaggcggcgatgggggcaaacgttgttaatactatgtctgaagcggtggctgagaaattaaccattgcggggtatcaagtgttgatggcgattctttccaactatgcaactgaagcactcgttaaggcacgtgttgcaataccagtagacgcgttggcaacgaagcaggggatgcctggtacggaagtcgctcgcaaaattgcagctgcgagtcatattgaacaattgtcaccttaccgagcagtcacgtcgaacaaagggttgcttaacggtattgaagcggctgtattggcaagtggtaacgatacgagagcagtcaatgcagcgttgcatgcctatgctgctaacaatggccaatatcatggtttaacaagttggacagtccaagacgatatgttgttgggtgagacaacattaccattgatgcttggagttgttggtggatcgattggtattgtgccagcagttaagctgaaccatgctttgatggataatccgacggttaatgaactaacaagtatcgttgcagccgttgggttggcgcaaaacctgtcagctttacgcgcgctagtcacaacaggtatccaagcaggtcacatggccttgcaggcaaagtcattagctttgcaggttggtgcgacgacagaagaagtaccggcgctaacagcgcgtttgcaacaaattggacaattcaatgaaacggttgcccgtgaaacgttggcgacattacgtcatagtaaataaggaataagaaagagattattatgcaattttcagaagatacagttaagctcctaaaccaagttaatcaagtttacccaggttcagttgtccttcgcggttcaggtgaagcaacaggtaagttgacacatgaccaagtttcaacggatatgttgggaacgcgtttgatggttgaggtaactgatgcaaccgcacctgatttctcagcaacgcaagaattgttgaacatgatgttgacgttgagcggttacccacaagtgtatttccaattaaagtcagaagatattaatatgacggatcaattgatggttatgtcgacgtacctttaccaaccagctttgcgtgcgattacttataaggaacaagctaagcacggtttggtgacggcggcggttgtaaaggcgtttgcgaacggggtcatgtcaacgttgacgcctgaagcaaagaatgatcgttcagaagcagcgctacgtttgttgacgttgttggatgcacgcgtcttcatgaatgccgtgccatctgatattgatacagccatttatacggatagctttgcagatgccttcccagaagcatgggaagctgcaggtaacatttttgctacgatgaaggttgatgatatcaaggacccattcacggttcaccgcgcggtaattgctgccttcaagggctttgatgcgcaaatgattgcttggaacttgcctgaattgcaagcgtttgagttcgcaacgttgacgccagtactatcagaacgccaattgcgtttgcctttggctcaagtattcgatattaagcacacagagatgacagaccgtaacacagaaaagtcagcttacgttggtttgagcaagtcagaaggacaaaacagttttgttatttctgcaccagatgagaaccaacctgagttctttaaggcgttgtatcaaacgcctgttcgtgaggtgctagaacaaatcggacaaccttttgttgtgcgtcagtagttactaaatagataggagtgtcatagcatgagtgttaatccagaaattcaaaacttatttgataatgcaaagcagattgtctttctaacgggtgctggtgtttcaactgcgtcaggtatccccgattaccgctcgaaaggtggcatctatgatgatagtggcgtagttgaacgtccagaatatttattaagcactgatgcattggctaatgaacctgaaaagatgtatcagttcatgatggacaatatgtattttccagatgctgagccgaatgtgattcatgacaaaatggcggcactaaccaagcaaggtcgtgccaagattattacgcaaaatgttgatggtcttcataagaaggcagggagtgaagcgacaattgaatttcatggatcgctttatgatatttatgctgtaactgatggcaagaaagcaacattggctgagtacatgacgaatatgcgtcgatcagacggcgcattgttgcgaccggggattacgttatatggtgaaattccatttagtgtggaagaagcagccatgtgggtgaaccaggcagatttgatcgttattgttgggacaagctttgtggtgtatccattcgcgggtctattacagtacgctaaagcaggggtgccggtattggcgattaacttagagcggattccagccctagatcgggtgcaacaaattattggggatgccacagtattctttgatgaattgcacatataagagcaagtaaaatcgcaaccagaatgggtttctggctgcgatttttattttgtatgaacaaagtttgaagaaagtgttgacgaatcgcataaacatatgtaatatagattaagttgtttcagggaaacagcaaaacagcaaaacatatttaacttgaatagctaattgatattcaaacttctttgaaagaagttgttgacattcgcttgaaaggttgttatgatatataagttgtctggtgaggcaacgacgtaggtcattgaaaactgaatatcgtttcgatgaaacaaatgtgtagggtcatcaagctaagcaagtgatcaatggcaagaagaaggatattcaccaacacgttgtgaacatgcaactagccaatcaactgcgtaacagcaagcgtagcgaaggaattaatgcatggattgagatggagtatcatgcgtaagtattactatttccgagataagcagggctacttcaaactcgcttatacgccagaaggcaatcgcgtgattgtgcggacgtggaataagcgtcaggcatatcgcacaagtagcaagtggctcatcaagcatatggtcagcaagtggttagttggctattactattgggtagaagaaggataaacaaaaagcgccagaccgaagtccaacgccatgtaacagaattaggagtaacttcattttaacatggttcggaggacgtagggaatggcacttttaccagcggtgaatgagaaggcaacaagagaagcggttcgagagttttttgatagtgagtggccacgtatcgttaacatggctgatatgggatatgttgatttgaagtcagttgaaatttcagacatgccaagtgcacgatcatttggtaatgctaacgatgaaagatttactaatcacgctaacgctgtgtactactacgatgccgttgtccatgccatcaaggttatgacacagccacacaggcacttcatgtggttgcgatacgtccgacacttagaatggttacaagtagaagcactgactggttacagcactagacgtggtcaagagattatcgatgaagcgtttctgttgttcgctgataatttttctgacgttgatgatctgcgagttaaggaaagcagcagttattagttgcgcaacttattaattatttattgactatttaaccaagtggatataccatgtgtgtgtaacatattatagataacctaaggggggacgatcatggctttagaagacaagattgatggcgcaaaggatcaagtagcaggtaaggcgaaggaagttgaaggtaaggttactggagatgaaactcgtgagacagaaggcaaggtccaaggactattgggtaaggctaaggatgcctttggagatgttaaggatgctgcagaagatgcagttgaagacatcaaggaaaagtttgataagtaatttttaatacttccaaatgcgtactcgctgtatttggaagtattcttttgttcctttagctcagttggttagagcagacggctcataaccgtccggtcactggttcgagaccagtagggaacatggcatggattgatagatcttaggccttttcatccctatatggccacaacactcactcagatgtctatcaatctttgcttttataagccgatatggcggaactggcatacgcagcggacttaaaatccgtcccttaattggttgtgggttcgaatcccactatcggcatattcacatcaggtagcaatcagttagattgttacctttttattttattttgacaaattttacgaagaaaaagcgcgtatatggttcataaatgccgcatgcaaggtgcgggcagtccaagttattatgatagagtaccaaagttgaaataaagcatgtgtggcggaataggtagacgcttagttgtgctagagagcaacaagataaggcggttgatgggacgtggtcacatctcaagatgccctgtgctaatcatgtcaggtgcaaatcctgaccacatgtatagtgagatgtagttcatcgtatgtgcataaaaccgacaacatggttgccaggatatgctataacatctgtatggctatcttgcgaaagtccatgtcagcgcccagcgttgcctggcatacatacacatgaaactacataaaggacaactttattagttattaccgtgccagcgccttgtatgtagtggctggtgtacatatcaataaagcataaggatatgctttctctaatctaatattcgtgccgtggccttcgatatgtgggtgcacggtttttgcaagtgctataataattgcaaatactcaagaaagttgggtcggcgatggtactgactaatatgcaaagtaatgaaattcaaggcatttacgataatctaatttttgagctgattaacttgaaaaagtcaactcaaaatattttctctggaatgtcattgaatatggacgttgcaaagcctactgaaaaaatgaatataggcttgcaaagggttataactcataaattgatgaaccgagaaatcgaaaagttggatgtggaattacaaccacttgcaaataagatctcggtagccaaagtaacttcaactgatcatggagatgctgcacgatacaagatcagttctgatgacccgtacgtaagggttttacttgccgcgaacgacagatttattagaaacattgactataatcaaaggaatatttttgatacagcggttgtgaacttagcaagtttgttagagaatacaatgaaacaattggcacaatttaccatgctgacttttcccgaaaaattcagtgtaaaggaacaatcgaaactgactttgatgaacgtgctgaattcagataacgttgaggaattgaaagaagaagtgctgcaacgatactttgccgacttgacgtatgattcagttgacgaatggttgcctaaattgctcaagtcggtatccggtaagaaggcaaaaaataatgatattgcgatgttcaaagaactgtttgaaagaagaaatgtgattgtacacaataagtctgtagtgaatacaacatatctggacaaggtagacacatctgtttttacaaagggtgacttgattattactaattctaattacattgataatttgattacgggggtaatcgggttaacagtgagtttgttggatggtgcgttagcaaattggggtgctgaaggttctgaattgacagaatttttggccaatttgaatgatgctgctttaccgttttatgacgagcaacagtatgatttcggaattgcttattataaaaatcttcgtaatgtagctagaagtagaatcggaaaaacaacgatgggtgcgtacggaacatcatataactattacttgggtttgaaggcgaaaggacagctagacactcctgaaatgcagtctgaggttaagagattctttgattactttaaggacaaggattggtgggctaatgtgccatttgaaaatactgtgttaccggaagcttctttaactaagagttctgttgagtttgctcaggtacttgtacagtatgctgagggattgaaacgcgaaaatgatgcttcgttggccaaagtcttatcctggccgatgacaggattagtacgtgacgaagcgacatggaatgcatatttgaatgacttttataagcaaatatggtagtatgttgttggaattaaaggagatttaattatgtcattgaatgaaagcaagtctgatctaggcactgttataatgaagtagctttaataattacgatgaagtcaatcggaaacggttggctttttattttgcactgaataggagtatgacatgcacaagaacttaatgggtaagttgattaagagtaacaatgtcaatcgtggggaatacacgtacatttatggtggtagtgaattagttgatatagttaccaaaggtggtaagcaatattcacgcaacacggcgtttgatggtcgattcgatgagaatgcataggtgtaagggagaacgatatgccaaaaatgacaatctgtagatttgtaagttcagcgggtatcaagtgccataaattagcgagttcacccaatcattattgtagtgatcatatgaatcacgaatctgaatatcttgcaaagcgtaagaagtggagtgacaagcatacgcaaaactattatcgcaattacaataagacgcaacgagtacgtaatgaaaccaagcaagaacaagataagttctaccgcactaagcaatggaagaatggactaaggccagccgtgttacaacgtgacaactatctgtgccaatactgtgcagctaatgggcgcatgacaccaggcaagatagttgaccacatcattccgtatgagttcgatccaagtaagcgtgatgacgttaggaaccttgcaacgatatgtgccgcatgccacactggcaagacacgttgggagcaggagtattacggtacaggagcagggaacgaattaaagaacgtagcagcagtgcccgacattaaatacttaccagattttatggatagcgctagaacgcaatgagagccgttttaagcgctttttattttgtccggcataattgtcgattgtgttctgaaaataaaatgaccccgcccctgggtgtcttaaaagaaaagcacacacattagtgttttcttgtaaaaaagttggattttgaaaattttttaataggggggtacccagcaattaaggaggtgatgttaggtgccacgaaaaagctatgaaagcgagtctgacgctgttttgtcgctgaccccgccacatcacttaggcaagattgcaagtgccatgtggcgaaaaatggtgcccgtacttaacgcttcaaacaagatggctccattagataagaatttagttgaaatgtacgcaagccaatacgagatttatcgaaatgcctatgaagacatcaaggagaatggtcaagttaccaaagtttataagacggtagttaacccagtgaccggtgatgtgattgctaacgatatgacgggctataagcgcaacccaagtacacagatttactcggatgccattaagcagttgaaatcattaggtagtgagcttggtttatcacctgccagccgtgctgaacttatgcaattgagtttggacgacggaaaagacaagccaagtgctacggaacaactgcaagcgctattgaatggaggtggtgatgatgagggttgatctaactcaatcacacgacgttctaggttggtaccagcaactacatggcgattacgaagacatcagaaccaaatacaaggacgctggaacaaagtacgtattcagtgtcctagatggtgatgttctggccggctacatgattaagcttgcagcgttccggcatattcaagacttggtgcgttcagaaacagatgactcgttcgattaccattacaacgtcagggaagccaacaagatacttcgatttgcgagtgtatttcctgatgttgataccggtgaaccaatgccacttatgccgtgggaaaagtttgcgctaactcaattggttgggtggcgtgaccatcttggaaacaagcgatttacaactgctattctgtcagttgcgcgcggacaaggtaaaacttatctaatggctattcttatggcctatgactttatgattgagtcaattggattgtctaaccaagactatcttgttgcgtctatcaactggaaacaaactagtaaattgttcgggtacattggtacagcgcttaataagatgacagcggttgaaccatggaagtctttggctgctgaatcagggttgaaagttcaaaatgaccagattatcatgaaaaatttcaacaacatcatgcgtgcgattagtcatgagtcaggacaatatgactcgttccacttcaagacagccgtttttgatgaaattggtgaagttaaaagtcgtgaaaagattgccaagattacttctggtcaggttaaggtgcctaacaagcaattcattcaaatttcgacatcatacccagacccaacggtgccgtttcatgacgaccaaaaggctggtcagcaaatcatggaacaggactggaaccgtgcaaatgacgacaatttggtgctagtttgggcgcaagacagcctaaatgagacatttaagcctgaaacttgggtgaagtcgaacccgttgcttggtttggaaggtcaacatgatgttttgctaaagggtttgacaactgaacgcgacacaaagatgctgcaaggtgatttgccagcgttccaaaccaaaaacatgaacatgtggctggcacaatcaactgacagtttcttgaacttggctgatgttgaaagcgctgttgttccagacttcgatatacgtgaacgccaagtttacattggcttcgactactcaatgatgtccgataacacagcacttgcgtttgtttatccttatgttgatccagaaggtaatggacgatggcacattgaacaacactcattcataccgtggcataaatctggttctattgaagccaaagagaagcaggacggtatcaactaccgtgaagctgaacgacttggctatgccaccattactagccacgaacaaggaatgattaatgacgacgaagtttacgcttggttgcttgattatgttgaagaaaatgacttggacgtgctgttctttggttacgatgcaatgggagccactaacatggtgaagatgctggaaaacaattcagtgttcccactgcaaccaattaggcagcgtacagatgcgttaaaagacgccaccaagttcttacaacgcatctttgttgagaattcggttgaccgattagacgacatcacaatggaaaaggcgttgttaaatgccgtgctacgtgaagatagtgtgggaattcaagttgataagacaaaagccacgctaaaaattgacgttgtggacgctattatcgacgccatgacacaagcgatgtatcactttgaagagtttggaatggtaaatgatgccacatggcaagttgaacacatgagtgcacagcaagttgcggactggttcaacagcgcagaaagcgggttacttgatgattactaagaaaattaaaggctttgcacgagcgattagggctaggttggacgttattttgttcagcttggcactagtcgcttttgttttgaccatgtttttaacgattaatgcactagctggtggaatttcgctgactattgcacttgccattgccggatatggcgtcgtgcttatcgacaatggcaccaacactaacaggaaggagtaacggagtatggcagtattcaagccacctaagattagcaacatgttcgctgctagttctgacggtggcagtttagatgacggcattgtcaattttctaactggtggtaattcagattacgtgtctgtgcgtgaagcaattcataacagcgatttgtactcgttggtttcacaagtcagtggcgaccttgcaagctcacgattaattgcggacgcaacgcgtgcacagggtattttgaataaccctgatccacgaactaacccgcacgcattctggcaatcattctttgctcaaatgttgttcaacggtgaagcgtttgcttatcgttggcgcaatgctaacggacaagaccaacgttgggaacaattacggccttcacaagttcaaccgtacatcaccgatgacggtagcgggttgttatatcaagtgtcattcgatgaaccgatgattggtacgcaattcttgggtcagggtgacattatccacgttcgattgatgagtacgaacggtggtttgactggtatcagtccactcacggcattaagcaacgaattaaacgtaaaaagagagagcgacaagctcacaattcaagcattgaagcagtcgattaatgcaaacggtgtgctgtctatcaagggtggcggtttgcttgactggaaaaccaaggcatcacgttccaagcagttcatgagtcaatacaccgcttcaaatggtggaccaattgtgcttgatgatttggaggattttaagccgttagaaatcaaaagcaatgttgcagcacttttgggacaggtcaattggacttcgacccaaattgccaaggtttatggcgtaccagacagttatttgaacggtacaggcgaccaacaatcgtcacttgaccaaattaaaggactgtacgcaaacgcgcttaatcgctttatgagtgccgttgttggtgagttaaacactaagttgtcagcgaacattacggcagacgtgcgaccagctattgacccaatgggtgataactatcttggcatgttggcaaatattgttaagcaaggtgcacttggccaaaaccagttcgaatatttggtgcgaaaccaaggctatttgcctgacgatatgccggttgcaattatgcctaagccagtattgaagggaggtgaaaaggaagatgaagacaattaacgtaaagggcgctgtcatggataacgatagagcgtggttttctgactactttggcatggactatacaagtcctaagtcagtagcagacgtattgaacgatggtgaagttgatgatgttgtggtgaatatttcatcgcctggtggtgacgtgttcgcagccagtgaaatctattcagagttgaaggcatatccaggcaacgtcacggtcaatgtgcaaggactagcagctagtgctgcatctgtaattgcgatggccggcgacactgtgaatatggctccaaccgctcaactgatgattcacaaggcatcaactacccaagatggcaactctgatgacatggacagtgcatcagcaatgctagacaacactgataagtcaattgcgaatgcctatcaactaaagacaggtaagtcacaagctgacttgttgcaaatgatgtctaacgaaacatggttgaatgcacaagatgcagttaatcaaggtttcgcagacagcatcatgtttgtagatgaaaatgcaccgctggtgactaattcactggaagctgcattgccacctaagtcagccattaacaagctgatgaatattatcgctaatgataagcaaaaagaaattaacaacaagactgatatccagcctgtggacgatttgaaagcccgcaagttggctattttgctagacaaataaatttacgaggtaaaaacatatggatattcaagcattgaacaacgcatgggttgaggctggacaacgattgtctgacttgcaaaacaaggcggctttgttggtaaacgacgacgcagcagacgttgacgctattaactcaattaagaacgacatcgacgttgcaaaggctaagcgtgacttggcaaaggacaactatgatcgtgccgttgaagaccaagcacatgcagttttgaacgacccagacgctgtcaagaagccattgaacaacgaagaggtcaatatcaaggacaagtttgttaaggactttgttggaatgatgaagaatgacccaaaggtggtcaacttggtttcatcatcaactgacgaaaatggaaacgcaattggtttgacgattccacaagacattgagacggctatcaacacgttgaagcgtcaatatgattcattggagcaatacgttaacgttgaaaaggttggaacgcctaacggttcacgtgtatttgagaagtggtcagacatcacgccattgactaacttggatgcagaagatggtctaattgccgacaacgacgaccctaagctatcaaccgtcaaatacttgattaagcgttatgcaggtatcacgacggtaactaacacgttgttgaaggatacggcagaaaacatcttggcatggttgtcatcatggattgcaaagaaggttgttgttacgcgtaacactgccatcatcgctgctatgaacgcagcaccaactaagccaacattggcaacgttcgatgacatcaagaagatggcgttgactgctgttgacccagctatccgtacaacgtcattcttcatgactaacacgtctggtattgctgttttggcaacggttaaggacgcagagggacgttacttgttgcaacgtgatgttactcaacctgaaaactacatgattgatggtaagcaagtaatcgaaatcgctgacaagtggttgccttcaaacaagggtgcaatgcctttgtacttcggtgacttgaagcaagccgtaacgttgtttgaccgtgaaaatatgtcattgttgtcaaccaacatcggtggtggtgcctttgaaaaggacttgacgaagctacgtgttattgatcgctttgatgttaagacaaccgatgccgatgcatttgtggctggttcattcacggctattgctgaccaacctgcaaaggctgttcaacaagctgctgcgactggaacgcaagcttaataggcaggtgagttaaatgacggtcaatattgaacaattcaagacactaatgcgcgttgatattgccgatgatgacgcaattatcaatggctacttgttggcagctgaaaattacatcaaagatgcaattggaacggatgacgatttttatactcaacctgctgttgttgaccgttacgaaactgctgtctatgcctatgctggcacgttatacacgtaccgcatcagtatgactgaagttaaggcggtaacaatggacgccactgtcaactcaattgttggccaattgcgtggtaagtatgcagaatgggaggaacaacatgaaggcagctgatttcaatcgtaaggtcgcgtttggtactgtggaatcaaagcagaatccaaataatggctcaatcaaaaagaccttcgtgaaacagttcagtctgtggtatgcacccaagacccgcacgttaaatcaacagtatcaaattcaaggtactccattggataacactaaggtcattgtggtacgccataactccgctgtggaaggtatcaaggttgctcagattgacggcgtgatgtacgaaattgtgcaatacagccctgatgagtctaattccattattgcgtatgacttcgttactctaaaacggagggcataggtatggcagaacaatcatttgaggacattctgaacgcctttattgaagacgctgaagcagtatcgacacagatgacggttgaggataagcaaaaggttactaaggcaggcgctgatgtgtttgctaaggagcttgaatcagaatatcaggctaaccactaccgtcatcgcaaaacgggtaaagacccacatttggctgattcagttattgctcaaaataccaacgtagacggtatgaagaatggtagctcaacagttgggttctcaaaggataaggcatacatcgctaattttattgagaatggtacgaagtttccgatgtataccgcaaaagggcgtaagtataagaagggtggccaggttgctatcaacggtgaccatgcaatcgataacctacgtaacgactcacagttgcaggctaagattgttgaagctcaggcagaagtatacaagcagattgtcgacaggaggaataaccaatgacaccagtggaagaaatcgataacgtggttcattcagtgttccccgattggcaggtatacttctacgcgatccctgaggaagtcatcaacaataagaatgtcacccaagtgctgatcactgagagtaactcagacattacgacatttggtggtaacacatttaacgagatggcttttggataccgtttacaggtcttctacgggcttgacgaagagaaccttattggcaaagaggtaacgctgtacaaggccttagagagcgcctactggcgcatcacggacagtcagccacgttacttggatataagccaaacggatggacaacaaatcatcaagaatattgatattaacaaaacactaacgcttgacgagattaaccaataggttgacctcgttttttatttgaaaggaacaattaactatggctattgcaggtttgaagctaattacattggcactgcgtgacaaggatggcgcactattgactggtgacgctggtctatcagaatcgggtattttcgaagtaacgacagcaatgttgggtgctaagttagctaacatcactaacatttcagctaacggtacagccatctatggtaacaacacgaaggttgaccaaacgcaaacgaagggcgagccttcagttgcgttggactttaatgatttgccatttgacgttaagcaaaaattgttgggtcgtgtgtcagacggcaagggcggttacttgcaagaaacacgtcctcgtgtcgctatgacgatcgagacgcaaacgattgatcgaaagaactcaatttactttggctttgctaatggtgaagtgcaagaaacggccgctaacgttcaaactgatacgaacaacgaagtacgtgttgacgatgctttgacgttcacatcgtttggcgttgaagagtggaacaaagaagccatgaaggtatacttctcaggtgacgctaagttcgacaagacggctatgcaagcggatgtctttggtgtgtcaacgccagcgcctactggaaactaaaacggattcgagcaacggctgacgctatgagacagtccaaatggggtgggaagcccaattgataattacatatatgagagaaggtaaaaccatgaagatttcatttaaagaattacgcaaggcgccgtttgaagtgaaagcatcatttaagaacttgcgtaagacatacggtgtccaactacaattggcaaaattgcaagatagtttgaatggtgaaccagttgaatccatgcaagctattttgaaaagctttgacgacacggttgagtatatctcagacatgttacatttgaagggcaaagagcttgatgctttggaagagttagagcaagaagaagtaacggcaattgcacaacgtatctcaatgcgtgttatggggatgtcagaagatgaaatcaaggaagccttggaaccatctgatgacgatgaagagggtttagagtagcaccccagcaacggatcatgacgtacaccaatcacttggctgacctacgcatgttcgctaaagacacaatgcagaacctgcactggtcgctggacgacatagaaaactcagactatgcggatttgatggaaatcatgaacacgactgaagcggataagattcaagatcctatggctatgatgaatctttatcaatcacttgattagaaaggaggaaatatggcaaaagaaaaagtagctggattaatgtccacggagattgggcttgatacagccaaggccacagaatctcttaaccaactgaaatcagctgttaaggaatcaacaaatgagtggaagcaaatggagtcccagctgaaacaatctggtgataccgttggtgccagtgaggctaagtataaagggttaactcagtccgttgagaagcaacaagacgtgttggccaagctcaagcaagagcaatccgaggtcaatcggtctacggaagctggagagcagacctatcagaagtatgcttcacagataaccaccgcagagcgtcaattagcttcgatgacagctcagcaagccaaagctaagacggcttatgagcttcaatcggacggaatcacagagcttaaccgcaagattaaggaaaacgatgagctaacaaagctccaaacagaccgcttagatgccgagggaaagaaaactgaatcggttgctaaagccaaagaggggctaagaaccaagatctccttgatgaacgagctgtacgagaagcaagccagccgacttaagcaacttgaattagctgaaggtgacaataccgatgcaattgccaagcagaggcttgccttagaacgtacgcacacggctattgctcaagcagattccaacatgaagggtctatcaaagacttctgagaaggcgtctagcacgttttctgaagttttcaaaggaacagccctagcacaaggtgcaattcaggcatttaacagcgtgaggacgtccatagagggcgctatcgaggctggagcggagtataacaaagaacaagacacgatgaagaccgtctggcacgctttgacgacagaagcgcccaaagatggtaaggaattggttggctttatcaacgatatggccaactcatctatctattcagctgattcaatcaatgagatggcacagtccttctaccacgttgattctaacgctcaaaagacgaaggaatggacccaagacttcatcaatctgggctcaacaatgtacttatccaacgcagaaattgcggaatctggtaagacctttgccaagattgtcgctgggggtaaggttggtgctgaagaccttaatatgatgattgaccgcttccctatgtttggtgaggctgttcaaaaggcatctggaaaatcgatgcaagaacttcgtcagatgtccgcacagggtaagttgacctcagatgtcttcgttaaggccatggacgagcttggcgctaagtataaggacggtcaagctgaggctatgacatcgttccaaggtatgacgatgtaccttggtaagcgtagagcacaactgtttggagaaattgagcaatcatcattcaatatgtcgaagaagatgaagtctgatttattggacatcacttccgataagtcgatggagaaatacgctcaagcaatttcaaaggcaatgggcaaagtcatggctgttgtcgagaagatggttgaatatatccgagctcacaagaaggacatcatggagatgttctctaacgttgccaatattacaggcatcctgggcggggctatctggaataccatcaagggcacgattcttggtgttgctaaggccataggttcgataggtggcaatgctaagaaatcacatgacccacttaaaacggtaaacggtgctctggaagccatattgaggcataagggtgctatcaaggcacttggggcaacgattgccacagcctttatggctaagaaaatgattgatttcggtaagggtgttcattccaccatatctgacatcaacggtatgcgtcaggcgcttgtaagattagccacgtctgagaaagttgcaacaggtgctcaaaaagccctaacaatggcgcaaaaagcattcaactttgttgttaagaatagtcctattggacgtgtcgtgttgattataaccgccttaattggtgcgttttatgaattgtacaagcacagtaaaaagttccgagcgttcgttgatgggttggttcaatcagctaaagttctgttcaaaggtctgactaagtggtttggtgatgcgttcaaatggataacaaagttttcaggaaacttcaccaagaacttctcaaagggctggcattcgttcacggatggaattggcagagcatggaacataacgtggtcatacattgggaacgtgttggtaagttatatcaatatgtacaagcgtattattaggacgttcattgatttcttcactggaaactggggaaatcttggtaaggatgttcgtaacatatggaactcgttgtggggctaccttgaggcagtctttggcaagagggttggttcaatcaagtcaggaattgagaactttggtagttcaatctggaacttgtttagtcgtatcaaggacaaggttacgagtttctggtctgatatgtggaacggcttaaagaactttgctcgcgatggtatcaactcagttatcggcgttattaacggcggtattggcggaatcaacacggtcattcatacgtttggtggcaagaaaaatgctatcggcactattcctaagtttgccaacggtactaagggtgctccaaaggggttggccatcgtcaacgatgcacccggagaacactataaagaagcaattatcgacaactctggtaaggctacggttcttgaaggacgtaatcgattggttgagttcagtggtggtgaaacggttattccggcacatgcattgccacacttcgctaacggtaccgacaactggcttgatacagcggtggggtggattaaggataagtgggacaagctaacggaatttatcagccaccctatcaaggcacttggcaatatcatgaacaaggcagtgtctggtgtcacgggaagttcattggtgactaacattgcaccagctatgtctaacgggttggttcaaggtattgcagagccaattgtcaacatgttcaagtctttgaagaaaaagcacgatgacgagggaacgtctgctccagctgggtctggtgtacagcgttggaaggacttagttattaaggcgcttgataagaacggtttgtcaacgtcagagagcatggtccaaaaggtgctacgtcagattcaaactgaatcaggtggtaatgagaaggctgtccaaggtggttacacagatatcaatacgattactggtgaccttgctaagggacttatgcagactatctcagcaaccttcaatgcctatgccttcccaggacacaagaatatcttcaatggttacgataacttgttggctgcgttggcatacgctaagaaccggtacgggtcaaacctagcgggacttggtgagggtcacggttatgctcaaggtggcattgtctctcaacatggtttctatgaagtcgcagagcaaaacatgcctgaaatcatcatcccgctggatccagccaagaagattcgtgccaacgagttacttgcacaagctaaccaacgtatcaacggtacacaggcccaacaggttgttgttcaatcagatacatcccagttggagcataagtttgataacgtgattactttactgtcattgatgctaggtgttaaccaagaccaattgaagactatgcagtctcaaggtggtatcaacctacctaaccttatgaatcagatgggtatgacacaatcaactcataattatcaatcaatttaatcgaaaggaaatccgttatgcaattattcgtgcagccctatggtggcaaagaatttgacttgacggctaggttgccctctgtggtatttctagacatgaaggtctcagcaccacagctaacaggtgactggcttaccatagcaggctcagatggtcaaaggttacagaacgccacttatggcgccaatcaagtcacagtctcattattcattaagggacgaaatatggctgatttcaggttgctgaaggctgagttacaacgggtgttttaccaacgcggtctgatccgattgagaagctcactggaaccatttaaggtgtgctgggtcatggctaacccaacagacatcacaccgattcaagcgtcatcacaaggaaccgtggatcttgtgttcaccaatccaagtggtatggcacagagtttggtcaggtcagataagttacctgatgacttagacagtttggggttcggtatgaatctaccagccaggccgttgagctatgttggtaccagtaatcagttcaacatttacaacccttcagatgtggccattgacccatacgttaaccaccatgatttagtgattacagtgaagggttctggttcatttactttgacaaatcagacaaatggcaccagtatcaagttgaatcaggaaattggtagtggtgatacattcatattgaatggtgtaataccaacgttgaatggttcaactgacgtagatacggattttgggcatatcgagttggaacgtggtgataatgacattcgtttaagtggactaagcagtgccaatgttacattcagtttcccattcttgtacttctaaatggcatacagcaaagataaggttgttattcaatcgagggacggcaagtccacacaagcattatcctcattgaatttcagtacgtttcagctaacccgtacgaagaatgaagcttaccaagttgatttccaagcgtatgacgatggatcacttggatttgccttgttacaagtggagaatctcgtgcaatatgacggtcaaacctatgtgattaaacaggcgactgatgacaacactggtggtgttcacaacgtaacagttacggcaacgcacatcttttaccagctcaacaatcggttccagtacaacgttagacagggtgataattcgttcagtctgacagacgctttgaattttctgctcacggatattggtgatggctactcatatcagattcatggtaaatttgacagcaacaagacgctaacagatttcgggaatacttcaatcatcgaagggttgtcaacgatcaagggtgcatttggaatatatgccatcgtacctgataacaaggccattcacttgtacgacaaagattcatatgttaagaacactcataaggtatttcgataccgcaatgatacctccgcagtccagctacagtatgacgcaaccagcattgtgaataccgtgcaagctgtatcaaccgcagagacaccagcattctcacccttcaaggtacaggacgcagattcagttgctaagtggggtatcaaagagggcgcaagggttgaaagtgacaagattacttcaacagacatcatgaagaacttggcttctcagtcatttgtattggagccctcgttggctatgacagttacatcagctggtaatgaagacgttgttttgggtgaaaattggacagtacagatgcttgataacgggttccagacttcagttgaagtggtcagcattgtaagagcaccgtttgcgacatcagcagttcagattacgttgaacaacacccgcaagaatttccttgacgcccaaaaggtacaacagtccgcagtcaacacagcaaaaaggaatacaggaacaacaggtaacatgtgggttatcggaaaggtggtcagctaatgacattaaatggaatcgacataagcaattggcaggctggcattaacctaagtgctgtccctgctgatttcgtcatcattaaagccaccgaggggaccacctatgtatcacccgaatctgatacgcagtaccaaggcgctaagtcagcaggccggttgttaggtgtttaccactttgcaacaggtgctggtgctgtggaagaggctaagttcttcctgagtaacattcaagggtatcttggagaggctgccctgttcctagactgggaaggtgctgttgtatcacaaggcgttggttacgctaaggactttttggattacgtgtaccaacagactggtatcaggccactggtttacatgagcaagtcagtcacaagcagttatgactggtcatcagtgagtgccaattatggtctctgggtcgcccaatatgcagattcaaaccccactgggtaccaagatgacccatggacagacgctaagggatatggttcatggagtgggccagcaatattccagtacgcttcaactgggcgcctaagtggctatgatggcaatctggatttggacaaattctatggtgacaccgcagcatggcaagcctatgctaagccggaccatatgacaccagaccctgatccaacaccggagccgacaccagagccacctaagagcacacctatcgtgcaatatgctgaccccgatggaaataaggcttatgcatatacacattggcaagctattgaaggtaagcctgacttgagcacagttgtattgaccagcccgaacggtaccaagtatcagttgcaggttgacgataagggaactctgacaacaaaggtggtgagtgaatgattttagatttacctgagcgtatttctggagctgatgatacagctcaccagatttaccaagcgttctacgatgttggcatgattacagaagtgccgtcaccaatggaaacgctgaacattacggaatacaacgagcaagcattctcagaaattgggagtgctttaattttgctcaaaaacaacctcaatcgactggtggacatcttcaatgaatatcattttgtcggtatggagggcatacaggccaaaggacatgaatactggggaagcaatttaagtgaactggggggatcttatgatgatttcaacggtcacttggttgctatggaaagtacattgcaaaatatggttgagattatgattctcaacggtttaatcgaaaggaattaagaaaatatggctacacaagcacaatcacagggtcgctatgccgttattaacacgttgctagactcaactgatgtaacattgattgactcgctatcaggacgacaaggtgataacggacggatcgtttactttgctatcaaggacggaaatttgccacacaatcttgacggtcaaaacgttgttcttacggcaaaggattcagcaggtaaggttaagcaaatttctggggttcatgacatgatttcagccactggtgggttgttttcaatgctaatcccaggagagatgtaccaatcagctggtgacattgaagaagcctacatcagtgtacaagataacgcaggtacggttattagctcaatccctgtaacgttcactgtggttgccaacaacattttgttcacagctaacgcttctaaggactacatcgattcagtccaaaaggctgtcgacgaggcaaactcacgtatcacaggcttgaatgacaatatcaaggcgcaacagcttacttacgagacgttgaagacctcagttgagaatctggcagggcaaatcgactccaagcaagtggctatgttgaacgttgaaaatcacttcactgaaacggctactttcgataaggggattacagcagacaatgtaaattctaacggtggggttacggcaaagacaatcagcacgcctaactttaagtcagacggaacttctatccaacaatcaagggacggaaagacttggcacaacttggcggacgatgatggtgttgtgcataactctggaaatgaagttcttgcgggtgataagacgttcacaggtaaagtagctatttctggaacattagacgctgcgcaaaaaacttataacagaactgttgggacaactaacgatttgcaaatcacatacacaagagttggtagccttgttacagggcgatacgttgtcaagtttgcaggtacattcccattaggtgctaacgatggttacaagtcgactagtggctatccggttaatgcgatagtcggtagtggcgttaacgcatacttcacgactgataataagtttgtagcggacaaagctagtgaaggaaactttgtgtttatcacttctgaccctctaccaaagaactagtgaggtataagcatgggattttttccgcacgacttagcgggctggctaacagttgtcggctcattagctggcgcaatgtgggttgtcattcaaaatacatttgttaagtcgatgaattctttgaataagtctatcgatggattacaggaaacccttaagtcctatgacagacggattgatgaccacgaaacacgtatcagagtaatcgaggactggagagagcatcacgatgacaatgaataacttaataaactttacagaagcgctatggcagtcaggtattgctccagcgcttttaattttggccattggttggctttcgaagcgctttgccaacaataagaggctcacagccttgttagatattgcagaacatgcagtgaattgggctcaggtgaccttcaatggtgggcaaacgcaaaaagcacaagccatcaagatgattacagattatcttatgaaagctgacaaggcacacctgttcactgctaagcagattgatgaagctatcgaaactgcagtgaaagacatgaaaggacaaaaataaatgacagtatcagtaagttttgacacaccgcaaattcaagtaaataacagcagtacgggtattcaactatcacaggtaatcttgccttattcaatccgtagctcagaaaacttcggacaatacttgggcggtcagatgacgttaggacaatccgatggaattaagttgactgacaacacgaaggactgggaacgccttggcttggctaagattaagaacatggtggctgacgcagaaatctatgtaccagacccagtcattgaagttcctgaaggactacctgcaagctcagcagtagaagctccagcaagctcagcagatgattcagtagcaagttcagaagctacggtagcaagctcagcgacagaatctccagtaagctcagctccagaagttccagcaagctcagcaacggaggcgccagtaagttcagcttcagaatcaacaacggaggaataatcatatgaataaattgctaaaaagcgctttggcttcggctggggcgcttttaattatgggatcagtaccatcagtacatgctgccaaaggcgaccagggtgttgattggtcaatctatcaaggttcgcaaggtaagtttggatatggtcatgataagttcgcaatcgcgcaaattggtggttatcacgggtatatctatgatcaatctacttatgccacgcaagtccaatacgcaattgcccagggcaagcgcgctcacacgtatatgtggtggcaagatatcactgattatgcaacagctgatagggtattggactacttcctgccaaaggtacagacgccaaagggttcaatcgttgcacttgacgttgagagcggtggacaaaacactgacgtaatcatgcacgccttgcaacgcattaaggacgctggttacacgccaatggtttatgggtacaagaactacttgcaagcatctacagacttgcaacgtatcgccaattcatacgagctttggcttgctgaatatccaaactatgaagttacgccagagcctaattacaactatttcccatcgtttgataacgttggactgtttcaattcacatcaacttatgttgccggtggtttggacggtaacgttgacttgagcggtgttactgataatggatacaagaacggtaatcctagcaagccaaacacgcacacgccagctgtgaatgccggtaaggaagccgacaacactccgaagtcagatattgcagcgggaatgaccgtgaaggttaacttcagcgctacgcactatgcgactggtgaaactatcccagatttcatcaagggtgtgccacacaaggtgcgagaagttgatggcgaccgcgtgttgcttgatgatatttactcatgggtaaacaaaaagaatgtcgaaatcttggacgctaacacgcaagatgactcggcagagtttaacggtgtattctatctagatagctggcaatatgagctgggcggtgtgtacgttcgaaacaatgatatggctattccagtagcagattatcacaacgatatgccggctgtatcagtaacgttgaccgaccgtcatggtaacccattggcggaccaaaacggccttggcaacaacggagttccggaatacttcactttgaatggacgatacaaggtattgcaacgtgttggatcatctatcgaagtagaaatgaatggtgagtcagtttggttgaaggctgcattcgctaactagtttaaattgggccaacttgccacattgaaacagatacgcaagttggtccacatgtaaaataagcccgtctggactaggtgttattgcacttaatctaggcgggcttttttgcttaattgattaatactggcactttaaaacacaaattataatgagtcgaagcttaacaaaatttaggtatttgtaatataagccattgattaatggtggtttatgctgtattataaattaattatcaaatttaatggaggtttgcatgagtataattaattctaattctaacgagttagcacttgctaactggctctatgaaaacgatccaaggtcatatcaaaatacccgtaagtttcaaaaatttttgtttttctacgaggttttctccaaggtaaacgaaaaagaatatgacttgggtagatttaaaatttggatgcacggcccagtcaattcggtagcgtatggtgattatacttataggggtgccgattttgtaactgcttttaaaaaagtagaggagaaggttgatcaagaaatcgcacgcaaggcggattttttggttcaaattttaaacactgaggaaatttctgaactgactcatacgtttgatttttggaaaatacctgccattgaattgtcaggaagttggaatgataatgtttcagcaaataaaaagaacttttcttctactgacatggaaagggcacacaagctgtacacaatgtatgatgatacgtttataagaaactccgaagtcattcatacgttcggtaagcattttgttatttctaagagcgataaagaaaatcttacttctgaacatattgaggtattggaaaagctgtcaactgatacgagtcttatgaacccaatatttgttgaaattgacaatgacgggaggctggcaattgattaatccttccgatgttgtaaaaatgtttataccctttccgagtattgaatccggattagcttataaaaaacatatgtatgttgtggagaatgataggttttctgtttttgcgattcaaacagctaaacctcaacttgtagagcaagcggttttaaataactacttagttctaaatccaggtgatatgtctcccgttgttcgacgatcttatttagggatggatactaggtttatacttgaaggggttgaaatttcggactctgtaaaggcaagtattggactttcggagtatctattcgatatagtaaaatcaaaagctagatttgttactgacaacgtagtgttgaatcaaagagaagttgcacagcttaatgaaggtgtgactttgttgtaacgcgaactaataaattagcccgctggatttggatgaacttccttgtctggcgggctttttattgtacaataattaggtgagaaatggcgggtcataccctgcaaactaaaattggattcagcttagtttgcgccactaaatacgaggcttaatatttgcgccatatttgcgccagtaaacgctcaaactactggtgtataagcatttaaacattcccacgtacaatgaaccgtttgtggccataagcttaaatacaaacattaataaaccgctgaagacagtcgttataactgttttcagcggttttttatcatagtgattattttggttgcttgtttttcttttttcgacgaccgataaagaatagtgctaccaaccagaaccagggacgtagccacaatgggcgattatcattattatccatgttgcaaatcctcctataacgtttagcgtactctgaatatgaccatcgcgttgacggaaatatgggggtataatagaaaaatcgaaaagtatggggtacatgctttcaaattttagttaggggaacgtatgacagataaattaaattttgcagcgtttatgcaagctggtacaacgagcatcagtaactatttactacaacattaccgtgaccttggcatgacgaacgaagaattgcttgtttacgtgcaaacgaaggcaggtattgatcgtggcgaactagaacctagcacgcaaaaaattggggagacacttggctgggatgcgcagacggtgtttggacaccttgaagcaatgcgcgccaagggattggttaattttgttagtatgcgtgatggtgctggtcgcgttagcacacagttggatttccaaccactatatgacaagttggtttctgaaccaggtagtgatacgatgactgcggcgcagcgtgttgccacgcaaggtcaaccagtaacacatcaggacgatttgagtcgtgcagcgatttataacttaatcgagcaagagtttggtcgtccgctaagtcagatggagatggaaaccgttaaaaactggtttgacgtggatcatttcaagcccgaatttatcaaagcggcggtgcaggaagcggttctgaatgctgccttaaacctgcgttacattgagaccattctggtggcctggcagaagaaaaattatcgttcagttcaggaagttcgccaagaacgtcaaaagcggacgcaattcaagcagttgaattcagatgaaaaagttaacattccaacgaatgttgatattttgaatactgactggtcaaaatttaaataataaaaagcaaggagccgaacggtaattaaaccattcgactccttgcttttttatttaattactgctgtcgttgttctgaggacgaactagcaggtggggtacttgagctctgagctgatgaacttgcaggcgtagaagaacttgctggttcattcgatgctgctggcgctgaactttcagcgggttgtgagctggctgttgagcttgatgatggcgtgtacgttgacgtagaacgtgaagaataagaaggtgtgtatgttgatgccacaccgaccgtcttttcgtttgctacgttagcaccggccacttggtattccttcttaccgtaaacattaacttgcttaacggttgaaggaacagtccaatctgatccgtccattgaagagtcagacattacgtaatccatcaaggcgccataaaccttcaacatgatgtattgttcgttaccagtcaaatcgtggccgacctcgtttggatcgtcataacctgtccaaacagaaatggcagcactcttagtgtatccagtgaaccaagtatccattgctgaatcagctgacatgtttgaatcttcgccataagcgacggttcctgtcttaccagcttgattataagcatcggttgcaatcatcttggcgtatgaatcgctgataaccgacttcaacatgcttgtcatcatgaaggctgtagaagacttcatagcctctgaacccttagaactaaacttcttcacggcaccactacggtcagtaatcttagaaatgtaagatggcttgtaataagtaccaccatttgcgaaagctgagtaggcggctgcttcttgctcagttgaaatgtcaattccaatggcatttgaggcaaccatctccttaggatcttcgttaataccgagcttcttaaggaatgcagaagatttgtcataaccaacttcttgcaacgtttgaacggctggaatgttacgagattgtgcaatcgctgtacgcattgaaatcgtaccaaggtaacggtgatcaaagtcattcacggagatgtttgtgccaggatacttgtaggcattgtcatcaacggcgtggttcgttgaccagttcatatcttcaattgctggaccgtatgcgaccaaaggcttagctgttgatccagatgaacgcttggtgttagttgcgtggttggtaccaaatagggttgtttctttacgaccaccaatttgggcaatcacgtcaccgttgcgagggtcagtaactgtcaaaccaacttgcatctcatcatcaggccaagcaacatagttttctgtgttaacaatgttgtaggcgcggttctggacctttggctcaagattcgtttgaatcgtcaaaccgtcagtgtcaggattgtagccaaggctcttcaattcagcattaaccgatgtgatgtacgcttggttaatcttggtcttttcttcagtgttttcaagttgatctgagtgagttgagaccaaaccgtcgtcgatcggcgtcttcatgtactcattggccttagattgcgtgataacgccgttttgggccattgcttcaagaacttcgtcacgacgattcttggcgtcctttgggttagtgtatggatcataaccagtaggtgattgtggcaaaccagccaacaatgccatttgaggcgttgacaactggtcaagcgacttaccgaagtagtaatcagcagccgtcttcataccgtaaacaccgttacccatataaaccttgttcatataaagcgtcaaaatttgattctttgagtattgcttctcaagcttcaaagcaagccaagcttcttgtgccttacgcttcaacgtttggtcactagccgcggttgagaaaacagttaacttaatcaattgttgcgttagggtagaaccaccttgcaaaccaagtgatgaaccagtgaagttagcaaatgcagcgccgagaatacggcgaggatcaacaccgtggtgcttgtaaaagcgacgatcctcaattgaaacaacggccatacgcatttcttgtggaatctcagattgcttggcaatctcacgcttttgtgagccacttgtatagaaaacgtcaccgttcttatccaagtattgggtttgtgaagtgccgacaagagcagcatttgtcactttaggtgctgatgaagcatagtaggtgaaagcaccaactccggccaatgtgccggctgcgccaagcgtcacaagcgttagcaacgtatactttgtatagcgcttccactttgaagttggctgggatgtcttcttttttgagcgtaacctttgcacgcgtgacatctcttctgtcataacaaatagttctccttatactttacgttgattaagcaattcatcaatagcggttaagtagggcgtggttgggttgattccgaggggaactaacgcaccttctgccttaataacgtcgtatggaatcgactttcgttgggtttcttgattatcccaataagtgaataatagctctgcccaaatgacgtaagtctcatttaggttggaaaagcgaataatcatgaaagcgagtccatgctgtgtaaccacttgcttcaaatgcttaatctgatgttcatggacatttttcaaaggaaatgactgcttattggtcgtttccttcgcatcgaagtcgatatattgcccattataaacaccattgtaatctgtggtagaagcctgtctaaaatatgcttccgtaattttcgcagctgaacgggcggggtagctaacgttaacaatttgaataggcgtgggctttttatgaatcacagccttatctgttgctaggtagtacgcatttgcgtcgttcaaatcattttccaatgacatgccacgattactttgggaaacaccttttgagaccggctttgaaaacgcactcggattaaattggcgtccatttggatagttaatagccatttcgtactcctgcgtcttaaggtatcctttatattatagcaaaatgacaattattctgacaaactttcctataatgtaagtaatacgtaaagaggtgatgacgttgacagttgatggtgaattgcatcgaatttggattacagggttccgcagttatgagttgggcgtgatggggacaaaagacccaaagttgatggtaattaagtatgcattgcgtaaaattttggaaaacgcgattcaagatggtgctgattggttgatcactggtggccaattaggtattgaacaatgggcgattgaagttgcgttggaattgcgggacgaagcttaccctgagttccagattgcgttgatgacgccgtttagcaaatttggtagccaatggaatgaagcaaatgctgaaaaattgacgcagctaaagtcatcagtcaattttacaagcgctgtttcgcagggtgactttgcaggacgcaatcaaatggtgacttaccagaattttatgttaacgcacactgatgaagctgttattttcttcgatgaagaagcaagtgaatcaaaggcgcgatatgatgatgttgccattcacgattttgcggaaaaccatgattatccggtgcgccgggtggatttggaccgtttgcaagactacgcaaccgagtaccaagaaacgctttgggaagactagggcacaaacaattcacataaagtgcttttgtaactgagtttaaaacctgttaaactaataatacgaacaaaacggaggagtcctagtgatggaaaacgtgctacacaaccgcgaggaaattttgacgaaggaatttaagaagacgcgtatcggtactggatacgatatgacggatgtcgatgctttcttggatgaaatcatgtcagattatcaagcgttccaaagtaatattgatgaattgacgacacaaaacgagaagttgaaggcgcaagttgctgaattgacgaagcaagtatcagctgcggcaacggcgcctaaggcatctccagcgccagtggcaaacacgaacatggatattttgaagcgtttgtctaacttggaacgccgtgtatttggtacggcttcagaggcgccaacaccagttgctgaagaaaaggctacacaaacggctgaataagtgtataataagtaaatacgatgtattagcgggtaattgcgtatggcttatgccgtatgaggaaagtccatgctcgcactgactgcgatgtcagtagtgttcgtgctagctgaaaaaataaggctaggcagccgacttgtcggttgacggccaacgaaagacctacgggtaactatggttgagtagttgttaaagtgccacagtgacgaaccgtcaaagaaatgcgacgggtggaacgcggtaaacccctcgagcgggcaacccaaactttggtaggggcgcttgacctaacaaattgaagtgatggtcggggagacagaaatgtctgagatagatgattgccaccgggtattgaccgccaatcaatattcggtacaaaacatggcttatagctgatgcatcaggcagccgacgtccttgtggcgtcggctttctttttgcacttaaacccaggaaactgggatacataaataagaaaaaaggtgacaattatgcaaacatttaaattgatggccaccatgggagcaggacttgaagcccttgttgctcgtgagctgaaggacatgggttatgcaacccaaactgaaaatggacgcgttttcttccaaggaacggttgaagatatttaccgcaccaatttgtggttgcgtgtagctgatcgtgtcaagattgtggtgactgaatttgatgccaagactttcgaccaattgttcgagaagacgaaggcattcccatgggaagacttgttgccatatgacgctgagtttccagtaaacgggcgctcaaagaactctattttgcactctgtaccaactgtacaagcaatcacgaagaaggcgattgttaaccgtttgacggatgcctatcacgcgcgtggctacttgccagaaacgggaaaccgttttgttttggaaacggccgttgataaggatcacgtcatgattacgttggatacgacaggtgattcattgtttaagcgtggttaccgtactgaaaagggtggtgcgccactaaaggaaacgatggctgctgcattggttaacttggctcactggtttacagacaatccatttgttgatccaacgactggttcaggaactattgctattgaggctgcgttgattggtcgcaacattgcaccaggattgaaccgtgagttcgatattacgcaatgggactggttcgacaagaagattggtgaaacgttgaaagctcaagcacgtcaaatgattgactttgatgttgagttggatattgaaggattcgatatcgacgaaaacatgattgaaatcgcgaaggcaaacgctgaagctgctggtgttggtgatgacatcacctttaagcaattggctgctaaggattggtcaactgacaagattaatggtgtgttggttgctaacccaccatacggagaacgtttgggtgatgaggatgctgctcgccaactttacagtgagatgggtcacatctacaacaacatgccaacgtggtcaaagtacattttgacgtcagatgaaggctttgaagaagctttcggtgctaaggctactaagaagcgtaagttgtacaacggtgcattgaaggttgatttgtaccaatactggggaaagaagatccgctaatttttaaagattgaaaggggcaaacacatgagttcactacttgatggcatgaacgacaaacaggcagaagcggttatgacaacggaaggtccgttgctaattatggctggtgccggatctggtaaaacacgtgttttgacgcatcgtgtcgcccacttgattaaagatttgaatgtgatgccatggcgtattttggccatcacatttacgaataaggctgcccgtgaaatgaaggaacgtattggtcaactagttgacgctgaagatgcggatgccgtttgggtctcaacgttccacgcgttggcagttcgtattttgcgtcgcgatattgataagttgggctacaagaaggacttttcaattattgatgccggtgcgcaacgaacattgattaagcgtattttgaaggatatgaacgtggatatcgaaaagtatgatccacgttcagtgcttggggccatttcaaacgcaaaaaacgcgatggaaaagcctgagaagtacgaagaaatggctaatggcccatttgaagagattgttgcgaaggcgtacaaggagtatcaacaccaattggcgttggcgcaatcagtcgactttgatgacttgatcatgttgacgattgaattgttgcaccaagaacaagaagttttggaattctaccaagaaaagttcttgtacgtgcacgtcgatgagtaccaggacaccaacgatgcgcaatacgaattggtcacgttgttgtcagctaagcaccgtaacttggccgtagttggtgactcagaccagtctatctatggttggcgtggtgcgaacatgcaaatcatcatgaacttcaccaaggattatccggatgcgaagacggttatgttggaacaaaactaccgttcaacgcaaactatcttggatgcggcgaatgcagttattgaacacaataacgagcgaattgcgaagaatctttggacggacaacggaatgggtgaaaagattacctattaccgtggtcaatctgacaaggatgaagccttgtatgtcattgcccaaatccgtgatggtgttaaaaatgatgagcgcaattaccgtgattttgccgtcctttaccgtacgaatgcgcaatcacgtggaattgaagaagctttggtgaaggcgaacatcccttatacgatggtcggtggatcgaagttttatgagcgtaaggaaatccgtgatgtgttggcctacttagctttggtgacgaatccggctgataatgaaagtttcttgcgtgtcgtcaatgagccaaagcgcggtattggtaatacatcaatcgaacgtttgcgttcatttgccttgcaacaaaactggccattattggatgctgcccaaaatgcggtcatgattccaggcttgacgacccgtgctgctaaccaattgacacaatttgctgatttgattagctcacttcgtcaacaaatgtcatttgatttgagcatcactgatttgacccgtcaaattttggaacgttctggttacgaggagcaatttaaggcatccccaaccccagaaaaccaaggccgtctagaaaacttggccgaattcctgtcagtaacggaagaattcgacaaaaagtacgagccaaccgaagaaagcgtctcaaagtacgtggacttccttggtgaattggcgttggtttctgatttggatagtgtcgatgaagatgcagacaaccaagtgacgttgatgacgttgcacgctgccaagggattggaattcccagtcgtcttcttggttggtatggaagaaaacttgttcccattgtctcgtgctgcagctgatgacgcccaactagaagaagaacgtcgtttggcttatgttggtatcacgcgtgctaagcaaaagttgttcattacgaatgcttattcacgtttgctatacggacgaacgacaagtaatatcccatcacgttttattgatgagattagtccagagttgattcaacaaccagctggtcaaacgttgtcaacgactgccaatcgtgatggtgctttgccctttgcccgtcgcacacaacaagcgacggcaacgacgtttgctggtcgtcaacgccaatcatcagtggcgtcaacgccaactcgcacaacatcttccatgacaactaacaacccaggaactggcgctgataaggcggcttggacaattggggatgcggttagtcacaagaagtggggtgttggtcacgttgtgaaggtgtcaggaactggtgaagaccaagaattggacattgcgttcccagatcaaggtatcaagcgtttgctggctgcctttgcaccaatccaaaaagtcaattaacaaagagggactgttgaatggcagatattaatacggatattaaagatctttcacaagaagacgcggcgactgagattgctgctttgcaagctgatttgaagcaatgggcacgtgaatattatgagaacgatgcaccgtcagttgaagattcagtttatgacgttgcttataaccgactagaagctttggaagctgctttcccggcgttggtgacggctgattccatcacgcaacaagttggtggtcgtgaagtgaagtcagatttgccaaaggttgcccacccggtaccaatgttgtcactaggtgacgtcttttcatttgaagagttggcagactggatggctacgacacaaaagtcattccacgaaccactggcatacaatgcggaattaaagattgatggtttggccatcagtttggtctatgaaaatgggtcacttgtgcaagcgtcaacacgtggggatggtagcatcggtgaagatgtgaccgctaacgtccgacaaatcaagcgtatacctaagaagttgaacgaaccactgaccgttgaagtccgtggtgaagtgtacatgcctaaggctgcctttgtgacgttgaacgaggaacgcgagcgtgacggtttgccaacgtttgcaaacccacgtaacgcggcagctggttcattgcgccagttggatgccaaaatcacaaagcaacgtcagctagatgcattcttgtattttgcggttgatgctgaaaacgttttgggtgttacgacgcaagctgagctgttagctcgcatggcagaacttggtttgccaaccaatccaaccaatgcggtggtaagttcagaagcggatgttgaagcttacattacgaatcaaacagcgactcgtgatgacttggcttatggtatcgatggtattgtcgttaaggttaataacttggcttaccatgaagaacttgggaacacggtgaaggtgccacgatgggccattgcctataagttcccaccagaagaagcgttgacggttgttcgtgatattgaatggacggttggacgtactggggcggtcacgccaactgcggtgatggacccagttcaattggccggcacgacggtttcacgcgcctctctacacaatccaacataccttgaagcaaagggcattcgtatcggtgatacggtgacgttgcacaaggctggggatattattccagagattggtcaagtgattttgaagcaacgtccggcggattcaattgaatacagtatgccgttgggttgcccggcctgtggtcaggaattagtacacgttgatggtgaagttgcccttcgttgcattaacccattctgcccggcacaagtacaagaatcattgacgcactttgcatcacgtgatgccatgaacatcgatggccttggaccaaagattgtggcacagttgcttgataagaagatggttgatcaagtgtctgatttgtatcgtttgacgtttgaacaattgcttacgctggacaagtttggtgaagtgtcagcaaacaagttactaacggccattgaaaattcaaaggctaattcagttgagcgcttgttgttcggacttggtatccgtaacgttggtgcgaaggctgcgaagacgattgcggctaagtttgtcacgttggatgccattgctcatgcaacagccgaagaaatttctgaattgccaggcatgggattgattattggccacagtattgcgcaatacttcgatacagatcacgcccaagagctggttcgtgatttcgaatcacttggcgttaacacgcgttatacgcaagcggttgaagttgccactgacacggtcttttctggtaagcgtgtggttttgactggaaagcttgagctgtttagtcgttcagatgcgactgcttggcttgaagcgcaaggtgcaacggtgagtggatcggtgtctaagaagactgatttgctaattgccggtgcagatgcgggttcaaagttaacaaaagcccaagaacttggcatagagatttggtcagaatcacaattgcgtgatagtatggaaagtaaataataatcaaaaacgaaaccgctcgatggtagtgtcgagtgggtaagaggagtttttcatgatgcgtgcacttaaatggattgctgcactagttgttgtggcagttttggctgtagcattggtcttctttggtaactttttctcaaagaattcgtcatcagttaataattctggtacgacgaagacaacgcgctcatcttcatcaaagaagggtgttcaggttactggaaaagctgatgactcagtttataagactgtcgtcaaggacggtaagtatttgacgaacaagacccgcggcttgacggctcaactgaattccggtaacacctttaacctcgttggttttgaagacgggctgcttgacttttctaaggagcatttcagtacatctaagtacgtgttccaagaaggtcaatacttgtctatgaaaacggctatagaatggttaaaccgcaaggcaggcgataatccaacaggcctaaaccctgaagataacggtaagactgatgattcacgtgcaccaatctacttgcaaacgattgaagaacaagacttcatgacgcaagacggtgataacttgaagttagctggaattgtcatcggaatggggatgaacacccaagacgtatatcaaaaggaaaaagatggtcctagctttacgcaagatattgataaggctgaccgcattgctcacggtaaggaaatggcggctgaggtcgttaagcgttaccgtgcaatgaaggatattcctgctgatgtcccaatctacgtggcgatgtacgcccaagccaaggatgattcattggctggtggtagcttctacagctggaacgtatctaagtcaggtgatgcacttggttcatggactgacttgaataatcaaacggtcgtgttgccaatgcaagaaggtacgacgtcatcaaagtcggttgcaagttcattgaacacgagcttcacgaactttgtcgacaaggtacaaggattcttccctaacttggcatctgtgactggtcaagccgcataccgtgatggtacgttgcgtggtttgaatgtgacagtctcaacacagttctattcagcaaccgaaatccaaagttttgctaattacattgcgcaaatcgcaccaagttacctaccaaatggggtgccagttcaaattcgaattgaagcgtcaacaggtatgcaagcttacgtgacgacggacgcaaaggacaacaaatacacagttacgattctaggatcatactaattatttgaaaccagaccaatttggtctggttttttgcttgcattcataaacttaaacaagtatagtagtaaaaatatatttttttgggaggatgaatgaaatggggatgcatcaatatttatcaggtttgaatgaacttgaaatgatcacacgcgcaccggggtactttaagtatcaacctcattcagtggccgcccactcatggaaggttaccgaggctgcgcagttcttgggtgacatcgaagaacaagcgggtaatgatgttaactggcgtatgctttacgaaaaggctttgaatcacgatattacggaacgttttatcggtgatattcgcacaccagttaagtatgcgtcagcaaccttgcgtcaaatgttggctgatgtggaagactcattgtcagataactttgtaaagactgagattccagttgagttgcaggaagcatacaagcgtcgtcttcacgagggtaaggatgacacgcttgaaggacgtatcttgtcagtggctgataaggttgacttgttgtatgaagcatacggcgaattacaaaagggtaacccagagcctgtgttcttggaaatttacaaggaaagcttggaaacgattttcgctttccgtgacatgccaagtgtggcttactttattcgtgaggtgctgccagagttgctggacgagcaatttccaggttcagaacaattacaacgcatctacatcggcatcttcaatgcaaagtagtcataagttgttataatgataaatagagaagtccactgttctcagtgggcttttgtgtttgttgagagaaaataactattaatgcagaaagtgagtaggcgaatatgattaatcgtgatgacagccatacctacgaggttgtgtcaaagtatgagccaactggggatcaacccacagctattgataagctggtaactggcttgaagaatggcgttaaggaacaaatcttgttgggagcaaccggaactggaaaaaccttcaccatttcaaacgtcattgcccaggccaataagccagttttggttttgtcacacaacaagaccttggcgggccaattgtatggtgagttcaaggaattcttcccaaataatgcggttgagtatttcgtgtcttactatgattactaccaacccgaagcgtatgtgccatcttctgacacgtatattgaaaaggactcatcaattaatgatgaaattgataagcttcgtaattcagcgacggcatcattgctagcgcgtaacgacaccatcgtggtggcttcagtctcatctatctttggtttgggtagtcctgaacaatataatgatcacgttattaacgttcgtgttggtgacattatcgagcgtaatgatttgatgcgtcgcttggttgatattcaattccaacgcaatgatatcgacttccagcgtggtcgcttccgtgcgcgtggggatgttttggaaatcttcccagcgtcatctgacgcgaaggcgattcgcattgaattctttggggatgaagttgatcgcattcgcgaagtggattcgttgactggtgaagtgacggctgatttggatttggcaaccatcttcccagcaacccactttatgaccaatgatgagattcgtgagcgtgctttgaagacaattcaagccgagttggacgcccaattgaaggtgtttgaagaagaaggtaagttgttggaggcgcaacgcttaaagcaacgtactgaatacgatattgaaatgattcgtgaaatgggcttcaccagcggtattgaaaactattcacgccacatggatggtcgtgcaccgggtgagccaccatttacgttgctcgactttttcccggatgatttcttgattgttgtcgatgagtcccacgtgacgatgccacaagtacgtggtatgtataagggtgatcgcgcccgtaaggaaacgttgattgattacggattccgtttgccatcagcgttggataaccgtccgctccgtctggatgagtttgaagaacacgttaaccaaattatctacatgtcagccacaccgggtgattatgaagaagagcgtgtgtcaaacaaggatgttgcgcaacaaattattcgtccaactggtttgttggatcctgaaattgaagtgcgtccggttatgggtcaaattgatgatttgttgggtgaaattaatgagcgtgtcgccaaggatgaacgtgtctttgtgacgacgttgacgaagaagatggctgaagatttgacggactatctcgaagacgtcggtgtgaaggttaagtacttgcactcagacatcaagacgcttgaacgaactgaaatcatccgtgatttgcgtttgggcaagtttgacgtcttagttggtatcaacttgttgcgtgaaggaattgacgtgcctgaagtgtcattggtggctattttggacgccgataaggaaggcttcttgcgcaatacccgttctttgattcagacgattggccgtgctgctcgtaatgagaatggtcacgtcatcatgtacgcggatgatgtgacggcctcaatgaaggcagctatggatgagacggcccgccgtcgcgctatccaaatgtcatacaatgaggaacacggtattacaccacacaccattaagaaggaaattcgtggtttaattgcggtcacccacgaatctgacgataacagcaacaagtctgcaagcttcacagaagtggctttcaaggatatggcgcgtccagatcaagaagccatgattgccaatttggaagatcaaatgcgtgcagcagctaagcgtttggacttcgaagaagcagctagcttgcgtgatgcggtgatggaattgaagttgcaacttggcgtttaactccttttctgcccgaaaaggcctgttgagatgtgatatacttgatatacgatgtttatagaaattaggggtatatcatgagtttgaatttaagcgatattcaagcattgatgcatgattttgagcagagctcattacgtgaattcaagctagatactgaagaaacacatctttatctcagcaagaacgaccaagcaccaataatgatggcacaacaaccagctgccaacgtggcaacgccgactgacgaatcagttgttgtggatacaacggtgacgattaaagcaccacttgttggtaccgtttatttggccccaaagccagaagctgcgaactttaaatcagttggtgacacagtcgctgtcggtgaaacggtggccattgttgaagccatgaaattgatgacggaagtaaaaagtgacgttgctggtgttattacggctgttaatgtcgataatgaagctgtcgttggatacggtgatatcctgtatacggttcaaccggcatagtttgaaaggggttgggaatttttccagcctcttttcatttgatggagttaattatgtttaaaaaagttttggtagcgaaccgtggcgaaatcgccgtacgcattattcgcgcactgcatgagatggacatcaaagcggtggccatttacagtacggtcgacaaagaagcgttgcatgtgcaattagctgatgaggcaattgcggttggtggcccacgacctcaagattcatatttgaatatgaaaaatatcgtgagcgcggccttactaacaggtgttgatgccgttcaccctggttacggattcctgtctgaaaatgcgatgtttgtgaatatgttgacggatgttggcatcacatttatcggaccacacgcagaaacaattgccttaatgggtgataaggcgcaagcacgtgaaacgatgcgcgcggcaggtgtgccagtcatccccggtagtgttggcacgttgaccgatagcgccgaagcaatcgctgttagtgatcaaattggttacccagtcatgttgaaggcagccgctggtggtggcggtaaaggcatgcgtttgctaaacaatcgtgaagagctggcccaacaatttgagcgggcacaagccgaagcgaaattagctttcggttcagctgatatgtatattgagaaggtgatgacaaacgtgcgtcacatcgaagtccaaatcatgcgtgatcaacagggtcagacggtctttttcccagagcgcgactgttcaattcaacgtcaccaccaaaagatgattgaagtatcaccagcggttggtgtcacgagtgatatgcgttcagagcttggtgcgttggcggtcaaggcggcgagtgccttgtcttacgagaacaccggaacgtttgagttcttggctgaccgtgataataacttttatttcatggaaatgaatacacgcattcaagtggaacacccggttaccgaagcggtgactggtttggacttggtaaagatgcagattgccgttgcagctggggagccgttgccagtccaacaacaagatattcaaattaagcaacacgcgattgaagttcgtttgaatgctgaagacccgatgcatgatttccggccaagcgctggccaagtcaactttacgtacttgccatttggtggaccgggcatccggtttgactcagcgatgtatgcgggtgataccgtgcaaccttactacgactcaatgttgggtaaagtgattgtttcagcggataaccgtgatgatgtctttaaaaaattgtcacgtacgctagatgaagtggttgtgcgtggtgtttcaactaatctagcggtgcaacgggcattggttaaggatgaacgtgtccaccaaggccttgtaccaattgattttgtcgaaacggactttttgcctgcgtggtcaaaggaagaggtgcaagcgccatgacccaattatttgataatcaagctgataagtttaagcatgcgcctaacccggacgcgtttgataaggtcccggccggtagttgggtaacttgtgcctactgtggtgcccaacaataccaagaagaattgggtgaatacctggtttgtggtgtttgtggttacgggttccgtttgggggcgcaacaacgccttgatttgatgacggataagttttccgaatggtatgcggatgttgaaatgacaacgccggactttcctggttaccctgagaaacttgccaaggcacaagcaatgacggacatgaaggaagcagttatgactggtgaagcggtcattgatggtcgacgaactgcagttgctgtgatggatgcacgtttcatgatgggatcattaggcgcgaaaacgggtgagaaattagcccgcttgttcgacgatgccacagctaagcacttgccagttgtcctattttcggcttctggtggtgcgcgcatgcaagaaggtattatgagtctcatgcagcttgccaaggtctcaggagccgtcgcacgtcatcgtgaagctggtttgttgtatgtggttgtcctaactgatccaacaatgggtggtgtgacagcgtcatttgctatggaaggcgatattattttgtctgaaccacacgcgttggttggctttgctggtcgacgtgttattgaacaaacgattcatgaaaccctaccaaaggacttccaacgcgctgagcacatgcaagcaagcggatttattgatgcgattgtgcaacgccctgagttacagtcatacattggcaagttattgcgtgtgcatcaagcaccgttggaggcgtaatcatgagtgaattaacaccaattgaaattgcgtgggccgcccgtgaagaccgtttcttggcgcgtgatttgattgctaatatcgtgactgattttcaagaatttcatggtgatcgtgcacaaggtgatgatccagccgtgattggcggtgtggggatgctcggtgagcaaccggtcacgatgattgcgattaatcgtggtgatgagatggctgaaaagcttcaaacccgtaatggttcacctgaagctagtggttatcgtaaggcgttgcgtctgatgcaacaagctaacaaattcaatcgaccaatcattacgttgattaatacacctggtgcctttcctggtaaaacagcggaagaaggtggtgtcggccaagcaattgcggaaagcatcgtgcaaagcatgtcgttcaccgtaccgatgattgccattatctatggtgaaggtgggtcaggtggtgctttggctttagcgacagcgaaccaagtttggatgtttgagcattctatttatgcgatgctgtcacctgaagggtttgcttcaattatgttcaaagatgccaagcgtgcaccagaagcggcagaactattggggctgacaccacaagaacttttggcgaaaaagattgtggaacgcgttatccttgaaggcgatgatcgcgacctgttttatgaaaacctgcgtcgtgatttgctacaaacaattgacgaactgttccagttgggaccagaagcaattaaggtgcaacgacaaatgcgatttgataaatactagaaatcttaacggtatctcgtgattgagatgccgtttttttctggactgaactggtagcaatcagtcgcaatatttgacatgttaacagagctaaaacggtttaaccacaaaatcaaaaacagttggcaaaagtccgattaaataccggaattttgccgactgttgatatgcttagccgtgatgttattgttgtttttcggtgataactaccattttgttaatggtgcactaaaccagcgcccattaagaacatcatgaatcagtttgtccttttgttcagatgttaacgttttatcttggtgcatctgcttgatgattgacggaccactttggttagcgtgaatcaacttttgttcgacacgcttgtcagttgcggataacacgcggatgttttttgcttcgccagtaaaaggtagccaatcgctttttgcttggcttgggtgtgaagtggtcatgaagcgatagattgagttctggaaagtattggcgagctttttggccccggtgctttgataagttttaccgacatatgtcttataatttgtgttatcagtatctagcaatggcacaaatacaccgtgaaatgaacgcagtaatttcatttggctggtttggtcaatcgcatttttatctgcaccaaaatccaaatgtagggcatatgttggtgcggtgcggtgtttggtcattttttcagctgatcgttgtacgttgaaatattggtacaattcaccaccatacttattcacaaatcggaattctttggcaattgttgattttccagttagattaccatcgctaaaggctgatttgaagtacgggtcgcttaatccgaataatgaaaattcttgtgatccagtggtcattaaaacggggacattcaagtatttttgagtgttgaaaccttgttttggcaaaacatacccatcccgatacaaatgggggaacccagccatccgaataccagcatcgccacctaattgtgcggtaatccgctcagcagacaaattatttaggtaagctgctacttcagcatcagaagacaaaagccattttttagcggttgcgacgtcgggtttgataccgtcatcaaccaccagcggggcaagtttttgagaaaaaatttgttgtgcatcttcagggcttgaagtggtcataccaccactgaagacaatggcctgtttgaaatcgttcttaaatatgggagaaatcaacattgccatgacatctcgtccgccagctgagaaacccgctgcggtaatattgtcaggatcacctccgaactggctaatgttatcatgcaaccatttaaatgattggtgcatgtcgagcagggcaaagttaccagaattttctgcttttgttcccgttttaagagctggcaaaggattaaagccaaggcctcccaaacgatagttaattgaaacaaaaatagcgttatgtctttttacaaaagacgcccctgatagttcagttgagaggccactctgattattgccaccatgaatataaacaaggactggtaatttcttgtgcgtggtttttgaccgataaatatctagcgttagatcgttttcaaatcctttagtgaccggggcatttaccgtagatttgctactatccagttggatatcaccttgtccgggcacagttgcatcacgagtaccttgccatgcaactggagtcgttggcgcttcataacgttcgctgtggccatagggaacgttaaaccaactattaacaccgttctcagaacgcccttgtacggcgccactttcagtggtgacagtatgattgtccgctagaactggtgtgaagtttaagccagttgcgattagaccagtaacgacacttgttgaaatcttttgtctcattgtgagacctccttttgaaaccgctttcaaaggaaatgtaacaattttcaagctgattaaccaggtttatcaacaaggtcggcaaaaattaagtgagttatacgcaaaaattaaaatttttgatacctagcttaaaagaccacagactatgatatattgcggatagggaaaggtggcaattaacatgcaaacaatactaggaagtaacggccaaattgggacggtacttgccaaagatttatatcaacattacaccaaggaaattcgcttagtcggtcggcatccccagaaaattcatgacactgatgagttgatggtcgctgacttaacggacccagcgcaaacatttgaggcaatagccggcagcgaagttgtatacttcaccgtgggattaccaatggatgcaacgacttgggaagaacaatttccgctaattgttgagaatgtgattcaagcaacaattaaagctgatgctaagttagcattttttgataatacgtatatgtacagaaaagatgcgacacctcaaatggaagcaagtccattcgtgccagtggggcgcaaatcagtggtgcgatcaaaaattgcaacacgactattagctgcaatggacaatgaaggtttgcaagcggtgattgggcgtgcgccagaattttatggacccgatcgtacgcaagggattacaaacgggatgctttttgatcgtattaaagccggtcaaacaccacaagtacctgtaaacgacactgttttaagaacgtttatttggacgcccgatgcaagtcgtgcgttggcattgttaggaaatacgcccgatgcttacgggcaaacttggcatttgcccactgaaccaggcatcagctataaagatttgattgccttaactgaacaagttgttgggcacgaggtaacgtacgacattatctcattagacgcatttcgcgaagaagcacgtgaaaatcatattcgagctgagcaacttgaaatactggttcgttatcaatacgacaacatatttgtaactgacaaatttacgaagcgctttccaacgtttaaagtgacctcatttgctgacggagttagaacgatattggcatagaactgtccacatggtgattcagatggagtcatcatgtttttttgtgaagtatgtcatcgataaaaatacgtcaattaaggtcaaaaatcggtgcttctcatcagaagaaagcgtttacaatattgttatcgaaacgacatgagaatttatgggggataacatgggacttaagttgaatgatgattttctttggggtggcgcgattgcggcccatcaagcagaaggtgcctggcaagaaggcggtaagggtgtatcaattgcggacattcttactgccggtagtcaccaacatccacgtcagattactgatggcgtgattgagggattgaattatccaaatcatcacggcattgatttctaccacacatacaaggaagatcttgccttgatggcagaaatgggatttaaggcctttcgaacatcaatcgcttggacgcgtatttttccaaacggcgacgatgttgaaccaaatgaagaggggttggcattttatgatgacttgttcgatgagatgcacaagcacggtattgaaccggttgtgacattgaaccactttgaaatgccgtaccacttggttacagaatatggtggctggggtaaccgtaagttaattgacttgtttgtgaattatgccaaggttgtctttgagcgttaccaagataaagtgacttactggatgacgcacaacgaaatttctaaccaagcggctgtttcaaacgatccgttctttgaatttatggtttggacaaactccggattgaagttttcagaagatgctacgttagctgaaaaacaagctgctatgatgcaagctggtcactatgagttggtggcgtcagctaaggcggttaagttgggtcatgagattaatccaaactttatcattggtgggatggtaaatgttgctgcgctttatccggctagtcctaagccggcagacatgttagctttccaaaaagcgcggcaaacgcgtgactggttcacagacgtgcacgttcgtggcgcgtactcaactgagatggaagccttctttgaaaagactggcgttcgcgctgatgtcacagatgaagaccgtgctgacttgttggccggtacggttgactacatggccatttcttactataactctaagacggtaaaggctgcgactgatgctgatacagagattgataatccatcacatgttgaaacagttaagaacgactatgtaaaggttaatgactgggattgggcagttgatccacaaggattacgctatgcgttgaatgaattgaacaatatgtacccacgtttgccaattatgattgtcgaaaacggatttggggcatacgacactgtggagaatggtgacattcatgatccgtaccgcattgattacctgcgagctcacgtggctgaagttgagaaggcagttgtattggacggcattccagtgattggatacttgtcatggggaccaattgacattgtttctgccggaacgggtgaaatgaagaagcgttacggatacatctatgttgatttggatgacatgggtgagggttcaggagatcgtttacgtaaggattcattccactggtacaaggaagtcattgcgagtcatggtgaaaacctaggcgactaacaatatgatgcccatcatcgcttatatccttgtaggaccaacgctatcttaaaattaaaatatcacaatctcaaataattaattgatgggcatcttacagaccgtgctgaatggcgcggtcttttttgataaaaaagacatatacgcatttgacgcacaaaatcaacaatagtctcaattattcagcatattatcaccaatagttatttctacaatgaaactggataggaaatatgctgcaggaaaatgtgaggatattcaaatgaaaattattgttgctgatacctatgatgaaatgagtcggcttgctacccataaattgcttgcaacgatgcttaagtctgagcgtgtgaatatggccattacagctggcaatacgcctaagggtgtctaccagttgctggtggatgaagtcgcgggacgtgattattatgataacgttcatttttacaactttgatgaagtgccggttaacggtgagcctgaaggtgtgacgatgactaatttacgtcgtctattctttacgccggcaaatgtgtctgaatcacaaatcgagcgcctgacacctgagaattatcaaacgtgggatgaaaagcttacggcggatggtggtttggacttgatgttgatgggccttggtgctgacggtcatttccttggtaacgtgcctggtgccaccaagtttggcaatcagacatatcgcgttgaagctgatgcgacaccaaccttgcgtgaggtgctagttgacgaagttggtggtgatgaaagtaaggcacctgacttctatgttacgatggggccacagtctgttatgacccaagtgcgtgatgctgtcatgattgtgaacggtaaaggtaaggcggcgatggttaagcaggctttctttggaccggtcacagaagatgtgccatcaagtattttgcagctacatcctaatttcacgttgattttggatgcccatgcggcgagcgaactgaatctataatacaaatacaacctcagtggctgttcttgcggcgattgaggttgtatttgtttttatcgactgaagctcgtatactgactaaaacttggttttacgggggtaatggggatgactttaattgaaagagtaactgacttagataactttgagagcgagcactttttgtatcgacatgcgactgaagaagatgccgctgatatgtttgaaatgtttcataatccagaggtgctaaagtggattcacgtaccgatgccggaatcaatcgaacacactttagaaatcagcataaagaaatttcatttagctgatccactgggcaagtacgtcattgttgaaaaagcaactaacaaaatgattggtagcattgatatccgaccaaccgagaaaaacaattcggctgaaattgggtacgccttgaatcacgcttattggggacaaggggttatgactgaggcgctacggacggtgatcacggtggggttcgaacaactagagttgcaccgcattgaatcattccacgcaccagaaaatattggctcaggtcgcgtgatggaaaaggctggcatgcaatatgaaggaacactgcgtgattatgagttattaccaaatggtcgatacgttgacagtaaggtctatagtattttagcgactgattatttcaagtcagaagactaatgttagtactggaggggtaaatgaacacatatctgattttgctccgggggataaacgtcggtggcaaacgtaaagtcaaaatgagcgagttgcgtgaatggtttgtacaacaagggtttcataacgtcatcacgttcggaaatgctggtaatgttattgccgctgttgaatctgatacggttgattttgccagccttggtatcgctttatcagcacatgagggctttgaaatacacctgttcggattgtcgctagccgacataaacgatatgatgagtcattcaccagactggtggggaatcaaagatgacggtcggcatgatttgataattgccagttcggaagcagaagcgaaacaatccttggatgagttcgcaccctacattgggcctgaaaatcgtgtgttgctatacggacgcttcattttcatgagcactggtgcagaacttcgtaataaaaccagattattgcggattagtacaacgactgcgtttgctaggataaccgtgcgtaatgcgaataccatgcagtagataacgacactaatgaacgaccgacatcatgacttgtgattactcacgacaaaacgtaagatggagataagtattattcagttcaaaggaagtaataaacatgtcaaaaacgctaattgtgacacacactgacttagatggcgttatgtcaggcttagtcgctaagtatgcgacgtcaaatgaatcggatattcgttatgcagatgctggtgctgctggtattgatgccgtgttggaagatgttttggctggggatgatcaatatacccaagcaatcttcttggacaacacgccttcagccgaaatgttggctaagttccataaccaaaccaacctaacgccaacagtttatgaccaccacgtttctaatcaagatgtttgggaatcagccactgttgatgccacatttgtgacggatcaaactggtacgtcctctgcgactgagttggcgtttaatgacaatcaaactgcactggcaaagttaccattcctaccagtcttggttaagttgactaacttgtacgatacgtggacttggcaagatgagcgctatgctgatgagcaacaaactggtcaacatgcgcaagtcttcaatgaagtgctcaatttcattggtcgtgaccgcttcagtgcgttcatggatgaagcaacgaataagacatttgctgaagttgatgtgccaagtgccgtgttagcaacgatcttctcagacttgattatggcgctggtgtacgaacgtattaagtctaaccaagactacgttgctaagaaggcagaaaaagctgaatttgctgatttggttttgcctgacaagacgtaccactatgcttatacaacagcatctagccagatgtcagaaatcgggaatgcgttgactaacttaccagatgtcgatttcggcttggtcattaataacggcaagttgtcattccgtgttgcgaaggataaggatgttgatgtctcagtcattgctggctactttaatggtggtggacatgctaaggcatcgggtgcgaagttagtgatggattggccaacaatcattcagaatgcgcgcaataaataaactgtttgtagggatagattggttgtcgccaggctatccttttttgctgtatagccattcaaggacatacaatccggaatatcggtccactgttttgtaagcgttttcaaaatataaagacagccaaagccaatcttaggtatacacttactatatggaagcgagtaacgaagttgtttttacaaatagggggattaaaatgacttacaacgcaagtacagcagaagaaaagttagacatcattgacttgccacgtttgcgcgctttagtcgagtcacgaacggaggcaggggcatttggttatgttgatggtggatcatcggatgagcaggtgctccaggataatgaaacggcatttcgtcattatcagttgattccgcgaatgcttcaaaacattgcggagcctgatatgacgacaacgctctttgacattccgcttgggatgccgattattgcagcaccaattgctgcccaaggattgatgcacgaaggtggggaaagcgtcactgtaaagggtgttggggcagcaaaatctattttcagcgcgtcgacctatggaaatgccagtgttgcagccgttgccgaggcgtcaccggaaacaccaaagttcttccaactgtatatgtcgcgtgatgatgagtttaatcaatttttgattaatcaagcagttgaaacggggtataaggccattattttaacggcggactcgacgttaggtggttatcgagaagccgatattattaataacttcgaatttccgttgccaatggataatttagcggccttttctaatgcggctggtacaggtgagggccttagcatcgctgaaatatacgcacgcgccaagcaagacttagcgttgtctgatattacgaagattaaagatatggcaagcggtttgccagtgattgtaaagggaattcaagatccagaagatgcattggcagccattgctggtggtgcagatggcatttgggtgtcaaatcacggtgggcgtgaactgaacggtgcaccggcttcgattgacgtccttgctgacattgcgaaagccgttaatcatcgtgtgccgatcatctttgattcaggcattcgttggggtgaggacattgcaaaagcaattgcgcttggtgcagatgtcgtagcgttgggacgaccaatgctatgggcgctcaatcttggcggagctgcaggagttcagtcagcttttgaacacttggcggaggagttgaaaattgttatgcagcttacgggttcccacacagtggccgaattgaagcacgcaaaaattattgaagcgaaattttagtttgtaactaagaattgtcagagataataatgcatttaaaaagggatcgaatgtatattcgatccctttttagtgtatgttgatgcccaggctctgaatgagcaaggcggattgatacgtattaattgtcataccagcagctagggctggatcaaataataaggtttcaaaatttgcatttgatacatcaaggtttgccagcttactaccagcaaaatcactgttatcaaggtcactttcgacaaaacgaagtgattttttaatgcgaatgccgtggaagaaactatcacgaacacgtgtgttattgaacacgacgttttggaaggtcgtcccgctgacgttgatgaaatcagccaatgagttgttgatttcggtatcgcgccactcactttgcagacctgagaagttaaccccagttagctgggtgttattaaagctagtgcgatagaaaatggcgctggcgaaatcagtatttgataaatcaacgtgatcaaatatgacatctgaccaagtactatctgagaagtcatcttggtcgaacgtcacacgttcaaatgtgacatcttgtatgttaatggcacgactagagtaggtgaagtgaacgttacggtaggtattgtttggtgtaacatcatccaaactaattgtggtatcagaaataagcatgaaaactctccttaagacttaaaattttaaaccatccccagccaaagtaaaagcctcacatcaactaaggtgcgaggcttcatttgttattcagcagtttctgtcaaaccttcactcaaggctttaatcttcttggttgcgaaccacaagagtaatccagcaacaatcgtgataataccgataatcaagaagtaattgatttcagtagactttgagtaaagttgtaccaattgtgcgttagccgcttgcgccgttgcgtcagacaagttccagaccgtcaacatttgcgcttggaaggcaacgggtgccatcttagcagatgctgacaaaccgactggtgaaatcaacatctcaccaacttcaaccaatgcccatgaagcaactagccacaatggattgaattggtgattaacaccaaacatcatgcctggcacggccatccaaacgaatgacaacccagcaaatgccaaaccaagcgagaacttcacgccagttgatggttgcttatcgcgcaatttctttgaccaaagccaaacgaagaatggcgtgaacaacatgatgaacaatggattcaatgattggaaccatgaagctggcataccgtgtagcgccgtttgatttgaagcgaacaaggccaagacaactgagccctgttcctcaattgaccagaacagcattgccgcaatgaacaagggaatgtaggcccaaacacgcttacgttctgccttagtggtcttctttgaggtcaacataacaacaaagtaaatcactggcacaaggatggcgacaaacgtcaacaagttaatcacactgttaattgacaaactgtgcgtaccagccataatgccgataatggcaatgaatgcgataacgattccggctaacttccacatcaatggggcgatttcattaggttgtaatggggatggtgcttggtgtgagacatccttaaggtgcttacgaccatccaatgaatattgcaccaaaccgaagaacatgccgatagcggctaacgagaaggcaacgtggaagttaacgtgcacttggaaccaaccaactagcaacggtgcgataaaggcaccgaggttgataccaaagacgtaaattgagaaaccggcgtcacgacgttcatcgttggcgtcatacaagtttccgaccattgttgccacgttgggctttaagagtccagttccgagtgtaatcaaggcaattgagccaaacaacccaatttcatgcaatggcatcgccaaggcaatgtgaccgaacatgatcaagacaccaccgtagaaaacagtacgccatggaccaaggacacggtcagatagataaccaccaacaattcccgataggtaaaccattgacccataaatcgacatgatggcagcaccggtggcttcgttaaatcccaaaccacctttatcggctgcataaatcatgtagaaaagtaaaatggcacgcatgccgtagtatgaaaatcgctcccacatttcggtgaagaacaaggtcataaggcctcgaggttggccgaagaaggaggtgtcgcgtttctgttccatcagaaaaaccctcactcttactggttatatttttgtctagcgaaaaattgtttccgcaattcgtcataacgatagaaactagtctacgccgattatgagctgaaatcaaataataaataagtattttctcatagtgcaataaaaaaatagcggttgtcgcctgacaaaccgctatttttgttctcattaaactattaaagtgtgatagtttcagcttctgcaggtgcaactgctggttgtggcaagatttctgccgcagcttcacgatccaacaacaacgtgaagttagggtgggcttgcaagattgaagcaggtacatcttcactgattgggccaaagaaagcttccttaacgatttgtgccttcttcttaccgaaagcaatcatcaagatttccttagcactcataattgtcttaggacccatggcaacgtaaccctcaggcaccttgtcttctgaaccaaccgtgtgaaccaatgcagcgtatacttggtcgttagcttcagaagggatgtagcgcgtaccgtcttcaaacttcgtgacacctggcaagttaccagcgtaacgaccatctgaaccaattccaagcaacataaagtccaaaccgtttgcttcagccaaacgctcgtccaatgcatcccagtttgacaagtccaaacggtggtaaaggtaagcaggcatttcagcagggttcaagaagtacttacgcaacgttgacgtcgttgtaccttcttcagaaccagcttgtgggacttcatcaaagttccacatgtgcaactttggcatgttaggatcgtggatacgctccgtgaacttttccaagcattgctcgtatgaagcaacagggcttgttccagccgtcaaggcaatgttttgtaccttacgatcgtaaatcttgttcaatagaatctttgatgtctcgttcgtgacatcttgctttgtgtctacaatttcaattcgcatattttttaatttccttctcttattaactgtcagtttgacttaacactaactagtttataggggaattttgaacaatgtttgaattaaccaccggaaattatgtgaattggtatacattggtatatgatgaaagcgcaaacattgccagaacaacgtttgcgctttcgagtgtcttaatgcttttttaatgaattgagtgcatcttggatgcgagtttgtgcttccgtgatacgttccaaacggggcttgttcttgaaattcattttctcaacttgaatttgaacatctttcacaagtgcttgcacggctggcaactctgcttggacattggcgagggatgccttcacatccttagtcgctgatactgtccgcttcgtgtccgtcgtgaagtgtgtgacttgctgcttcaagttggtaaaccaatccttgagtgcgtccatacttagtcctccatgtgactggcgatgttagcagccagtgccttgtaagtgtcttcggctgtttgttcactgtgatcaggcattggaatatcaaaaccgtcattggcataacgtggaatcaagtggaagtgagagtggaagacagattgtcctgcagcttcaccgttgtttgacaaaatgttcaagccaataatgttttcgtcgctggccttaattgcacgggcaatttttggtagctttgacaaaacacgcgcagccaaagcttcatcatattcaaagatgtccgccacgtgcgtctttggcacaaccaatgtgtgaccaggcgtaacttggctaaggtctagaaaagccaatacgtcatcatcttcataaaccttataagcaggaatatcacctgcaacaatcatatcaaatacatctgccatggaaatgcctcctaaatatcatctgttatcttcattataccctgactgctgtaaactgtccgttgttaaatttcgatgaaaatttgctattatataagtacattaaaaaatcgagagtgacattatgacattagaaattgaacacttatcaggtggctacggccaactaactgttttaaatgatgtctcattcactgtaccagatggtcatctaacggctttagttgggttgaacggatctggtaagtcaacgacaatcaaccatatcattggtttgcttgcacctaagcaaggatcaattgtcttgaatggggtaacactacagacacaaccagaagcattcaagcgccaaatcgcttacattccagaacagccggtcctatatgatgagctgacgttgcgtgagcacttagccttaacaatttcagtttatcaattagatgaaaagatggcttggcaacgcgctgaagaattgctcacaactttccgtttggataataaactagattggttcccaactcatttctcaaagggaatgcgtcaaaaggttatgattgtgatggctttcatcacggacgcgccattcttcatcattgatgaaccattccttggactggacgttattgcggttaacgacttgttagcactaattgaccaacgtaagcatgccggtacaagtttcttgctaacaacgcacgtcttgacgacgctggctgaccacgcggatgaatttgtttatttgcgggatggtgaggtcgctgcgactgggctggcaagcgaattcgccgaaaaggtacctgaattacaacaaaaagaggtgtaaggatggctatcgatcatttatttaaagaacgctggcaacgggaatggcgtcaatatagtaaatatttacgttatgtctttaatgaccacgccatgctagctttgctgtttctattgggggcagctggattggcgtatcggcaattgtgggagagcgcgccagttactttttggacacgtggtttattattacttgttctgttactaacgctggcattgttcaagacacccgcaagttttgtaaagggtgctgatccagtattcttcatgggaaacgaaggggcgctgcgtcgtttgtttcaccaagccacgatttatagcgtcattgttaacggtgtgattcaactaatcctaaccgtgctgctttggccaatgatgtttcgactactcacgccaaaatttgtgacgatgttattggtcaccattgcgctaatggcggttaagatgctatttatctttatgaaagctcgtcggacaaccttgtttgatacaacggttggtaataacttaattgactggcgtgccgtggtggctgccgaggataagcgccaggcggcaattcttagcttcttcaatttatttattgatgtaccaggaatgaagcccgctgttcgtcgtcaacgctgggctgatcgtttgattggacattggccaaatcagtcgcgaaacccattggtccgattgttagtcacgacgttcgttcgtcaagggcaatattgggatgtatggggacgtctaagcctgattggcttgttggttgcgtttgtgacaactgggtggctgcaaacagttttgtttgttattttgttctacctattggtattgcaattactaccattggcaagcgcacaccaatcattggtgtttgaccacttgtacccggtaacggtggcacaacggcaacaagcatttcgcaatgcactcatcccatggcttgcgttaactggcctgatttggtcgattgtgggtggtgtactagcgggttctatcacactcttattacaaaatgtcataggacttgtcgtagtaggtggtattttgttattctggtatacgaaccgcattattgcaaacacgtttagaaggagaaattcacgtgcgtttacgaaataaaaagtggactagcccatggttggcagatcacacggacttggttattacacaagaccgtgcgacaggtctacaaggaaattggcaaagcatctttgaaaaggtgcaaccattgtacgtagaaatcggtacaggtaagggtcaatttatcattggtatggcaaagaagtacccagaaattaactttatcggtatggaaattcaagaaggagccgttgctgttgcagcacgtaaggcggatgaagatccagtcgacttgcctaacttgaagttcatctacggtgatggtgctggagttgagacgtactttacaaagggtgaggtatcaaagttgttcttgaacttctcagatccttggccaaagtcacgtcacgaaacgcgtcgtttgacgtacaagtcattcttggaaggttaccaagctgttttgccagctggtggtgaactagaatttaagacggataaccgtggcttgtttgagtactcactatactcatttgcaaacttcggcatcgaattctacaaggatggtatctcactaaacttgcacgaagacgaagaaaagatgaaggacaacgttgagacggaatacgagcaaaagtttgcttctcaaggtttcccaatttacaagtttacgggtgctttcaagtaaccaacaaaaaacgcatgctgactaaccaagtcaacatgcgtttttaatttattcagatagtgtcgctggagcttcagtcataacggtcaacgtaacagcttgctttgatgcttcccattgtgcctcggcaccaaatccaatttgttgttgtgtttgttgggcgataaacccagcttccaatgcaaaactagcctctgggttttcgctaaagcgggattctacgattggtccgtctaggcgccacttttgcatcgttggcttttgcgttgtgagggttaatgttccaaaaccggcctcttggaaaaaagcttcgatagctgagataccgtgtaggtcaacatctcttgctaaggtctttccggcccagtagataatttctgattgatcatcttgtagtaattcaggtaacaaacgatcacgtagcaaggttaacgcgaacacgtcaagacctggcgtttgtgctgattccgtcatgatgaactccttttattacagtttcatagttttaattatagtgtatttgagcttggtttgccaataatttacgttagtgttacaattaaaaccttgaaaggatggattttggcatgactttacctgataatccgttaataaatagcacgctaggattaatcaatggtgacctttttgcacaaaaaatcatcatgggtgacggttcgcagtggggaagtgattcttcactaacccttgcaaccattgcaagtctttctaacggctatatattaaccgacatcatgacccagttctcttactggtacacgaccggcgcttatacggctgacggtgcaccacaaacggctggggatgtaacaagactcgcaatcgaaaacttccgacagacacaagatccgttcacgtctggtggccgcgatgtacaggataacgccaatggctcactgttgcgcattacaccggttgtgctgttcttgtatgctaagtatggctcagacttcattcacgatgatccagccatgttaacgttgcaccaaattggtggtttgacacacaaccatccgcgttcattgattgcattgggtatgtatgccatgctaattaatggcttgttaacggggatgaagctacctgaagcgttcgactttgcaattagtaatgcgtatgagtactatgcaaagcacgcggtgtttgctgatgagctggaggcgtttgaatcattgaacacgcccgactttgaaaacatgccaatcaacgagattcacgcttctgggtatgtcgtggatacgttcgcggcgacggtttgggttttgctcaatagcgataactttgaggatgccttgacgctggcgtcggggatgcctggtgagccaatgcgtatcatgccactagttggtgcggttgctggactaatgtacggcaaggatgcgttgccaacggcatggttgaacaatcacgagaaagatatcgtgacgcgtattttggaaacagctgaccaaagtggtgagtttgtttgcccaacacctgaaaattaaatatcacgaaggggttctatcgttttggtagggcctcttctttttagacacggagaggagtttagaaatggcaacgattatacacagtatctcaggggttctaatgattttgggactcgtcgcagttgggtatgctttgataaagttgcgaatctttaacgatgacgatggcagattgagcaaattcttatctggatttgtcactaaaatcgcaattccagcttatttgattgttagtattccgcaggactttacaccggctagcctagttgctttgggacctaagttgattctgccggtggggagtatgctagtgctattcattttgtcatttgttgtggcacgtttaattcatgtaaacccaacccataaaggtttgtttcagtcgcttttgtttaattcaaatacagtgacggtcggactaccggttaatatggcactgtttggtaaggaaagcttaccgtatgtgttggtctactatatggctaataccattgttttttggacgttgggtgtttatatgattgagagcgatacgcaaacgggtaaacatttcgacttaaagaagacgctgaaaggggtgtttacaccgccgatgattgctttgttggttgcgattgtactcgttattttccaaatcaagctaccggagttcctggtaactgatttgacggatctggggaatacgaacgtaccgctatcattaatttttatcggtttttcaattgctaagacccaacgtgctgatctgattcctgataaagaaaacatcacgttggcaattggacgctttgttatggcgccaactgttatggcgttgatgatgatgccgtttgacttgcctaagttgttgaaggtcgtgttcatcattcaatcggccatgccaaccatgacgaacgctgccgtgatggcacgtgagctgaacggtgactataagtttgcgtctgtgtcaattacacaaaccacgctaatgatgttagttgtgataccgattttgatggtaattgtaagctagaccttgcgttataaaatcgactattgactggtattttctgcgggcgactaaaaacttcgccgggcgaaaagattattctcgcgtattctattctggtgacagtaagtagaagaggagaattcagatgtctacatttatgaaagtcgttaagactattttgcttttaatttcggggttggcaataataattattggtcaactgttgggggaaattgcctactcggttgtacctattccatcgctacctgatattgtttatattctcgttgcggttgttgctgttttggcaatgaaccgttgggtgctaaagattcctttggaagaatttgggttgggaaagttacaccttaattggtggtgggttgtggttggcctggcgatgccatgggggttgaattttacaatggctatgatatttgctggtaacatcacgtttaacccaaacacaagttttatgaccatttacatggcggttattgccgctttctcagctggaatggtggaagaacttattttccgtagctacatgttttcaactattcgtcgtgactttggtttgatagctgcgacaattattccgtcagtattttttgctgcaacacatctgcttaatggtagtttgaattttacaagtacgattatgctgctggttgctgggactattgttggggtgacatttacgttgattcgcctggcaactggaaacatttggactgcggttattatgcacacgctatgggatacatttgttgctgactcaaatatcgccaatgagaacgccttggttgccattaaggacgcaacggcaaatccaggcatgctactaagcggtggtcagtatggtatagaaacttctttgccaggtatgttggtttttggaatcccaatgattatcattttcgttagtttgaagaatcgtggcatgattggaacaaacaatctgaaataacaaatcttcgctacaggtgcaacctgtggcgttttttgttgttcacgagtaaagttgacttaaaaagatgagggggcactgtaatggggtcacgattaatgcacgcagccatcgctaaacagctgatggcaaagttcagtcaattggatatggcatttctaataggtaacgaagtacctgatgtcgataaaatcagtcagatgagtaaagacgaaacgcattatttagttcctagtaatcgaggaactagacgaattgatttacgggcttttttacaagagcatccagaaacgttgtcagattcgtttaccttgggctattacacacatttattggctgacgaggtttggcttacagacgtcttcatgaaagttgttccaccacaagattatccacgacgtccagcagtgctagaacgctactatgaggattttaaaaagctcaatccgtatcttgttcataagtatggtttacaaccattaccatcgacagctactgaggctgtgccggcggatttcgcagataaggcgtgtgttgaaaagttgattcaagactataatgctgactttacgggcgaaacaattggtgatcttgaagtacttagcattacacaaatagatgtctacattgccaacgtggttaatttgatgactaaggtcattgattcgggaatttttgtcgaaaaataaaaacataaagattgataggtcaccggtaagcacgtattatggccagtgaactattagaaataaggagaacaacatgacgttctataccatagaatatttatcacaacgtcattcttggatggagacagcaacgacaattgtaatcgctatactggtggctatattcgcaatttttgcggtgttgtattttaagaataatctgaagtctaaatatcgtgatttaagcgtgatgatgttgctgttagttgcattcgttgttgggcttcaataccaggacatgaatcaaatcaaaagtcagtcagcacaaaaagaacaggttgtgaggctcctaaagcatgttgcccatgcaaaggatgttaaatatagccaggtgtcaattaatagcgttaatctgaataacaatttgattatgaaggttggtaacgtgttctaccgggttaatttaagtgcagatcaatcgaattacacacttgaaaagacgaatttacttgatgagaacacagtggttgaggtgaaataatggatgcaagttatgcaacgattgcattaaagttggcaattggaatcatcggcttaattatccaaattaatattctgggtaaaggtaacttagcgccgatatcagcaatggatcaggtgcaaaattatgtactcggtggcattatcggtggtgttatctacaatagcgatattaccgccttgcaatttgtattggtattgattgtctggacgtttttggtgctgttactgaagtttttgaaggaacacaattattgggttaagcgcgtgattgatggcgcgccagtgacagtaattaaaaatggtgaagttgatgtggcgacaactatgcgtgttggtctatcagccagcgaattaatgtttaagttgcgcgctgctggtgttgatgaagttcagattgtgcgtcgtgccgttcttgaacaaaatggtcagttaacaatcattaagtacggtgaagaagcgattaaatacccacttatccaagatggacaggcaaattacgacttgctcgatgtgttagataaagatattgattggttacgtacagaagttgctaaacagaaaatgggtggtgtggaagacatttatctgggggaatttatccacggtaaagttattctgcatccgttcgctaagtaaaaatggtagtcatgacaacgatgtgtcgtgactaccatttttagcatacgtataagtgtttatgcagtgaacaacctggattaaaaggtgtttcacattggtcgcattgattaatttcgtcataacgggcgtaggtcatctgatgaccacagacgccacacatgacaattaattggttgctgagttgattataacggccaaatgcgtgattttcagtgttgttatggcattggtaacaagcatataacttgccacaggtctcgcaacgattggcgataacgtcaagtttcgaatgccagtgaacacatcgtccatcagaatcgaccaattcaccatatattttttcctttttcatacttatatgctgtcataaatagatttactaagcaagtctgcgcgaaaaaatgccgataacagttaaaagttagtctaagaatatcgagtaatctatattttcggacaattcactatgtaataataagtaatcggaggtggcgtatgaaagcagcaataattaaccagtttggatctagtgatgaattaacggtcgttgataattatgacgaaccaatcatttcagataacaaagttctgattgaaacgtttgcaacaagtgttaatccgattgactacaaagcccgcgaaggcgctttgcgagggatgtttaattggacttttccggtggtcttgggctgggacattgcgggtatcattactgaagttggggcaaacgttaccgaatttgcggtcggtgatcgcgtttttgcacgtccggatatggatgcaaccggtaaattcggctcgtatgcaacgtttatggcagtaaatgtcgataaagtggcagcgatgcctgataacatgacgttcgctgaagctgcagccttgccattagctggggaaacagctttacagatgttacgtgagttacgagtgacagatggttctaaggttctagttcaggccggcgctggtggcgttggtatcgttgcgattcaattagctaaattgatgggtgcaactgttgcaacgaccgcaagtcatgcaaacgcggaatttgtccgtgaacttggtgctgatatcgtcattgactatcacgaacgtgcgattaccgacgtgattagcaattatgatgcggtgctagacagtgttggcgatattgatgcaggcttagatgtgttagcgccaggtggccgattagtgacgatttcggctaagccaactgatgaacaattgtcaaacgctgaaaaggcgaataaaacgctaacggcggggtggctacaaccaagcggcaaggatttagaggaattagcagcatattatcaaaacgatcaattgaaaatcgtgattgattcaaagttcccattcacgacagagggtgttcgatcagcgcatgaacgtgttgaatcgcatcatgcacgcggtaaagtcgtgattgaaatgaaaccggaatagttatgcagaacacaacgatggtcttctggacatattgttgtgttttttggtgtataaagacacttgatttcccgttaaaaagaataaaattagcggttgaattaaagtgctatacttactgataataaatggttgaggggtattaaacatggtaaggattatttttaggccacatgatttagttgcgttaccgtatgtggtttttatagccacaattgggttgttgatgttcatcgatagtgctgcaggacgtattctttggggtagtattggactatttgtcggtctaattagtttaattggtgtgaatgcgatggtacgtaatcatccaaaagacgagtttgacgagcgtatttaaaacgtttgagaacggtggtatgaagtatggtggaactgacaatcgttgtagttgttttcgtaatatttgtcgtcgtaagcctcatctctgttttgatacaagtgcacacaaaatatcgaactcagcaacataagtggcgcattgcttttagacggtcattcggttggattggtgatttcatttccaatgtaattttgttttggtgaggcgtcagatgtttggtaagaaagtaaatgtgaagcaactggaatcactgattgatgaggctttggaagttgaaaaaaatccagaagttgtattagaattgcaaaagttagcaaaccaattaacaacggcaactaaaatccgagaaactgagaaaaatggctatttggtgattacaaagcttgcgaatacgtcaggattcagaatcagtacggcattgtttacgttagttgaacggttgagcttagatgtgtatggatcggtccatcaattcaatgtgttttaaagaaaataattaacgctgcaaagactaaatgtgtttttgcagcgttttttaattggtaggttggtaactagttttaatgactcaggtttacatttattctagtttacataatatatattatcgtgagttgttattttaataaggaggtggaccgtttaaatatcgttatctatgatacactgtccgataatacatttttgcgaggttctacgatggctattcaacaaattgatacacaacttgcaaccgacttcatcgttaatcaattaaatacacagcaacaaactctttttgaagttgatcatctacccgaatcgacgattgcgtttgctgacgtaactgctgatgttgttattggcgccttggtgcttaaagtttttggcaatactgctcacatttcattgctagccgtatcatctgagtatcgcggtcacggcatcggccataatcttgtggatgctgccattaagacttctaaatcactgaatctgctacatatcacggttaatacacaggattatcaggcgcccgatttttatcaaagttttggctttagcatctttggtcagcttgcagacacaccgtttgttggcactaccaaatactatctacaaatgacgctgtagttgctgacgaatcacagttcacaagcttattttagtgccatgaaatttgtgaatactgataccaaaaatgcgatcgcaaaaaagccgaaaaatgctaattgccatttctttttgccatcaatgtacatcattaggtatgacaagcttaaagaaccccaaacaacaaggttgttaattcgagatggccagtccatcaagatgccacctaataacagaatcagtgccaatgcagcgaagatgccggcgatgattttaaatgtttttgtgtttgccatgttatttagccccttttattagttactctttgtgataatcgtaacgtactttgctattgtttatagccgttgtaattatttcctaaacgaaatataaatgttataagtcgtcataacgaatgaaaacgtttacaattaaagtatatgttgattgactgtggatatgaaaggagattgccaatgttgtacatcatattaatcacaacaatatttgtgtctgtttatagctttcgtcatacgaaacgtcatctcgcaatttttaacaacccgcgaatggcatttggcttgctgacgggacttgcgaccttttacatcttggcaccagtttgggtaattgtattggcccaaatcaatattcttttgtcactgattccgatcatcgcaatgcttgcaaacgcctatttcacaaaatctgcggttaaatactacaacgatcatatcagtagttaggaaggaaaaggatatgctaacactcctcttcggcctgttgatgctcgttttgggtgtactggaactccatctgacaaaacaagcagttaagacctatgaacgatatgaccaatcacatgctacccctttcaagttatggggagtaagctacggttattacatcggtgcagcgctcattttattatccctgggaccaatcatcacagggatatcatcaattatttagaaaaacgaccgggaaagcctcagtgatacctttcccggtcgttttttgattgtatatgttgctattgaatacttagttcccagggtataaagccttaattgaatcgatgcatcgtgaaataacagtctttttgatgtgactttgattacgtggtgtgttgcgttcaacaaatgtgccgtgtattctgtgacgactgttagtctctttcgcaagttgcttgaaaatagcaattcttttcttgacttgaagttgcttttcttcggttgtgagattatcaaaagcgttcatgtctgtgtagacaccgtgttctttgaaaagctttcttaattcgcctactgtactctcgcccacacctttttgccctaggaatcctattggattatcttgcttcacccgattctcatcccgggaagtaaagtaaccaccgcctgatgaaacgatgacatactgatcatcaggcgcgttgcggaataaatcgtcctgggcagttgcttcataagcattagctttcgcgatggtcggcacactggccagcaaagcgacagttgttagcaatagtaataatcggtacacgtttttaggcattttggattctccaagtcataaggtaatcaaagcataacatgagacaaaacacgtattcaacgaggcaaaaataagtaagatctagtaacaacgcaaatgttacttacatgaataatcctaacaaactgaatacaccgactaccaatgcgacaccgacgacaatcttctgaaccatcggtgggaactgccagcgtgttggtaagcgacgcatggcccaccacatgacagctaagttagcgggcaacattactgctagactgtactgtgccacgatgatcagctctgatagtgcctgctcttggccgtggtacaaaaagacgatgataatcacaggcactagcgtaaatgcccgtgtgattatacggcgccataccattggcaaacgccactttaataatccagtcatgacaatctgaccagctaatgtactggcaattgacgcgatcaaaccggtaagcaaaagcgcaatcgcaaaaattggtgccatgacggtcggcttcaacgtatcgtacagtgcgctgaacatcacattactatgtccgatttcagtaaagacgaaccatcccatcaataccaacagcacgttgacaacccaagaaccaagtaaatggatcgttgtatcccactttgccattcggagcatgtcgcttacttctgcatcgttttcacggttgtatggccgcgctttagccaattcagaatgcaaatacaagttatgcggcatgatgatggcgccaaccaaactaacacttagccaaccgaacgagcgaaatggttcgtgtactggttgggtctctgccaaacgatgtggttgtagcacaaaaataaagccaattgtgacaacaatcatcacggcgacggctagtaactcgatacgacggacaccgaacttaaacaaccacagaaaaataataatatcgaatacagttaataacgtggttacttggagtgaccaaccaaacaataagtgtaatgcaattgcagtcccaactacggccgtcaaatcagttgcaatcatcgctagttcattgaatgcccaaaaaccgattcggactggcttagacaacgctggtgcaaccaattcagctaggtttttgcccgtaacaatgcctagtcgcgcactaaccaattgcaagacaatcgcaaatacgatagccaaggtcataaccggtagtatccaccagtgaaatagattaccaccgacaatcgcagtcaaccaattaccaggatccatgtagccgattgcgactaatgacgaagcaccggcgtatgacaagaaccgttgaaaaaatcgcttatcgaacataatcactcacaatgctttcgtacattttcgctaatgctggatcggcatttagcggtgatactaagctgaagcggtcaccacccgccgccttgaatgtttgcgcagcggtaatcttcaattcgttcagcgtttcgagcgagtcgattacaaaccctggtgttgcaactagtacgtttttgtcaccgtagataggtaactctgtcaaaacgtggctggtatatggctttaaccaaggcgttggtccaaattttgattggaatgtttgaacaatttgattgtcatctaattgcaaggctgttttaagggcttctgtcgtcgcgtttacctgctttaggtaatcatccccctgccgcacatagctcgttggaataccgtgatatgacaacatcaacttatcatagctgtttgattgccagtccaccttaatcttctcagctaaggcttcgatgtaggctggatgtgtctcgtacgagaggataatctgtgcatttggatcagcagccgtcgctttttcaacgattgtctttgtcgtcgttgttgagtattgtgggaataatggcaccacgataatatcatcggcgccattttcacgtaattgttgtagtcgatccggaattgttggtgaaccgtacgtcattgcgtagtcaaccagccagtctggtcgtaagtttcgcaaattctcagctaacttcgctgtgtaaacagttaatggcgatccctcttctagccagatttcacgataaaaggtcgctgatcgccaggtgcgcatcggcaaaataaatccgtttaaaatcacttgccaaatcggttttggcacatgaatgacattcggatccgataaaaattcttttaaatatggcttaacgtcaacattgtttggactagccggtgttcctaaatttaccaacaacacacctgttgtcatggttgtatcccccaaaaatatcgtaatttaatacataactattttcgattgtacgatattttgtagaaatgttcacatgtattttgatagtaaaaaacccacatctttaatgtgggtagaaaattttttacgggctttgttggtattagattattcagactatgccaagaagttggctaacaacattggtaacatcgctgatgcggttgggaatgcgtaaatcgtcttgttaaggtcgtcctttgtatatttatggttgatgattgggacgagtgtattaacaagttccggcgctgcatcgccgatgattgcggcaccaaccaattgcttatcacgattcaaaacaattttaaccttcgcttcctgatcgtgatgacttgcaaacataccgagttgcgcaaaattaatattgtgaacttgatactcatccgaagcattggcttcagttgtagaaacgccgatttgtgccatgcgtggcaacgtaaacgttacagtcggtacagctgggtacttgattgcttcgttttctttacctaataaaatgtccgcaatgtacaacgactcgaaggtagcggtcggcgttaaacgtggcgttgtttttgcgacgacatcaccactggcataaatgtgtgaaacgctagtctgcatgtaatcgtttacgactaccccgccccgattcgtttcaacaccgatgtcttcaagattcatatgatcgatatttggtatacgaccagttgtatcaaataccatcgcagcttcaaattgattaccttgcgcagtcgtcacaatgtatccgttgtcagttgctttgatttcgtttacagcattaccaaaagcaaagttgatacccttttctgacataatttcaacaacacgttgtgtgtattcagcatcgaaatttgccaaagcacgatcagcatattcgataattgtgacatcgctaccagccgcatgggcaatagaagcaaactccatcccaatgaacccggcgccaatcaaaatcatcgatgttggcatttcgggtaagtctagaaaatctttactgtcatacgttaattccgtaccagccactggtagcttagcagcacgttgacccattgcaagcacaaaattatcagctgtatatgtttcatcagcgacaacaaccgtgtgttcgtctacaaacgatgcgtgcccaaaaatgatatcaataccatcaacggccaaaatgcgtgccataacatcgtccattggatcaataacttggtgcttgtaggccatcaactctggccaaacaatgtttacagcgtcgttgataccaatgccgtaataattatgcaaatgatgcaataattcagccgggccatctaacaaaattttggcgttgcagccaaaattagtacacgttcccgacactttttcttgttcaatcaaggcaacctttttaccggcacgtgctagttcttgggcgccgtgccaggcggcgtgaccacttccaatataaattacgtcgtatgtcatgatttcaccttttctatatgcgtaccaaatatcgtacaagttaacgatatcactaacaaaaaatcaggtcaaaccaaacacaattggtagtatgtttttatttttagtagaaaaaagcccatacaggtatgtatgggcagaaagcgttatttttgggcagcaacccaatcgcgatattcgttatgcaacatccccatgaaataagaatcgtgatattgcccttcagcaaagaattgctcaatcaacgttccttctcgtcggaagcccagcttttcgtagatatgaatcgcagaggcgtttttaacgtcaacatacaggtatagcttgtgcaaatttaggttgttaaacccataacgtacaccataagccattgcctttgttgcatacccattgcccgtaaaagcgctgttgatataaacctgaatctcggcagtccgatgtagcaaatcaatatccataatctcaacaacaccaactggcgtaccgtcgtcttcttggacgataaagcgtcgttcgctttgatccaagatgtgcttatcataaagcaggctgagttcatcgaatgacgaatacggttcttcaaaccacagtgccatggcattgcgcgtgttttcttgttggtaaataaactccaagtctactttttctagtggtcttattatcattggattcccctcgttaataacaattattgccattattataacgatgataattaacgctttgccactctcaacccctcaaaataaaaagcccaccatactggtggacttgaaatcttgcttatttagtggcgggtgcaccggtcaccaggtcaaaaatctgattaaccagcgtgtagttttctttgctctgcgccgcattttcattgctcaaccaaatgaccattgttttaccgtccttggttgttttaacagaaggttcaaatcctagcaaaacgccgtgcaatcggtaggcattgccatcgtcgtacatgcctgatgcgtagttttcgtttggacctgtgaccaacatttggtgcaacaagtttttactaatcagcttaccagctagttcttcatgcaataacttgtacaaatttccggtcgtcatctcaatactaccggtaccgacttcgcggttaaaaatacttgggttatcaaagaatggcttcccgtcagcgccataattttcaacacgattaggactattgacgaaatcattataatttgtgtaatcgatgccgaattgctttttaaaagtattgtctagtagctgctcatatgacttgccggtcaccttgtgtaggatgccaaccaaggctacgtaattaccagctgaataataccaggcgccacgttgatccatggtcaggtgctttaaaccaaaatcaacgtagccagcttcatccagtttatcttcggttttaccaacctgattatagccagccgtcatgttcaacaactgctgaatagtgaccgtgtcggcgtcaggtaattctggcaagtattggctcactttgtcagtcaagtgtagcttaccagctgcaacctgctgcatgacaagaatggccgttagattcttctgaattgatgcgataccatacagagatttagcggttgttggcgtattggctgacttattcgctaaaccaaacccttgattaaggattattttgccattttgggcaaccaaaagtgtgccactgtgatgactatcctttgcccgctgcgcaatttgtgcccctagcgtaccagatggcgcgatagtttgattaacatcgacctttttaatcttttcatgcttcgtagttggtcgtttttcctgtgctactttatttggttcattcagaccaataaaagcccccaatgcgacaatgacaattaaaccaatgcctaagtgtagacgcttcatgttatccccctcatgactaatgcttatttatggtaaacccaagctggattttgcgtttggctagttttcgttgctaaattaaacccaagcggattacgcaacgccttatatggcaaagcgtacttattgaatgtttcgggatcgatatagacaatacgatccacgacggcctttgtcttaatacggtacatcggtgtcgcactctcaaataaggcgtagaagcggtctgtatccccgtcgtaattaacgccttccaaaaatggtggcacggtgacatacatgccattggtcattttgccgtcatcccccttatcaaagcgcaccaactttgaatcagcattactaaacgatgatgtaatcatcacgtgattcgtattagctgaaatgccctgcaactcaggtacgctttcataaaacttattcccggcaacgattgatggatctttatcgcccactggttgtccaaccattaacgttgcgtttgaatccccgttaattgcaaacttttggatgttacctagaccggtacgcgtaaagtatccaacccaaagtgccccatcataataagccacagttgaggcattaatcgcagttttaagtgtgaaatcctgctgatagccaattggcagcttggaacgaatgtcatagctatcaatatccgtctgagcgatgccgtatagcacagaatctttaccgttgtgaccggcaacccagagtaattgatggtcaggatcgtatgaaatgccaccagcgtgatcttgatattgtaggactaatgtcttgatgtaacgaccagtccacttgttaagcacataaataactgaatttgctttgtgtgcgtgatcatacgcagagataaaaatttcattacgactaactgcgatgccctgtggatccaatgtatcgaccttaatcagttggtgcttgtcaactgatgcttgccccgcttttagcgaccaggcgccctgaagaccaggtagcgcaattgcatattgcagatcgtcatgcatcaccggatatggtgacatacgatttaaaaaatctttatctgaatacagtggtttttgtgaggcacccccgtaaggcaccttcacatcatcgcttttaactgtatttaagtcggaactaatatgttgatgcgtcgtgagaccccaaaaaataaacgcccccatgattatgaggacgctaaaaatgatactgacgttttttcgcatatcccaaaacctactcactttttattaactcttatattatacaagaggaatgagattgcgttgattgctacggttttaagaacaccttttcttaaggtggtgtcagttatctttattttcatgtaattctttggcttcggcttgttgtaactcgcgttcggttggtagctgcggacgacgtcgctttccgaccaacgtgattgaaaatgtgatgatgctcaataaaattaggccgattaacggtaatagtagtccatgcatagtgctacctccattgacgcgttattagttaagtctaagcataatgagtcccaacccaataagcaagtagataatgagtagcacaccattgattagcatcgcgcgtagtggaaagtgccatgattgatcgcttgtatgttgtgcaaattggcgccaagcgagtaagttggccaatgatgcaatcaacgtacccaacccgccagttgttactccgaggtacagtggcgaaacgtggctagtgaagtttgataacaacaccgctgctggcacgttactaatgaattgacttgagattgctcctgtgatgaacgtcattgctggcgttgtcataccaagcttaatcatggcggatacccattcaatgcggcttaatgcgccaacaatgataaagaactcaacgaacatcaataagatgccataatcgatttggccaaaggtttggcggttgagtagcaatgctgtgacgatgctgaccaacaaggcaccccaaattggaaagagattcaaaatgccggctagtactaagagggtgctaattaccaagataatgacagtccgtgtctctatttttgtcgcagttagttcgatatcatggatgggcacatttttaaaggcaaacggactgagtaacaagaacactaagttaatcatgccgattggtagtgacagctgtaaaaaatgtcccagtgttaaatgataatgtgacgctagataaaggttttgcgggttaccgaacggcgtgaaggcactccctaagttcgcaaaaatcgtaataaagatgactggtaacaccatctttaattcaagtttgcgggcgattgtcacaaaaattggtaccaacgttagaatggccacgtcgttggtgaaaatcatcgagccaaagaatgacagcaatagcgtcactaaaataacttggcgcgtcgtgcgactctttttaataatggtcgtcgcgatggcgaccaagaccccagttcgctcatagacaccaactagtagtaataaagcggctaaggccacaatggtatggacgttgatgtccgtccaagccacttggccaaaaagtaatgcaagaacgctcaagatagtcgtaattgctaaagttttgtcagatagtatttttttgatgaatgtcggcataagacaccccacttttcttatagtcagagtattagtatacggcaaaaataaaagcagaccaactgccgtttggcaattagtctgcttatttttacgtgatttagttttgacgacgcttgcgtgattgcatgtagaagtacaaaggcaaaccagctagtgtcaaaattagcccaatcatggcgagctggaactctgaaatcaaggtcatgacaatgatgaataccccaccagcgataccaatgattggtacaactggatacaatggcaccttgtatggtcgtggcaaatcaggttcggtaatacgcaacttaataacggcaatgaataccaacgtatagaacaaccagataacgaagatcaacatgtcggttaacatgtcgaaaccaccgataaacatcaaagcaactgccaagacaagttggaagataccagccacatatgggatttggtaacggttcaacttaaccaagtgctttgagaatggcaactcgttttctaaggccatggcatatggcaaacgcattccggtcatcgtgtatccgttcagcgtaccgtagatagaaatcaagataccaatcgtgatcaacttaccaccgaagccaccgaaaatgtgttgtgccacatcactagcggcgttttcgtttcctgagatagctgacaatggcaatgagtgcaagtaaacaaagttaacaagcaagtaaatgaccatgataccaatcaacccaccggcgattgcacgtggcaagtccttttgtgggttcttcatttcaccggcgatgttaccaacgtgaatccatccatcgtaggcatacatcgtggccaaaagtccggcaccgacagccgttgcccatgaaccggcttgtgaacctggttcaactgggaacaagctgacatccaccccacctggttgtagcaaaccaaagatgataatcaaggccaatgggattaacttgaagaacaacgtgattgattggaattgtccagcaatcttagatccaagcaagttaatcaaaaagactgatgcgaccgcgatgattcccgctggaataatcgcacttgttggcaagtggaacaaattagcaacttgggtaccgaagataaccccctttgccgccacgctggctgggaagtacacaacaatttgtgcccaccctagcaagtaacttggtaacttaccataagctcgttcgatgtagactagcatcccaccagtttgtggcaatgcggcagcaagttcagcaccggtcaaaccggcagccagactaatcaaaccacccaaaatccaaacgaatagagacatactggttgaaccagttgattgtgcaacactagatgctttaaaaaagacacccgctccaataacagttcccatgacagtcgaaattgctggcaaaagcgtcattgtacgattcagtttgttttgatcgttcattggaagccccttatttaaaaatttcaataatgtctatcataccaggttctgctgtaaaaagataaggaatacgggacatatattagtaaaaaataaaaaacgcccgaaatttaattcgagcgtcagcaactaccttactttggcagagcgtaatttgctatttgtaaccgtttctagctgacgcaaagttgctgcatcaatgtgcaagccactcgcaatctgcccgaacgtccaagttggatgacgttcgcacaaatccagatagtgttcgatgagtttgtcattaatttttggttgaacgacttcagccaccccgttcactgcaaaatctgcagcgttggctttttcgaacgtgtaatgcaaggtgcttgggcccatttcaccagtagagtaatccatatctacatcccccgtgtttttataatagacgctttctttccttcatgagatttatattaacatttaattaactaattaaaaataaacaatcgacggtcatttccgaaaaaaacaaataatttcgtgtctatgttgacacagttttgttctcatggttgcaaaatgttacaatcagtaagatacatttttgggaatgttaggagaaataatgtcaacgagacaagatttaattcgcaattttgcaattattgcgcacatcgaccacggtaagtctactttggccgatcgtattatggaaatgacaaacacagtatcagagcgtgaaaccgaagctcaactgcttgatgatttgagcgttgaaaaggctcacggtgttacggttaagtctcgtactgtgcgaaactactacattgataacaacgggactgaatatcaatataacttgattgatacgccaggccacgtcgactttaactatgaagtctcacgctcattgtcagcgactgatggtgtgttgcttttggtcgacgcgactaagggtgtgcaagcccaaacggttgctaactaccgtcttgctaaggctgctaaccttgtgattattccaatcgtgaacaagattgataacatggctgctgaagttgataagactatcgaagaattgcttgatttggatgagtcatttaaggaagaagacatcctaaaaatctcagccaagagcggtttgggtgttgatgcagtcctagaggcaattcgtgaccgcatccctgccccacaaggcgacgaaactggtaagttgaaggccttggtctttgattcgaagtttgacccatacaagggtgtcattgtgcaagtacgtttgtttgatgggcaattgaagtcttcagacaacgtgttgttcatggctaacaagattaagtcgcaaatcaaagaaatgggtgtcttctcacctttgatgacgccacttgatacgcttaaggctggggatgttgggttcattgtgactggtattaaggatgccaaggcggttcgtgtcggtgatacgattacacttgctaacgatccggttgctgaaccccttcctggttatcaagatgttgagccaatggtttatgccggtctttaccctcgcggtagtgagtttaaggacttgaagattggtatcgaaaagcttggcttgaatgatgccgccttccaatatgagccagagcaatctgaagctttggggatgggattccgtggtggattcttgggaatcttccacttgcaaattatccgcgagcgtttgcaagaagagtttgggcttgatgttttgacgaccatgccaaattcaacgtaccgcgtaacagttaagaatgaagacgagccgatttacgttgaaaaccctatccaattccctgattacggtcaaattgtaaaggttgaagagccttacatgttggctaagatgacgttgccaaacgaaatgttgaatgacattatgcgcttggctgaaggtcgtcgtggtgaattggtggatttggcaacgattggttcaatgttgatggtgacttaccgtatgccaatttcagaaatcgcctatgacttctttaacgaattgaagtcagcgtcacacggttttgctaccctttccacagagtttgattcataccaagagtcagacttggtccgtatcgacattgcggttgattacgctaaggttgatgcgttgacattcgttatgcaccgttcaaaggttgatcgtgttggaactgaaattgtttctaagttgaaagatttgattccacgtaagttgcaatcaatgccagttcaagccatcgttgaaggtcgtgccatcgcccgtgctgatgtgccaccactacgtaaggcagctgcttctggaaccaaggtatcaaagaagcaacaacaattgcgccgtcaaggtcaaaagaagagcgacatcgaattgccacaagcagtctttgacgcgatcctagacatgaatagtaattaataagatgaacccccggacaactcgatttaaagttgcgtccgggggttcattgctttctcttgcttagagtatatatttacttgaagaacgtcttgatttccataccacatttttttacactaggcttattcacgtccagattggaatgacgtaaaaagctatgggagtatttttatgggaccagaaagtaagtttggccgtcaatctttttttgatggtgggttgctgtcgttaattggttggagcattttggggtttattgttacggtcatctcacttggaattctatatccgtgggcattggtgatggtatatggttggaagattaaccacaccgttattgacggtcaccgcatgcagtttaacggatctgcagtgggcctatttggtaactggattaagtggttgttactgatgattattacgctaggtatttatggcttctgggttggtatcaaattggaagattggaaagccaagaacacgcgttttttgaattagtctcagatatgacaattcaaaaaattgctatataatagtggcatgaataatctacaaacgattcgtgagttctttcaattaggaaccactgaagtaagcactgcactacaactgtcaccagatgaattacgtgcctatgaatcaggtgaaaagcaacctgaaatcttgatgtggcagcgtttttctgaatattacgcggataaattccacgtaccagccctacctgacatggttgagccaatccacttccgccttagtgtggattacttgatgaatatcggactaacgatgaacgatttgatggcgtttaagtggtacttcgataacacgcgtccagaaatcggcgagttcacgattgccttgtatgaaccagatacaaccaagattgaacgtcgcacgactgacttgccggctgtgcttgatgaatacgctggttacatcttgttaaacaatgatgggtcacttaaccaatttatcgatgaacgtaataacgacaagattagcgattggcgcttgttattgtacaaaaacgacaatttcatggttgatgttacaccggatttgatgtatttcgaatacctagtaaacatgaccgttatgtagaaaaaggagatctcgtatgaggtctcctttttggcatactatttaattgtccaaccaccatcgatggtaaacacttgcccttgcacataacttgattctggacttgtgagatataacgtcatatcagcgacttcttgcgcagctgcccagcgtttaaccggggtttcagcagcgacctgcttggccattgcgccgtcaccagcgaaatcagccgcattcattggcgtgttgatggcaccgggtgcgatagcgttaatatggacgccttgatcagcataatctaaagctaattgtttcatccagccgactaaggcgtgctttgacatcgtgtaggctgccccgccaccgccagcaatttgaccggcgattgaggccatgaacaccatttgtccagcttggcgttttaccatatgtggtaagatagccaaacttaattggacagccgcgttaacattgacgttcatcaattgttgaatggctgtaaaatcggtgtctaaggccggtgtgaatgcatctaatacaccagcggtgctgagaaagatatcaacgatgcgtagttcatcgttatgcgacacaatccactcgcctagctggttcatatcacttaaatctagttgatatggtgtcaaacgattgtgcgtaacgggtattggttgcttatcaattgcgatgaccgtcgcgccggcatctaaataggtgtttaactgggccaatccaatccctgatgcagccccagttaacaaaatggtttgatttttatagtcttgtgtaatcattacttttccaaatcaacgcgcttgctcaaaatgtagaagataacagccccgataatcaaagctgccagctccccaagcgccgtccaagcaaatgttgcccagaatggcgtcttggccataaagtacaactcggcggcaacaacccacatcattaatgcatcgataacggtactaatagccaaacgcttaatcacgcttttaaccttgcgcgtcgcaaagtaagacatcgtggtcatggctaaggtgccagccgtaccgacaatcatgtcgacgattccgtatggtgaccagatattggcaataaataccccgatggtcaaagcgatgatgtaacgcttgttgaagacgaccaaatggttaaaaccttctgaaaagcgtagttggaatgggccgtacgaagcaaatggcaaagccacggttgcgacagcgtacaatgctgcgataacggcaattagtgaaatatcacgcgctgaaaaagagcgttttttcgtgtccatatttaattctctcctagtttttttgagtgggatggttacgaaccactaacttacagcatagcaaaatcactccttatcggcaataagcgtttttcaggacgaccttgtcaaaatcctcccagttatggtagtttggaaaaatacttattttttccacggaggatttttgatgaaacgcttttttgaacgatcatttattttgggaattgtcacaacgttgatgatggtgacaattattagtatttggaacggtacttgggttgcaggttggcatgagaaaacaattcttgcgacactaaccattgtaccgttgacgttcatgctagcgttcttactgaaggaaaacgtaaccttgccattggtcattaagctccacgatgtgttgccagcttggtttagtcgtctaattccacgtcgtcattcgatggcggtgttcattgtcaccggtaacgtttcaatcatgtcattttatgggttgtatatgtctcaccattacgacacgcaccatttgattcattcttactttatccaatgggctcacacgctactattcgcaattccgctattgcttttcgtggttcggccacttgtgaatggcgtattcgaccttgtttggcaccaagaagatgcagcttaaatcgtagtaacgacagaatataactgctaaagcctgatggtcctaaaaatcaggcttttttagttctaaaaattagatttatatgtgaacttttggtaagctgttactcgtacatgtacgaggaggtcacatgaaaaattcaaaaaaggccaagaaaatcgggttattccagcttgttatgctgggacttggttctctaattgggtcaggttggctatttggtgcttgggaagcttctcaagttgcaggtccagccgctatcatatcctgggtaattggcggtatcgttatcggaacaatcgcctataactatattgagcttggtacgatgttcccacaatctggtgggatgagtaaatacgcacagtatacccacggttcattactcggattcattgcttcatgggcgaactggatttctttaattacgttgattccaattgagtcagttgcggctgttcagtatatgagttcatggccttggtcatgggcgaaatggacgcagagcttcatggcaaatggttcaattacatctgaaggattattagcagttttctttttcatcgctgtgttcacgttgttgaattactggtcagtggagctattaacgaactttacgagcttaatctcagtctttaaaattggggtgccgttgctaacgatcgtcatgttgacgatgtcaggttttcacccagaaaactacgggacatcgttacacgagtttatgccgtacggtacggccccaatctttgcagccacgacggtttcggggattattttctcatttaacgcctttcaaacggttatcaacatgggaagtgaaatcgaaaatcccaagcgaaatatcggtcgcggtatcgtttactcactactaattagtggtgtattgtatattttgcttcaaagcactttcatcacagctttgaagccggacatgattgcagctagcggttggcacggcataaactttgcatcaccgtttgctgacttggcaattttgcttggtattcattggctgtcagtgttgctgtatatggacgccttcgtttcaccgtttggtactggtgtatcattcgtagcgtcgtctagtcgtacattggcggccatggtttctaataaccatattccaaaattcgtcggtaagattaacgaaaaatacggtacgccccgtatcgcaatggtggttaatgccattctaagtatgctgatggtgtctattttccgttcatggggaacgttggctagtgttatctcaacgtcaacattgattgcctacctaaccggccctgtcacagttatttcattacgcgaaatggcacctgaattcaaccgcccattccgcggtaagattctaaaggttatggcgccactatcatttgttttggcgtcgctagcgacttactgggcgatgtggcccacgacagttcaggttattttagttatcttgctcggattgcccttctacttttactacgagtggcgcactggtttcaacaagacgaaacgtgcgtttgagggtagtttctggatgattggctatttgatttttatctcaatcatgtcatacatcggatcgaaggaatttaacggtcaaaattggattcattatccatttgatttcattgtcattattgctggctcactgttgttctattattggggaactgttagtcacgtgatgaccaaatactttaagcaagcgcaacgcgttaatgcgaaagtgaaagttaaaaagtaactgaaaaatgccggatgacttgaatcatccggcattttttaatgtgagttttatttttaatattaagcgcgccacttggtcaagtactcgttagcggcatcaacgtcaggcacacgcaaacgttggccagtcattgactcagtgttctcaaagtgcaacgcaccgattagttcaccaaccatctttgacgtcacgtaactatccttgcggtacaaagatggccgaacacgagtgttaactgggccaagaatcaatgagttaacgttaaatcgaccggccatttcaacagcgtaaagctcactcatcatgagaacagctgcgccagctggggcaactggacctgagaacttactgaaagcagcgtcttctgcggaaacgccactaataaacgtgtagtttgcaccttgacggagcaaaggcatcaaggtcttgctggcaacaaagtgagccgtcaacaaaccttgcatcaactcttcccattcagccttagtaatgtcagtcaaggcagcgccttgccaccaaccaccaagtgatgacaccattccgtctagttgttcgaagttatcaacaatcacatcgtgcatcttttgtgcgtcatcttcgtttgaaatatcaccgaacaagtaaaacacgttcttacggaatggttgatcaacaaaccctaatgcatccaacgctttttcttcagaacgtgatggcactagtacggttgcgccattctctgctaaatacttgacgattccctcaccaacggccccggttccaccggcgaccaaaataactttaccctcgtacatattgtttgcctcttgtttcgttaattcgtatggctatcatacctagtttcggcgcgcgggtgttgcaaaaagggaacatttttaaatgaacgaacgcttatttatcagtgtattcgcgtatgacctgcaagatgtcagcacgggcgtcgttgacatggacgctttcacgggctagcagatagatgtcaaacgttggtacgtcgtcatttaataacttgataaagtgcatgtcacgatcagtttcttgtaaggctaacgtcgtaattaatgtcatcccaagtccttccttcactacccctttcaaagcctcgacgtttgaagttgtgtagagaatgcgtggaaacgtttcggtgttatttgtgagttctttaaacacgcgactatgaatgaagccttcgtttaaatagaatgaaatcttcatcagcaacatcttcaaagtacatttcatcaggtaaatctttgtttgttgttgcgagtacaaatgggaaggatgcgaccttttgggcaataacgccaggaatgtgaacctgatcaatcgaggcgattaaaccaaaatttagtttaccgtccgcgatttgcgccattaaatccgcactacccatttcgaccgcttcgaaattaggcagcaaatgacgtttagctaactgacgggttaccggcataaaatagtaagttccgataattggcggtaaaccaaaccgtaattttttcaaggaatgcagacggacttcttccttagtgaacgcaatttcactttggatttgcttggctagttccaaaactagttccccagtacgcgtcagttcaactgatttctttgaggcgtggcgctccaacaattcactgtcgaattcttcttctaatcgtttgattgcgtacgtgatggttggctgtgtgacaccaaactgctctgatacagctgtgaactgctttaactccgcaagggcagagaagtaagacaagtctttaaagttcattgcgacgccccttctttcgttaatataaattaattttatcatatctgttgaatttgactataaaaatttataggtagtagactgggcaccgttaagaaattatttatagatttaagggagatgtttacaccatgcgtggacaagaaattttaaacaaccccttcttgaataagggtactgcctttactgaggaagagcgtgcagaacttggtttgactggtatgttgccagcccatgttcaaacgattcaagagcaagctgatcaagcctatgcccaatacctaacaaaggttaacgacgttgaaaagcgtattttcctttcaacgttgttcgacacgaaccgcacattgttctactacttggtagatcaacacgttgctgagttcatgccagttgtctacgacccaacaatcgcagacacgattgaaaactactcagcattgtttgtgaacccacaaaacgctgcgttcttggacatcaaccacccagagaacatcgaggccacgttgaagaacgctgctgatggtcgtgacattaagttgttggttgccactgatgctgaaggtatcttgggaatcggtgactggggtgtccaaggtgttgatatcgctgttggtaagttgatggtttacacggctgccgctggtatcgaccctgcttcagttttgccagtttctgttgatgctggtacgaaccgcaaggaattgttggaagacccactatacttgggaaaccgtcacgaacgtgttcgtggtgaccaatacttcgagttcattgataagtttgttaagacggcgcaatcattgttcccagagatgtacttgcactttgaagacttcggtcgttcaacggcaacgaagattttgaacacgtacaagaatgactggccaacgtttaacgatgacattcaaggtactggaatcgttgtaacgtcagctgttttgggtgccttggctattactggtgaagacatcaagtcacaaacgtacttgacgtacggtggtggttcagctggtacgggtattgctaaccgtgtcttggctgagtttatgcaacaaggtttgtcagaagaagaagctcgcaagcacttctacatggttgaccgtcaaggattgttgttcgacgatgacgaaacgttgacgcctgagcaaaagccattcgcccgttcacgttcagaatttgagaacgctgacgagttgacggacttgttgtcagttgttaaggctgttaagccaacggttttggttggtacatcaactaaccctggttcatttaccaaggaagtcgttgaagcaatggttgccaacacggatcacccaaagatcttcccattgtcaaaccctacgaagttgcacgaagcaatgccagatgatttgatcaagtggtcagatggtaaggcattggttgcaactggtgtgcctgttgaccctgttacggcatcaaacggtgtaacttacgaaatcggacaagctaacaacatgttggtttaccctggtttgggattgggtacgattgttgccaaggctaaggtcttgtcagatggtatgatttcagctgctgcccacgctttgggtggtatggtcgatgcctcacaacctggtgcccctgttttgccacctgtttcacgtttgtcagaaatgtcattccgtgttgcggttgccgtggctaagcaagcgattgctgaaggattgaaccaagttgaaattgacgacgttgaagccgctgttaaggctgctcaatggacgcctgaatactaatcgaatataggagatatttgggaaatgtctgcattgctaacttcaatctcatctgttgttgagattatcttcgtgattgctttgggttacttcctccgcaacggtggtaagttccaagactcattcaagcacgatatcgaattcttaatcatgaaggttgcgttgcctttgaacatcttcgttggtgttttggacaacttgacccgttcaaagttgatttcactttctggttcattgatctttgtgattatttctttcgcctttggttacctagtagcctggcttttgacaaagattatgaaggtgcctgagggtcgtcgcggaacgttcattaacatgttcgttaatgccaacacgattttcattggtttgcctttgaacttggcattgtttggtgaacactcattgtcattcttcttggtctactacttggctaacacggtttcaacgtgggccatcggtatcttcttcatccaaaacgacggtcctaaggtcgctgacaagaagttcaactggaagaagttgttgcctgccccattgctaggatttatcgtggctttggtatggttgttgctagatttgcctttgcctacgttggttgataagacgttctcaatggttggtggtgtcgtaacgccattgtcattgatttacattggtattgtcttggctgacgctggtttgaagtcaatccacttcgatcgcgacacaatcgttgctttgcttggtcgtttcgtcttcgctcctgtcgttatgattgttatcatgatgatgtttaagggtgcgatggacattccatcagttgagcaaggtactttgattatccaagctgctgcccctggattggctgtgttgcctatcttggtcggtgaagctaagggtgacgttgaatacgcaacaaacgttgtgacgacgtctactgtcctattcgtgattgttgtgccaatcttgatgcaaatcatcacgatgttgtaactaaatacttagggatgtggcctgtgcgcaaacgaacatgcagaacacttttactaaactagtgcatgtcacatcacctatcaaaaagacctcggaattttggttccgaggtctttttagttatttcaaaattttcacagtcaagcctaacatgaccgcaaccaagatgaagccaattagtggcatggttgttgcccccgctgcttgataaacccaaccagtgattagcggtaagaccaccatcccagcttggcaaaaagctagattgcgactaaccatcaacttggccgtttgatcatcgtgtcgttcatacggcaccatcatcatcaatggatagagcgctgagagtcccaaaccaatcgcgaaactagagcatagtagcgcagcggtgtttggtacaaatagtagccccatcccaccgaacgtcagtacgatatgccctaaaatcaattgcttgtttgagaaccatttcgtcgtcaacccagttaggaaacggccgaccattaagccggcccaaaatagtgtggtggcattcgctgctaatgagtcagatagtttcaagcgatcgactgcataactagataagtacttacccacaaccaattcaaccgaatagaagaaatagaagattggtaatagccagtcagctccccttaatttgccaccagcctcagttgctgtatcagaaccattatctttttctgcaaattcttgtcgtgtttgataaacaaacagcataatcaacagttgcaagacaccaatgattaggacaccgatgcgccagccagttgggaacaatagactaatggcgaggataagcgaactcaacgtgacaccgacaccatacatgccatgcaaaatgctcatcaagccacttgtaaagtgcttggcggcgtagtcgtttacagcgatatcaattgccccttgtcctaagccgagcgctacagaagctaaaataagcaggattgtggcctcgccccatagcaacagcaaaataccaatcatgacaaatcccatactcatgagcatgattgatgccatcgtcattgcttttgcaagtctaggataaagcaacgtcgatatgaaggagaatgccaggctaatcattgtcaaatacccaacgtagtcaacgttcacgtggtatgtttgacggacagccggccaagcactccccataatggcatctggcaaaccaagcccgatatagattaaaaagttcaccagaataatgaacgttccgattttaactggttttgtcatgagtcactcctaagtgtgttaatcatcgttagtttacgataaaactatgcccaaaatatgaaaacacgagacctgaccccagatctcgtgttaatacgtgcactattacaattgaccccatgcagatgatgaaattgatgggaataggtaaaccattcgctcgatttctgcaggaccaaacttaaattcgattgctggcaacaaggtgttaatcacatcgtcggccttgtttgacacttcagtcgcaccaactaacttgtgagccttgtcgaagattaagatattgtcgccgattgtctccttgtcaacttggcggtaccaatcatcaggaatgtggttcgtttcaatcgtgtacaactcaggattagcttccgcttcagcaacggtgacacccacctgagccaaacgtggcgatgtgaagacaacagatgggattgctggataaacaatcggatcagtcgtttcaccggcaaatgtgtgcatcaagtagagtgattcaaagacagccgttggcgttagctttggttgcaccttatcaatcacatccccagacgcatagatatttggcactgacgtccgcaagtaatcatctaccgtgataccagccggtgtgtaattaacacccacttcttccaaaccaagattctcgacatttggtacacgaccagttgcgtcaagcacccaatcagtttcgatgttcaagtcttgtccacgaacaaccaagccttctgccccttggacaattgcttcaacggcagtttcgcgaataaaggtcacaccgtgcttttccaaatcggcgatgatttgttcaacgaatggttggtgataagccttcaatgcttccttgccacgcaaaatgaccgtcacatctgaaccggctgcatttgccatcgtggcgaactccatagcgatgtaaccaccaccaatgattgttagtcgttcaggcatgtcagtcaaattcaaaaagtcctctgaatcgtgtgccaagtctgaaccaggaattgtcaaacggtgtggacgaagcccagttgaaataacaatcttatccgcagtcttcgcttcgccgttaaccatcaccgtgtgggcatcagccaacgtaccacgaccaaacagaacatcaacattagttgagtccatcaaaccttggatgaatgctggcaagccatcaatcacctcatgcttgtgggcttggttttcagcccaatcaattttagtttcgccgttaacaataccgtgcacttcttccaagtgacgttgcattgcaactggtgaatctaagacaattttcgcgttgcaaccgcgatttgggcaggtaccgccgaccaaatcttgttcaacaacgccaacctttttccctttcgctcccaatggaattgcaccatcaaacgttccgtgtcctgatccaatgtacagcacatcgtaatcgtagtttgccatgattctgcctcctaaagggtgtgtatgcgattttcagtattccgtgtctctcacctacggaacacatctattgtatctaaaatgtaagtgaattgcatattatctgcttgttctttagaagtttttggcaaatgacgcaaaaaagcacctcagatgggccatcagaggtgctgaaagttacttaaacaacgcacgggttgcaagttggataagtgtattaagttcatcttcactaacgctcagattattacgcagacgtgactgcatgagccattgcattggctgcaaggcctgggctacgatgatatccacgttggcagtggttagcagttgttgctgatacgcttgcttgataaccgttaacatagcaggactcaacaatgacccttcgccttgcatatcgtcaggcaaaaattcaggattggcgaccatcgtggccatgaaagcaacttgttttggatgcttctcgaaattagccgcgtaatcacgcatcaatgttgcaaactgatcttgaggcgtgagcgtttgatctggcattggtagttgcgtgattaaattttcttgtactttactgaatagttggcccaataaatcagccttgttttcataataaatataggtggtcgcaaccgatacgccggcgcgttttgctagtttattgatgcttaaattcgcaattcctgattcctccactaaatcaaacgttgcgttttctaaagcttgaatcttattctcatctcgtgttcgcatacattattccctatcaattgctaaaatcgttactccccagtaaatcgatgctcagcaaagtcttttctatctcttaatcgtaacggttatgacgcaaatgagcaacaacaaaaaaagaggggcgctcccctctttctctcgctatcctttaccggtggttagcttcaagccaactgctccgacgataatcatcgtgataaatagaatgcgcttccaatctttagactctttatacaaatacatgccgacgatagtgccaccggccgcaccgatacctgtccagattgcataaccggttcccattggaatctgacgcaaagccagacccaacaagccaatgcttaacgcaccgccaatagccataccagctgcagcccaccaagctttacgtcgttgccattcgttaatcatgataacgccagaaacttccattaaaccggcgagaacaagaaatacccatgccattatgtgtgttcctccgtgatcaacttaagtccaattacaccacctaataagatggctaagaaaagcaactctggtaggtctaacttgtccccaaagactagccaaccagtcaagacagttgcagcagaaccgagtccgacgaatacggcatacacggtaccaacgggcaacttgtcgacagcggtcatgaacaaaagaaatgataaccctaaggcaattagggttagtacccattcccaccattggttggcgtgttttagaccgacgacccaaccatcttcaaagccaatggctagcacgatttttaaccaaggattcctcaacatacgaggtcctcccttactttaattctgtttaactattccagtatacccaaaagcaactagaaagtgtgttaatcagtccgtattagatagttttccgtcgacaattttgtagacgttatcagaaaactctcgcagacgatcatcgtgcgtgacgatgacgactgctttttcctcgtcatgcgcaatattggcaaaaagttggccaacttctttgacacgcgccgtatccaaggccgccgtaggttcatcggctaggatgattgccgggtctgtatacaatgctcgggcaatcgcaacgcgttgttgttgaccgccagacaattcgccagggtatttgtttaataatttttgaatgcctagcgtttcaataattttgtcaaaggcatcttgactgaggttattgttaggcttcacctggtctacaagtttgaattggtccgctacggttaaatatggcacgagattgtatgcctgtaagacgaacccgatttgttcaagtcgtattttttcggcttctttggtactcaaatcactgatatcgtgaccatttaaacgaactgagccgtctgttggtgtctgtaacccacctaaaatggttagcaaggtacttttaccagatcctgaaggcccaatgataagcgacacctcaccagctttaaacgctaaactgacgtcttctagtgccgtaactaaattggttttctgaccaaattgtttcgtcacgtgttcaagggctagtttttcttcacgcatcattttaacctccaattactgataccggatcaatcttactaatcacacgaatcggaatgattgcacccagtaacccggttaccatcaatccggccgcaatgagtcccatcaatccccaatcaaatgccattggtacgctatctggaatcccaaattcagttaatgccgatagtacggcaccgacgacgataccagttgccataataaagaacgtctcaaataacgtattttgggccaagaaacgatttggaatgccttgtgcacgcaaaactgccaagttaggcaatttttgaaccgttagaatgtagaggaagatggtaatcacaatcaatgaaatgacaatcaggaagccaatcatgagaccaaacgtcgctttttgcggtgtataacctggcaatttattgataaaggcttggtatgaataagtctttaatgctttgtcatcgaccgattgtgacgtttttgaagcaacgacgctaccttggaattgatctgacacgcccttaatgacacgccattgcgctaactcaccataaataacagatgcggtattatacgtggcatttttcacataacccacgatcttatatttcgtatcagataacccgatcgaaattttatcccccataccgtaaatatccttatcaactgagtcagcgaggacgacttcgttagctgcctttggcaagtgccctttggttaattgtaggtttttagcgatgtactcgtcgttattcatcccaacgaattgtgcggattcacgttttccgccaactttcatattaactggtgtaatgccaagtgttgcggttttttcgccacttaactgatcaacctgtttcgttgtcagtaatgactgtccggcattgccatttgcgtctttggtcattacaaaggacttagactgccagctgtccaccgcagcggtgttagctgtcgccaacccgagcgccagggcacttaaaatgaaaatcaaataactgattaagacgacgactgtcagaatcaagccgtaccgtagtttttcttttttaatctctctaattgctaaaaacatttgtccctcctgtatttgttgcagttcagcaaacttactatacacaagtatacaaatgtggattgactaattaatcagcaaaagaaaaagacttcccacttgaacaaatggaaagtctgatatctatattaatcgatgtgcgtacgtgaataacgggccattgctgtgaaaagacctgcgacggcaccgacaacaaccatagcgccttcgacaatacgcttcgtggtattatgcgctattgttgataccttggcatcaagggtcttaggttgatcgggtgttgtttcaactgttgcaagttgctttgcttgtgtactagcttcatcacgtgttgcgcgagctgtttggctcgtcgtcgtctgcgatgatgtttcggatgctgacgacgcggtacttgcttcaggtgaggcgctagcagcgctacttgctggtgcagctgagctagctgcttgtgatgtctgttgaccatcaagtgccggattgtcgatttcacgaccatgactggccaagtccgccttcagtgcctggtaatcatgcgcttgcccaccaagacgaccgtttgatggtgccatcaaggttgaagctgggtcatgatccatccccaatgagtgacccagttcgtgcgtgataaccgtttgcaaatctgccccttgctcagtaatgcgttgctgataaatatcagtttcgccagttggtgcaaaggtcaatgccaaattaggtgtgttgtcaccatctggcacaggtacatccttgattgttactgaagcggcacttggatcggttgtgacaccaaccacagttgtgccagccaagttattccagtaagctgctgcgttagcgacctggtttggatagtcgggcgaataagccacaaccatgttactgctgttcaaattacttgttgcccatgtaaccgcatgagctgatggtgtgtccgctaaaagtgcagcggtaactgccacaccgagcagtccttttgaaaaattcatgattcatatccctaccatttttaactcactgtataagttacgccttaccaattgtaagttaaaggcaatagttttatgtaagcgtttttgttatcaaattgaaaagtcaatgaaaaaaactcccaatgttgccatctgggagttttaaaaatatgaactatttggttgctagggcatctgaaactttgtgaataacgaccttcacttcttgttgcaggcggccactttggccagctgtttttgtttgctctggcaatgattcaacagtcgctgtggttggggatgccttaacggacgttgcatcgcgagtcaccgtagctgaaccggtaatttgacttgacgttccaccagtcgcactggtggatgtgtccgtatcaggttgcttttgctctgaaacggctgctgtttcagttgacgtcgctttttgacttgaggctggggtcgttgaagatgagctagcttgacttgatgctcctgaattcgttgtctcgtaagctgggttatctaattgacgaccgtggctggctaagtctgccttcaaagcttgataatcatgtgcttgcccaccaaattggccaccggctggcgccatcaaagttgagccagcatcgtggtccaatcccaaggagtgacctaattcgtgggtaatgaccgtttgcaaatcaacgccttgtgaagcaatgcgtgacggataaatatcagtaatcccatttggtgcataagttagcgccacgtttggatcggcgtctccagctggggtatccttcttttcgattgtgaccgttgcatcagcctgattattcgtaacggcaacgacggttgttcctgcgaggctgttccaataagatgctgcagctgcagtttgcgctggataatcagctgaatacgcaacaaccgtttctgacgcgtttagattgctgtatgcccatgtggctgcatcaacgatggttgtattaactagcaatgctgtagccgtaataataccggctagtcctttaataaacttcattatgtctcactcaccttgtgtctctaatttggcgtctgcagtcgccttttcgatctcttgcttgactagcataaaggttactttgggtaagtgaaatgatatcgttttatgaaagcgtttttgttacacaattgtaaaaaagcgttcgcgacaaaaaatgtcgcaaacgcttaaaggtttttaattttcgcggcctgtcatgtaagctcggctcattggcaacccttggccggcagcacccttagtcattaggaactggataacgtcaatgtttcctgattcaaatgaagcagcactaccttgtaggtataagtcccaagcacgggcgaatgcttcgccacgctcggcaactgttttgtcgtatacggcgtggtaattctcagtccaagtttccaacgtcttttggtagtgtcgacgcaatggttcgatatcgtccaactgcataccggcttccataatgtgtgtgacgttctcggcgatgtttggaatgtaaccaccagggaaaatgtacttttggataaatggatcaacaccggcaccgtagtgttgaccagtgataccgtgaatcaacgcacgaccatttggtacgagatagttcgcgacgtccttaaagtactcgcccaagttttccttaccaacgtgttcaaacatcccaactgaagtgatgtagtcaaaggtcatatccacatcacggtaatcgcgcaacataacgtggaccttatcttgtaggcctagttcttgaatgcgttggttcgtaaaggcatattgttcttctgacaacgttacgccgtatgtttcaagaccgtattcttggacagccgtgataattaacgttccccatccagaaccgatatccaatagcttcttacctggttcactgtgcaacttgtctaaaatatggtgaaccttagccatctgagcttcttccaatgtcatcccatcctttggccagtacgccgcagaataagtcattgatgggtccaaccactccttatagaagtcattaccaatatcatagtgactgtgaatgtcttctttagattcattcttatcgtggccgtggagcatcttcgtcaacgtgcccttgaaaccgctttgatcagttaaaaaactaccggattgacggtaagcggaagcaatcaattcttgaatgctgccttcaatttcaatgccacgattcatgtacgcctcagcgagtgtcaatgttggcatcttggctaaggacttcatgtttggtttctcattcaacttgatgtgaatttttggcaagccgtccccgtaattttctgacttaccatcccaatatgtcaccataacgggcacatcaaaagcttttgacaaaagcttgctaaatacttgtttctctaacatgttatccaccctatctcaataatcttacatattaaagtttacacccttttcaaacaccgaccaaaataaagggcctgtaaacagcagtttacaggccctttttagtgacttaaatttttagatttctgaaataacaatcttgttgtcaacaaggtctgcttgcaagttcttagcgtccaagtgatccaagtagaagtcggtcacgttgtcacggatttgttgctcgataacacgacgcaatggacgtgctcccatggcctcgtcgtagccttcatcgatcaaccaagccttggctgcaggcgtaaccgtcaacacaatgtccttcttagccaatgtatcgttaacatcgttcaacatcaagtcaacgatttggttcaagtcttccttagtcaaatgtgagaactcgacgatagcattgaaacggttcaagaattctggacggaagtatggtgccaacttctccatcaattccttgtccttagcatcatcgcccatcaaagcttcgttaccaaagccggcgtttgacgttgcaatgacaacagtgttcttgaagttaaccgtgtttccttgtccgtcagtcaaacgaccatcgtccatcacttgcaacaacaaggtcaaaacttgtgggttcgccttttcaatctcatctagcaagacgatagcgtatggttggcgacgaacacgctcagtcaacgtattgctgttatcatcgtagccgacgtatccagcagttgcaccaatcaactttgaaacggccgtcaaatctgagtattctgacatgtccaaacggataacgtgatcctttgacccaaacatatccaaagccaattgctttgccaactcagtcttacctgttccagtaggtccgacgaacaagaagctaccaattggacggttgccttcatcgaagccggcacggttacgacggatggcacgtgatacggcttcaacggcatcgtcttgaccaatgaccttaccacgcaaacgctcgttaatacccttcaaacgttcaatgtctgaggcacccatttgtgcaactggcacaccagtcaagcgctcaacagactcagccacgtcgttaaccgtagccgttaccttcttagcctcgccagcgtcgtcgatttgcttttgcaattcgtcaatcttaaccttgtgttgggcagctgactcgtaatcttccttatcagcagctagttgttgcgcttcacgctcgcgcttgatttgctcttccaatgacacgacgtcagtgacaggattcttagctgccaagtgagccgccgtcatatccaacaagtcgatggccttatcaggcaaagaacgttgtggaatgtattggattgagtaatcaaccgctgccttcaaaacattgtcaggcaattcaacgttgtggtgttgcgcgtacaagtcacgcaaaccaagcaagatgttaaaggcatcctctggtgaaggtgcattcactgttacttcattgaaacgacgtgccaaagcagcgttcttcaaaatcgtgttacggtactcatcttgtgtcgttgcaccgataaccgtgaactcaccacgactcaaagcgggcttcaaaatatctgccaagccctttgatcctgagtcaccacccatggcaccggtaccaaggatttggtgaatctcatcgaagaagatgatgacattgccggcttccttgacttccttaatcaagttttgcacgttctcttcgaatgaaccacggtattgtgtaccggcttcgatgcttgaaagatcaattgagataacttccttgttacgaattgaagcgggtacatcaccagccacaattgcttgcgccaaaccttcgacaaccgccgtcttaccaacaccagcgtctccaacgaggactgggttgttctttgtacgacggctcaaaatttcggccgtctcttgaatttccttgttacgaccgataactggatccaacaaaccttcgcgggcctcttgcgtcaagttacgaccaagcttggctagaatgccatccttctttggtgcttgaccatttgcctcgacttctggcaagtcttggttagcactgttaggtagttgacccgtacgacggtattctgcgaattcttcaggcgttacttcgcgtccgttgatcaaataacgagaattctctgagttgaaaccacccatgcgtcccatcatttggttaaagatatcatccatgttgttaaaatcattaaagtttgccattttatttacaatcccccaatattcaattgttaaactcggttgtaatgaggaggcccccacggccatccctcaaccttgtaatctaattgtacaactattacaaaaccattgcaagcattttctagcactctcttcgttagagtgctaattatttagagcgcccgcagtaaaaccgcgtcatacaggcgttttagtgatgaaaataaattaaaaaagctggcattaacgtcgttaaaccgttaatgccagcttttattctaaaacttaaagaatgatttcttaggacgagcgaacgagaatccctcacctaatgtttcttgtgtatccatgaccgtcacgaatgcacgtggatcgatatcatcaataatctttcgcaccacattcatttccgacggatcaaccactgcgtagacaactcgttgttcattgtgcgtaaagccaccttcagcgtgtagcaatgacgtgccacgttccaaatcttgcataattgcatgcgaaatctcttccggctttgatgtgaagattaggaatgcacgagctgcataagatcccttttgggtgaagttaaccatttgcgcaaacacaaaggctgcaataacggtatacatcatttgaacaacgtcaatataaactagtgaagccgtcaaaactacgacgtccagtgcgaatagcgtacgccccatggggatgtttaacttctgttctaagatacgggcaatgacgtccgtcccaccagtcgtcccgccgtaacggtaaatcaatcctgatcccaatccaccaaacaatccagctagcaaagccgaaattagcaaatcgtgctgcaaatctaaatcgaatggcatcagttgccatagccacagccagaatgacaaactgaaaataccatacaatgtgtaaatcaatgcgcgctttccgagcatgcgtaacccaattaagagcaatggaatgttcaaaaatagtgttgataacgcaggattaatatttagcaatgccttaaaaatcaacgtgatacccgttacaccaccttcggccaggtgattggggatattcacgttaaccagcccccacgcatacatagcggttccaactgtaaaaattgcgaaatcacgtagtcgcattttttcaattagacgctctggcataatattttctgccatacgaattgcccccagtactaaaagcttaatgtgtaaatcatatcacaaattccagtatgacagtcattaaaaaaagacatgtccaaatcgaacatgtctgattgtaccaatatttaaccgcgaccaccttggaactcgttgtaaagcgtaataccaccgtcgatatacaatgttgttcccgtaatgtatgaggcttcgttagaaatcagccacacagctgcgttagcgacatcgactggatcaccgaccttcttcattggaatcatgccttccgtgtcggcacgaaccgctggatcagcgaaacgttgtgcgttaattggcgtttccagagcacctggtgaaatggcattgatacgaatgccacgttcagcatactcaagcgccgttgtctttgtaaacatcaagacaccagcctttgccgttgcgtatgaagcatacgtaggccaagggataatgtcgtgaattgatgaggtgtttaggatgttaccctttttgttatgcttcaagaagtgttgtacggcaatcttagttcccaagaaaacaccatccaagtcaacgtgaagcacacgttgccagtcttcatatgatgtttcgtgcgtttctgattgaatctcgaaaccggcattgttaacccaaacgtcgatatcgccaaaggcttcaatcgccttgtcgtaaatcgcttgcacaccagcttctgttccaacatcggcacgaattcccactgcacgtccgcctgattgttcgattaggtaaatcaaaccatcaatcaccttttcatcagcgttgatgtagttaataaccacgttcatcgcttcagatcccatgtgacgtgcaatcgcttcaccaataccagaagaacttccagttacaaccgctgttttcccacgtaaatcaggataacgggttgagtcttttgtatgattaattgtcatgcgttccaccctccgtacatatattgtacattaacgcacatgataaaacatgaaaattcagctttcaggacgtgaaaaaaaccagcgacccaaaatcggccactggcttttcaaactaattaacgcttttgcttaccagcattacgaccaccctttgattcagggtgcgtgttttcactggcgtcatctgtaatgtccttacgtgcttgtgcatcttgttgtgcctgcgcagccttcatagcttgtgcaaatggaccagttggttctgattgcaacttaccagacaacgcatcgtcaacaacatccttcacttcgaacgtgtctgcaacgtgttgacgcaaacgtggacgccaaacgatgataatcaacgtttggataatcatgaccaatgcaccaacgaagaagtacaacgcaataccaccgttagttacccaagtcatgaatagcatcatgattggcataatcatcatcattgattgcatttgcttcttttgctcggccggtacaccaaccattgacaagtatgcttgcaaaccgtaaacgacggctgttgcaattgccaacactggtgattgcgttgccaacttaatgccgaagaaacttgcattcaccaaatcgtgtgaattcttaatcgctgcatacaatcccatgaacactggccattgaatgatcaacacagtgaagttcatgccgcctagcaatgatacaccgttttcacgataaacagccatcatcgcttgagaggcaagcatcttctcttcttgcgtttgggcgttcttttgtgcttcttggatcttcgtcatttgtggttgcaacaaacgcatcttttcttgttgaatcgttgcagcgcgttgttggtgaaccataaatggcaacaataccaaacgcacaacgaacgtcaagatgatgattgaccaacccactgcattggcaccaccaatccagttttcagacatgtgcatgaaattagtcaatggcccttcaaggaagtaaccgtgtcccgttacaaacaaaatgaccaacagaatcaacaaaattggcgttaagcctttaatcttcatggaaataacatccttatctatctctttttttaacgtatctattatagcacacggtttttctttgcgaacttactttacaaaaaaacaaccatcaacaaagtgatggttgttttagtaagcggacgacgggaatcgaacccgcattcccagcttggaaggctggagcactagccattgtactacatccgcatatttaactacgttgcctcaacaacatagttaataatacaggtaaaacgttgtaacgtcaaccccttatttcatcattaagctgacaaaacgatacttttccgcgcggttatcgcttagaaatgtattcaaatccttgaagttagcgaatatctgcgtaatgtaattatctttacgactggccggcatgaccccgtaccattgcaaatctgtcatcttgtcatatcgcgtattgtccataaaaatgcctgttaccggcacgaccgaaaatgaaaagtcggggtattgcgttgctgttcgatgagcaataccttctgcgtcagattcggttgtggcggctgtcaacaatgtatcgacgtcctcgccgaccatacgaacggcgtaccaactatgctcgtcgctagttagttcatcaattggttgataatcttcttcatctggcaacatcgggttttactcctttcttaattacaacttaccagtcaaaaattgggcttcaccgtaaccaaagctccaatcttcatcactgttaacgactaggttaatcatcacatcttccttgcgcaagcctgttttctcgtgtagctcagacaccaaattattatagaagttaaccttttgttcagttgtgcgcggacgcgttaccaaactaaatactagcaccttatctgtgcgttcgatacctagaccagtgtccaagatttgcatttcataaggctcgtgttgcgtgacaatttggtagcgatcaccatccggtgcaccaaatgcagctagcattacttcatatgaaatgtctaaaatttgcttgatttcatcgggtgtacgacccttgatcatatcgatattcatctttggcatgtgacttgcctccttagttgttatataggttactcccggacctgaaaatgagcaagaaaaaacgtgcctttacaggcacgttttaatcgtcattatagctttccgtgcttcttctcacccaacgtgaacaatacccacgctagtacaccgaagaagattggaccaacaactgtccaaataccgctgaaccaatctcccgtttggaatggtgagataatcgtcaacaaaattgagataattgtcaaagcctcaacaagaatcgtgataatccaagtgattgttgggttcttgtagaagataaatggacgctcaacgtcgttcaaacgcttgaacaatgggaacgcagcaaccaagaagacataaggcaacgttgatgacacattacccatgttcgtcaaaacaaggtatagttgctcagcactcttaccaccaaatgaaatcaagataaccaatactgaaaccaagatagcttgtgaccatacggcaatagcaggcacatcatgttcattcaaagcgataaacttctttggccaaacttcctttggtgaacccaagatgaatgacttcaaaggtgcatatgtcaaaacaaagaatgaaccaacataagcgaagaacattgaaataccagcaaagcgagcaaaaattgatcccatgatcaagccagcgctgtgtgacataccaaaggcatcacccaattgcacacccaagttattcatcaaaacatacgtgatgtttccaaggttcgctgacttgtcagccgtcaatgacgtccagttagttgaagcaccccatagcaaaattgagatagcataacccaacccgatgattgtggttgcaatcaaagctgccttaggatacgtcttttcggcgttatcaacgtcttccatgataccacccatttgttccaaaccggcgtaagcaaagatagcgtacaaggcaaatgaaatcatttgaccaattgattgataatcagggctacctgagatgaagaatgaacgcaactttaatggctcggcgaagtgaccaccgtgaccaatcaacacagcaattgaagccaacaacaagatgacgttcaatgccataacgaacataccacccatagcagaaatgcgtgaaattgacttaacaccgcgcgttacaaagtaagcaacgaccaagatgaacaaaactgccaaaacaccaactgtttgaccaccgttcaaaccgaacaatgaccaagttgttgtcatgtccttaccgaaaatcaaagttgacaacggaatccataccttttgtgatacggaaatcatccaaatcacccatgatgccaaaccaataaaagttgcaataaacgcaaccttcttacccaatgaacgttccatccatgagtaaataccacccttagcgtccttaaatgatgcaccaaattcagcgtacatcatagaagttggtaggaagaacaacaaggcacccaaaatataccagatgattgctgcatatcccatacgctcaaaggccacaggcccattggcgaaaccaaagatggtggtgaacatcatcatgattaacgcgccaagaccgattttcttcttgtccataagaataaccccttgaaaaaattcatatttaatttacgaaaaaatcataaatatacatgcaactagtttacgcttgtttctgacacgtggcaattcaatggcctaaatcaaaccgttttctaacctgattaaaacccaattctcacattaccgtcgatgaaacattaagatgacatcaaaacccttataaagacttgactgtttttttatatgtgtgaaaatagaaacattagtaaaagattgaattgagggaatttcatggctgtcacggtttattcattttctcaccgcacttcagcgctgaatgcattgaagtcagtcgagagctttttcgaacgtaacaacttagactacgagctagtacagttgaaggactcatcatccctccctgtttcagtaccaacgatgcgcgctatctgcgcagctgaggatcctgaggcaaccattttcaagaatccacgcggtatgtcaattgacgattggacgattaatgatgtcattgcaagtccaaacaagtcattgaagtcacctcttacagttgagaccaacgaagctggcgaggttgtccacgttatggctggtattaatgaagatatgttggggttgtttattccacgcgatcgtcgtaagaacgaattgcaagcgcttttgcaacgttctgctgagttggacgaagaagaaaattaatttaaagaaaaagaggagttcgttttatgcgaactcctcttttttagctatcaattatgaattgaacttattaacaatcgattcaatgtccttaatcacaagtgacattgttccatctggattattgacgaattcaaccttactacggtcttggtaaatatccattggaatagcaatctcgataccataatccagcttaaaacgttggagacggtacttcttctcgacgcgctcaacgttaggcacgtcaatcgccgtgtcgagctccttgtctgcaatgacttcgttgtacgcctgcttggccgaaatattacctttgaaaacagcttccgcaatatcagcagtattaatttgaccgccgtcggatactgattcgaaaatagcactctgcgtggctgccattgcttcgtgctcaggcacatcgaacttatcagcgactgtcttaaccgcacgtttaatcgttttgatattgtctttagttgattcctccggcttaatctccaagaaacgctctgagaagtaattgatacggtggccatcaatcagatattgtttctcgaccaacatataagaaccggtcatcaaattaacgatgataccttcatctgctttttgatttgcacccggcaaaaccgcttgattcaaaaccaagttgttcaccaattgatcatcgcgataatcaacaatgtgcgcataacgtggcgcaaagtttagcttaatcaagccgaagaagtcatcagtcccctctgcaaactcaaagctcaacaaatcgccggccggcaccgcttcgcttgctgcaatcgtatcaaacagcttttcggcgagttgggtggtcttttcagcaaatgacaacccgttattgtcatcaatcgtctgggctagataatcctcaccagtcaacgtgcccggcttaaaatcgcccgtttggaacttcataataatcttttccagatagtcgtggagtccaggttgagttaaatcaatttcagcttgggatgcaattagattccctgcatctttatccaaaatatgcaaaataacgtgttttaaaatcataatctttatctctcatttatccatttaaaaagctgtggccaactgaattggccacagcttttagtgtactatttttcttgcttaataggcaatgtaattctgaaaatcgacccttgtccaatagcggattcaagttcaatctttccaccataaccttcaaccagtttttgggcgatactcaatccaagaccatttccaccctgcttacgagaacgtgctttgtcgacacgatagaagcggtcgaagacacgcgcagcgtcttctggggaaataccttcaccaaagtcttgcacagccaattgtacgaagttgcccgaacgagacgcagcaaagtgaatttccttgcggtcttggctgtacttcacagcgttgtccgacaagataattaaaatttgctccaggtgatcacgattcatattaacgatagttggccccttcaagtcgtcgtccaagccaaacgtgaagtctggatgtatcatcttgaagttcgtatagatggcgttaatcatgtctttgacatcagtgtcaccctcgcggaaagttaattccacttgatcagcacgtgtcaaatcaagcatttcagaaaccaggccttccatgcgtcgcatttcttgcaaagacgcttcgattgactcagccaaaatctttggatcatccttaccccaacggttcaacaactccatgtgtcccttaacaatggccacaggcgtgcgcaactcgtgtgaaacatcttcaacgaattggtgttgttgcaaaatgaagcgttgcatacgatctagcatgtcgttcaacaaatctgacaagtccgttaattcatcaggacgtcgatcctcatgttgcacacgggcttgtgattgtgggtcggcttgcatttcatcaactacctttttgatgttgttgactgggcgtagcaggtaatctgataaccaatagccccacaaggctaacaagaacaagcctaggccaatcaaaatcatgatgataaggtacacacggttaaatgttttgtgatacgacgtcaagtggttttcaatcacgacataaccaatcaagtggttatttgagttacgcaactcctgacggccgactagcacagaactaccattaacccgttctgttttaacactcaaatctgagacacgttgaaatggcacgccagcaccaccaattggataaacttggcgcccatttgtgttatacaccatgactgtgtagtcctgacgcgtaatctgttgcataacggggtcgttaaccaccttgttcaagtcgtttgactttggtcgcaacatggcatcaacatcagccggtgataatttcttttcatccagattttgcaatcgcgttgtgacaacctgtagtgaggttgccacttgttgacgctcggtttttaacatttgtgatgaaaaagcctgcacaacaaaccaagcaaagattataaatatcaaaaaaacaccggctgcggaaccgagtgcccacttccatttaagtgagagtcccttgcgttgcggtgtttcagtgataatggatgcattgtccattagtcgcccccaaaattactgacgcataacgtatccagtaccacgaacggtttggatgtatgatgcgcgtgagtctggttgatcaatcttattacgcaagtaacgaatataaacatcgacaacattggtttcgatttgtgagtcgtaaccccaaaccttcttcaatagttcctcacgagattggacaacgttaatgttttccatcaagatcaacaacaattcgtactcacgctttgtcaaattaatgatttcgttaccacgacgggcaatgcggttttccttttcgaccgtcaaatcacggtaacgaacaacgctttggtgcgtgctgtgctcttccgtctcaatgttaatacgacgcaacaaagcgcgaacacgggccaacaattcttcgatggcgaatggcttaacgacgtagtcatccgcaccgtaatcaagtccagaaacacgatcaataactgaatcgcgagctgtcatcatgatgattggtgtgttcttcacttcgcgcaaacgacgtgctacttccaaaccactcaattctggcaacatcaaatccaacaagatcaaatcgtaatcattgtccaatgcagcttgcaatccaccacgaccgttgtcttctacgtgcgtttcataaccttcgtgttgcaactctagttcaacgaaacgcgccaaatttacttcatcttcaataacaaggacactactcatgtgcgatacctcatcttactttctacaggatacggtcactcccctgaagtcatgacattttaaaattagcataacatgattttctaataattcctagtcttttgccattctgacggtcattcggactctgaaaatccattagatttccggttatgttgataaacaaaaattgctaacgtaattggcaacaccaaaatgacacctaaaatcgcgtacaacaatgacaacattgatgacgtaaataatttcgcattcataatctcaccgatggtgtaatgcaatttaccaaaccaaattgctaagctcaaaaagtcagccataaatccaaataagacggtgttaacagccgttccaatgatttgctgaccaagcttttgtcctgtacgaatcagctgactggtcttcatgtttggttgatcatgacgtagttcgccgacaccagcagcaattgcgatggctgcctcggcaatcgcaccaagggttgcaagtaaagcagctacgatacctaacgtgacgaaattaacattaatacctaatgataatccttctagttcttctgaattttcttcagcgaatccttgcgccatcgctaaatgttcggctggcaaaatcagcaaaaccaaggcgatcatgacaatgaaacttgcaatcaaggcgattgacgttgtttcttcatcggcaccagaactcaagatggtgatggtcaacaaaaaggcaccaccgactagcaaaactgccatggcgttgaattggaagttaatcagcataatcatgacaatcatgataccaaaattaacccacaagctagcaaaggcgccaatccctttaccaccaccgatggcgaccattaacacaaacaaaataatggctaataccatggttactgtcatcttggcacctccgtcttaattcgggtgaacctacgaactagcaatacccacataatcccggcgggcacagttaacacaatcccaatggcactaatcaacgtttgcaccagccccagtgacatattcatcatgtacgtgaagccccaatcgttaccattgcgcaaatacaagacagccattggaatctgttcagcaatgaaaattaagaatagcgtattactcaaagcaccgaaaatttcttggccaacgtggcgaccggactggatgatttcacgaattgtgatattgggacgttcacgctctaggctaaacaacgtcgcaatcatatcggttgcttcatccataacggcgcccaaaacaccaactaaggtcattgccataaacaacggctgcggtagctgcgtaataaacgacatcagttcaaagtgcaaaccatgattattggtcatcttaaagacaatcgatgcaatgatcatcgccaatgcagttgctgtcaaaacagtggcgaacaccacccaggtctgtcgttgacggaagcccataactaaccccagcgtaattgtcgatgctaacacactaaatagcatgaacaagccaagaatattgccattagacgtatgtaaatccaatgataccgtcccaatgaagagcaccacattaacagctagggaaattacagttaggcgaccggcatgacccattgaaataatcaaaataccaagtactgcaatcatgatcggtacccaaacggtatcacgtttcatggtctggaccgtccaagtttgatggtcagcgcgatttaagaaaatttgattgccaactttaaatggttgttcaatcgccattgctgcatccgatgtattcttcactgtgatggttttaccggcttgattggtattcaacaactttacgcgtaaagactgggtggtctgtttaacgtcattgttgtattggtctgttaatcggttggtttgtagcaccttgacctgcgtcacttggcccagcggcgtacgataccagccagcgttgtgacgcaaaacgaccatacttgtcagaataagcaatattaatacaagccaaggccaccaccgtttcttctctacatactgcttcattaatcaaatacccgacgattgtcgccagccatttgaatttctttggccaagaaatgaatgcgttgcatcaaacgttctgccttaacaggctctgcaccactcttggtaactgtgaaatgttctttttctagctggtccattgagaagttcgatgtgaagaaggttggtagctcattttgcatacgatattcaaggataacgcccaaaatatcatcacgaatccaagcagtaatcgattctgccccaatatcatcaagcaccaaaattggcacacgcttaatggcattaatcttatcttgtggattttcctttgaatcaattgacccacgcatttcaacagcaaagcttgggaagtgcaccaacgtcactggaatgccttcttgggctagttcgttagccatggcgcccatcaagtgggtcttaccgataccgtatgacccgtgaatatataagccacggtgataagcctttgggtcagcgatataagcactgacaaaattgataactgccgttaatgcagctaatcgatcaccatcatcctcagaaaagtcgtccaaacgtgcccgttcaatgagctttggcatcccaattgattgcaccaaatttgcttgcatttgcaaacgttgcgcagccagcgtttcttcgtcaggttggtaaacaatcacaatacgattttcagtcacttcaagcattggcttatagccacggtgcacaaccggcttcccagctgctgcgttcttaacttgtgtgtagaattcgtacaagacggcaaagtcacggttcacaatgtcacgtgtcaaaacgtccttgttttgctcaaaaaaggctttgataccaggctcggcaaaaacctctttttgaatcgccgcgtaacgggcgtgtaagttctttttgttcatgaattgatcgagcgcttgcccaacatccatagggttatccgaatcagtttgacgattcagatgaaatgtttcatcagccattgttaattctccttgttagtctgttgtcgacgagcgcggagttgcgccagttgatccttagcggcctgggcagcctcttcagaaacagttgaagctgtttggttttcccaatcaggtcgcgtttctttaacctgcgctggacgttgccattgacgaccgtttgatcgactcgcaacttgcttttcttgcttggtttggcgtgacttcgcacggcgttgcaagtactcaagtgctccgacggcagtggtgacctttgcttgtgcccaatcgttaacaattgtttgtagcaacgctttgttcagggttgccttcttttcaacgactgtcaattcgtaaagcatcacattcaagacttccggtgctactttgtctaattgtgcaatgtcttccaacgccttgacttcagcatcggtcacaaagccaccactcacttcgcgcaagttttttaagaatacaagcggtgcagtatttttagcagattgaatgattgcttcagctggactcttaacgttcgtatccggcgtcgtctgcgttgcttcgtctggctttgatgtcaccaattcagtatggtgacgttggtcagattgataactcttttttagcattgtgcgaatcgcatccatatcaatgccgttgtcaggcgtaatcgtcgcctgaataacgcgtaccaaatcaacatcccctaagccatacaagtttttgacaatcgtcaagtccgcctcgtgcttgcgaatggctgatgcagacacaccaaatgtgcgtagcatgtcagtcaaaagtgacacgtcaacggatttggccgattgatgcagttgcttttgtaagtcgctcttcgtgtcgtcgttgtttaagggtgcttccggcaacttttcaaatgacacattacccatcatgtcaaagaaggttgttgaaacattcacacccggaattgtcgcgtcctttggcttaatgtcatcaaccaattgttggaacagttcatcacccaaataatgcgcaagtaaacttgatagcatggtatcagccaaaaaggccttcatggtcattggtggaaatagccgataaacccattgtgacccgaaacttgtgtcttggcgataggtcttaattaggcccattccttccaggttctgacgagctgacaaaaagtcgtgttggctaattgctaattgatcaagcaaatcaacgtgcagattctgagcatctggcgtttcgcccatcattgcccaggctaaataaagtgtaaacgcatcacgcccaataattggcaagtaaaccttggttagcgattgtacagcgccaaggtcaattggttcatcatacatcagccgataatgctgacgaattgaaaactcagccatgtcggcctccttgttaatttagtgtggtaatgctgctaaaacagcatcaacttgcgcataagtttcagcaatagtgcctgaattgtcgatgacatagtcagctaatttttctttctctgccattggcatttgcgaattcatgcgtttgcgagcctcatcggctgataattggttacgagccattagtcgttcctgctggacatcagccggaaccgttacaaccatgactgcatctgcgccggctgcattcttcccttccaataacaatggaatgtccaacacaatgagtggtacacctgctgctgcgtatgcgtcagcctgtgctcgcatgcttgcttggacacgcggatgcgtaaattgatttagtttcgctaatttcgctgggttgccaaagacaacagagcctaatgctttgcggttcagcgtgccatctggttgcaacatctcttcaccgaactcagccacaatatccattagtgcgggttgtccaggttcgacaacttcacgcgcaatgacatcggcatctagtaccggaatacctagttctttaaagtggttggacacagttgacttaccggtcgcaatgccaccagttaatcccaatttaaacatgtttttaatcctttactacttggcaaacagggcaataagttgtcccacgttgtgcaactttcatcttctcaagtgggtgtccacaacgcagacacggttcaccaacgcgaccatatacttgtaactcgttttggaattcccctgcttcaccaaacgctgttgtaaagctgtgcacagtggtgccgtggtgttcagtcgcgcgggtgatttcatgaatgatattctcacgcaaacgtgccagttcatcctcagttagcttgttagccgctgttaacgggtgaatttgtgattgccatagtgtctcatcgacataaatattgcctaaaccagcaatgtggctttgatcaagcaaaaacggcttgacgtgcatccgtgacttaccgaactcacttaccatataagccaacgacaaatccttttcagttggctctggaccaatttttgccagtccagcgacctgtaatgcgtcagcatctggaaccaggttcatgcgaccaaatttgcgtgtatcacggtaaaacaggtcaatgccctcatcaagatggaatgtgaccaggtcatgcttaccaggttcagtacccgctggaacagtgtaataagccccttccatacgtaagtgtgacaccatggttaagccaccagagaatcggaatagcaaatatttaccgcgtcgatccactttttcaattgttcggccaactaattcagcatcaaattcttctggtgccatgccgctgattgtcttttcccagcgcacctctgtaccgagtactttacgtcctactactagtcgtgtcagaccacgacgaactgtctcaacttctggtccttctggcatgattaaccgcctttccgaccgtgtatttcatccacggtcatgtgtcatttatcttatttagtttaccatttttaacaggtgacggttagacaaaaaatgtaatctcagcaacataaatttttaggtaaaaaacaggtaacgtatataaaaagactcggcaaatgaattgtcgagtcttcaaaatatctattacttagcgtcgtaccagctcttaccttcgtgactagcaactgatagtgggacatccaacttaacagcagaatccatgatgcgtggcacaagctcatgcaatgcttcaatttcgcttgccggagcctcgaagatcaattcgtcgtgcacctgaagcaacatcttagcttgcaacccggcatcagtaatggcttgctgcatgttaatcattgcaatcttgataatgtcggcggctgaaccctgaattggtgaattcatcgccgtacgttccgcaaagctgcgagcgttaaagtttttcgccttaatatcaggcaagtaacggcggcggtgagcaatcgtttcaacatagcccttttcgcgtgctgatgcaataatgtcttctgaccattgcttaacacctgggtattgctcaaagtatgtgtcaatgatttgcttagcttgctttcgtgacacaccaatgttcttagccaaaccgaagtcagaaataccataaacaatcccgaaattcacggctttcgcttgacgacgaatgttgccatcaaccgtttcctcaggcgctaggccaaagatacgacgagccgtggctgcgtgaatatcttcaccgttaataaacgcttcttgcaagtgcttatcgcctgtgatgtgggccaaaacacgcaattcaatctgtgaatagtcggcactaaaaatcatccagtcatcttgacgcggaatgaaggccttacgaatacgacgaccttcttcaatacgcaccggaatgttttgcaagtttggctcaactgatgacaaacgaccagtctgcgtcaatgtttgcaggtaacgcgtgtggacctttgaatcagaaccgtgaatcacacgtaacaatccttcaacgtaggttgattgaatcttggcgatttgacggtattccaaaattgacgcaactagagggacatcccccatttgctccaacacttcaacgctggttgaataaccagtcttcgtcttcttaataggcgtgtagcccatttcttcaaacaagatcacccctaattgcttaggcgattgaatattgaattcatgacctgcttgttgataaatcgtttgctcgagttctgacaaacgttccgtcaacttgctacgcatttcaagtaacgtgttggcatcgactgtaatacccgtggcttccatgtcagctagcacataggtcaatggcaactcgatttcttcgtacaaattcgtttgctcatgatcagctaactttttagtcaacggcgccttcaagtactgaatagccattgctttgcgtccaaggtgttcaaacaagtcctcatcagcttcaggaatggcaaacttagctcccttgccataaacctcttcatcagtacgaacggcatagtagccgttttcgtgggctagtgcgcctaaatcgttgttattgtcatttgtgtctagcaagtaagcgactaacaacaagtcgaaatcaactgctgggaacgttacacccagacgacgcaacgcaacgatggtttccttagcgttaaagacgttctttttaatggctgggtcttgcaacagcttgttgacaggtgtaccttgcaccaacaactcaatatcgcggctgacaaagtagccatgttcattattaccaattgcgaaaccaacaggtgcggctgtgtggtaattatcgccatcaagctctagataaaagctgacctcatcacccaattgttcaatatgggtcaagttcgtagctgttaactcacgaacttccaatgctgtattgctcatatcgtgaacaggatcaccgttctcatcagccgcatcgtgtagcggtgccggaatagtgtgaccttgattagccagcttcactagttgtgccttgaagtctagatgttgataaaacggaataatcgcatcatagtccggcccttgataagttaagtcagtcaatgtgtaatcaactggtgcattcgtgcgaattgtggccaagtcacgtgacaacaatgcatcttccttaccagcgaccaacttttccttttgcttagaggccttcatttcatcaatgcgctcatacatttctggaatggtgtggtattccttcatcaacttaatcgctgtcttaggaccgataccagcaacaccaggataattgtcactcgtgtcaccttgaagacccttaacctcaacgatttgggcggctgtcaaaccatcatacacttcagcaaccattgctggtgtgtagtggtccatttcagtaattccctttttagttacccaaacagaaacatcgtcggttaccaattgcgtcatatcacggtctcccgtcacaatcgtcaccgcatatccggctgcttctcccatacgggcagttgtcccgatgatatcgtcggcttcgtaaccaggaagttcgtaagacttgataccgtgcaattcaaccatcttacgcaatggctcaaattgttcaaccaattcttgaggtgtcttatcacggtttcccttatagttgtcaaactttcctgtacggaatgtcgtcttaccggcatcccacgcaaccaacgccaaatcaggcttaaacggatcaacaataccgtccaacaggttattgaagcctaccaaagcgtttgtgtgtagtccttcgtgatttacaaaccggtcaacttggttaatcagtgcataaaacgcacgaaaagccagtgagttaccatcaatcaatagtaatgttggttttgccatgtttatctcatttccgggtgacgtttcacccaccgtagtcatatcttaagtgtaacagaaaagcgcctcgcaagtaacgagacgctttaatatttataacggttttaatcgcgtgatccaccgaatgcagtgaacaattgaatcatgtagatgaacaagttgatgaagtccatgtatagtgacaaagcaccagacacggccataccttgttccatatctgcatcaccagcaaattgcatgtacattgccttcaaacggttcatgtcgtatgccgtaaacaatgcgaagacaatcacaccaacaactgacaagaacatgtagacaatgctgttaaagaagaacaagttgataatcccaccgataatcaacgcaatcaatgaaccaaacaagatagatgacattgatgccattgacttcttagttgtcacaccgtacaaagccataccagcaaacaagaaggctgtcgtcaaaaacgccgttgccaacgttccgattggtgttactataccgattaccgtgaacatcaaaccgttcagcaccgcaaatcccatcaacataccgaatgcttgggctggattttggtaaacacgcttaccgaacaagtaaacgaaaccgaacacaaccccaatcatgatgattgatgaaattgggctactgaaaatcgttgcgatttggcgcgcaaacatggtaatacccaagtatgctgtaaccgccgttaccaacaaggccaaagccatgtatgtgtaaactttcttaaagaaactgttcaagccctgcatatctgggttaaccagacgtggctcttgttgttcaaatccaaaattatccatacttttaatacctctttcgttgtccgcagacaatgttttggttaactaccccaatgcttatattataacaaaaaccttaaccgaaactctatggttcagttaaggtttttcgttgttttttactgtaggtttgattgcgtgttggctagaatcttttcaaaagcaaactctgtgttctgcaaatcaccggcacccatgaagatgaagacaccctcttcgtgatccaacaatggtgcgacgttagttggtgaaacgataccaccaaactttgaaatcttagcacccaagtctgatgatgaaatatcaccagcggcttcacgtgctgaagcaaagatttccgtcaaataaaccttgtcggccaattcaagtgacttagcaaaatcatcttggtacgcgattgtacgtgagaatgtgtgcggttggaagacggcaaccagctcacgacctgggtacttttgacgcgccgcatccaatgtcgccgtaatttctgatgggtggtgtgcgtagtcatcgatgatggttacggggccaacttgcttctcagtaaagcggcgcttaacacccttaaaagacaacaactccttgcgaacaaggtcgccatcaatcttttcgaagtacgcaacagcaatgacggccaaagagtttagcacaccgtgttgtccgaacaaaggtacttcgaagttacccaagaactcatcatggtagtacacgtcaaagctagaaccagttgttgaacgcttgatatcagttgcgtagaagtcatctgtttctgggtttgtaccgtagaagtatactggtacatccaccttcatttggcgaagttgtggatcgtcaccccaggcaaagattcccttcttaacattgtttccgaattcttcgaaagcgctacgtacatcatcaacacctgtgtagtaatcagggtgatcgaagtcgatgttcgtcataatggcatagtccggcgtgtagtccttaaagtggcgacggtattcgtcagcttcaaaaatgaagaagcgtgcgtcaggcacacccttaccagtaccatcaccaatcaagtaagatgttggggcaataccagccaaaacgtgggccaacaaaccggtcgttgatgtcttaccgtgagcaccagcaacaccaattgacgtgtattgcttaattaggctttcaaccatgtcagggtaagtcacaaccgtcacttgatcccccattgccaaagctgcggcaacttccacttgatcatcagtaaaggcgtttccacgaataatcgtcatacctggcttaatgtttgctgcgtcgaatgaatacattggaatacccgcggctgccaaaggcttttgcgtaaaggtatattcatcaatgtcagaaccagcgacttgtaggccttgatcatgaagaatcaaagcaagcgcactcatacctgagcccttaattccaataaagtagtacaacgtatctttgtccattttcattcgtccaatctgtttgtaagtaaaatctattatacacgtaaaaagacctccagacaaaaactcagcggaatgtaaaaaagccttaaccatggataattcacggttaaggcttcacagttatttagtcttcgaaatacgatgtttcgcttttagcagccacgattgcttcttctgataaaatatcatccaaactcaagcccagacctgttttaacatgcgtgtgagcatgcttttcatgggtcgctactgctgcttcgctgaccgcaactgaggcaactggcttggttgcggctgccacctttaccacttgcggttgcaatgtttccacaacaattagctcagttggttcagccacgattggcgtttcaaccactccaggttcaactgccggctcagcaagtacatcaaccgcgtcttcagacgaatctgcccacatgacataagccgtcttagctaacatcaagtgcgcaacttgctcatcgtagttttccattagacgttcataaaagacgatgggacgacgatcagccatgctgttacccccgtcttattggaacaacgcttgggcttcggctgagcttgcgtcgaacggcgtgcccacttcggcaaaatcgtcaggcaaaatcaaagcacctggcacttgtggtgcgtttggtaaacgcaactcacgaccagacgtaatcataccgttagaggcaacgccacgcaaagcacctggccagataatcaaacctgaaggcatcatggcaccaaccttagcaacaacaaccttaataccttggcgcatgtttggtgagcctgacacgatttgcacgcgttcatcgttatctacgaccgtcgttgtcacttgcaagtgatctgagtctgggtgtggctctgcagactcaacgtacccaacaacaaacttaggtgtcgtatcagctaccaatacatcctcaaatccagcagttgcaagcgcatcgttcaacttggcaacttgttcttcagtcaaaataacttggccgttaacatcagacaaatcaagaatttgtgaagcgttcaaaaaattcaatcccaaaaggttgttgtccttatcagcaaggcgtacaacatctcccttttgtgttgcggtgtgctcagctgcaggcgcagtcaacacaaccaaaacatcccccattcctgctgggttatagctggcaatcaacatcttgtcagtctccgtttcttttttatttattagtcaccgtaaatgatgtcatttacagttgtcttatcaagcttttgtgcaagtgtttcaaccagtgcttgagcagcttcaaaatctgaaactgaccaaaccgtctggtgcgtgtgaatgtagcgtgacgcaacacccaatgcaactgatggcacaccagacaattgtgattgtgcgccgtgtgcgtcagtaccacccttggcgacgaagtattgcaaaggaataccggcatcatgggcggtatccaagacgaattccttcaaacgcaatggcatgatgacacccggatcgtacacgcgcaacaaggcaccgtggtccatttgaccttggccttgttctgattgcgtatcatcagctgcagatgaatcaagggcaaagaaaatatcaggttgcaattggttaacggccgggccgacaccacgcagaccaacttcttcttggacgttagcccccatcatcaacgtattaggcagtgcgacaccttgtaagttctcaagtgcattcaaaatcgtgaccaaaccaaaacgattgtcccaactctttgacacaacgcgcttgccattagccaacatttccgttttaacagctggcacaatgaagtcacccgggtgtacaccgaatgaaattgcttcatcagctgacgtaaaaccaccatcaaacaaaatgtcttgaatcttcggtgccccattcacaacaccttcacgcaaaaagtgtggtgatacggctgaagacacaactgggtattggttatcgcgtgtaaagagtgtgaagcgttgcgccgaaactgtataagggttccaaccaccaactgggtcaaccaccaacataccgcgtggcgtaatttgcgtcacaatgaaaccaacttcgtccatgtgagcgccaatcatgatacgtggcgcatcagcattctcgttgtgacgaatgccataaataccgcccaaaccattttgaacaacttcatcaacgagcggcgtcaaatcctcacgaaaggccttgcgaacggcatgttcttgaccagaggttccttgcaactcagtatactttacaatacgattccaaatacgttcttccatgttgtgtcacactttcttttttacttgtgcaaatctagaatggcgcggatttgcgcttccaacatgccaataccaacaacgttagcgccaccttctggcaaaataatgtcagcgtatcgcttcgttggttcaacgaattggtgatacataggcttaacggttgccaagtattggtttacaactgattctgtcgtacgaccgcgttcgacaatgtcgcgttgcatgcgacgaatgaaacgcaagtcgtcatctgtgtcaacgtagaccttaatgtctaacatgtcacgcaattctggttcagtgaacagcaagacaccttcaacgataataacgtctgaagcttcaaccgttaccgtcttatcagaacgcgtgtgtgcagcgtagtcatacgttggctgttcgattgattcgcgttgcaacaattgcttcaattgtgcaatcaacaaatcattatccaatgaatctgggtgatcatagttcgttgcaacacgttgcgtcatactcttatcactttgatccttgtagtaagcgtcttgtggaatcataaccacagactcacccttcaaacgctcgatgatttcacggctaaccgttgtcttaccagaacctgagccaccagtaactccgataacaactggacgtgaattagacataatacaatcctctttcttcaattcaattctttaaatataacttattgtaggggtagtgtcactgtaatggttgtcccaacaccaacctggctatccaagtcaatggtacccttagcttgattcactaggtcattgacaatggcaagcccaaggcctgtgccaggtatcgtttgattacgtgacttatcaatgcgataaaagcgctcgaatatacggttttgttgttcactcggaatccccaaaccagtgtctttaacagccacgacaaattcagaagctgtaaccatagcagaaacctttaccaacccatcgtggcggttgtatttaacagcattaacaattaagttggtcaaaatttgacgaaggacagttgcatcctgcgtaaccgtaaaggatggcgcaacctcattctgaagtgtcaactgttgcttgtcagcattttctgcctgggacttgaatatatcattcaccatatccgacaacttaattggtgtggcagtttcctgtcgttcaggcactttggcgattgtcaaaatatcttctgtcaattctaacaaacgattcgtttccgtttgaataatcgttaagaactcttggcgagcctctggatcctcctgagcaccgctcaatagcgtttctgtaaagccagaaattgctgttaacggcgtgcgcaattcgtgcgacgcattcgcgataaaggcactctgcatatcttgcatttgcgtgacctcagtcatgtcgtaaagcaagaccaacaattcgtggtgtcgttcgcgtgtctcgtaataaaccagtgacacatcgacaattcgcgcatctaatttaactaactcgcggacatgtgtttgacgcttaagtgactgctcaaacaatgacaatagtcggtgattcttaataacgtcatcatattgtcggccgacgacattttgagtcaaaccaagaagcgcttgggcttgtggatttgtctgaataatcgttctctctggtgtaatacgtagcgcgccaagtggcatattagccatcaacgcagccaatgtactaccttgctgttgtaacaacttgatgcgatttcgattgaggcgttgaacatcattaatcgcttcagccaacggtgccaatgaatcgtcaggacgcatcagaatgtgtccggcacgcgtattgtccgtttgcaaatcgcggagtttatcaatgaaaatggccatgtgttgatcacgacgttgctgttgtaaatccagtactagcgttgcgacacccgccaaaatcattgacagcaataacagcaaatgtgcttttggcattcgcgtttcatcacctgttaacgcagcaaccaggaaaagcccccagattaacacgaagaacaaggcccagaaaatgacaaagcgtttcgcattatgcattaattctgattgcatgatagtcctccctattcagctgtcgcttgattatcaaaacggtaaccaaaaccacgaaccgtctttagatggacgggatgttttggatcgttctcaatcttgtcacgcaggtgcgaaaggtgcatgtcaaccatgcgtgtgtcaggccccgtaaattcgtagccccaaacaccgtgcagaattgtttcacgacttaatacacgtccctcacgttcagccatataagccagcaattcatattccttcggtgtcagtttaataacctcaccatcgcgctgcacaaccatcttgtcaaaatcgattttgatattaccgaattgcttcgtcttattctcgcttttgttctcaggtgtcgtcacatcgaagcgacgtagcacagcccgcacacgggcaatgacctcacgagggctgaatggcttggtcacataatcgtcagccccaatttctaggcccaagattttatcaacttcctcatccaaagcagtcaacatgataatgggaatgcggttcttttcagcacgcaattcacgggtgacttcaacgccactttttcctggtagcatcacatccaacagcataatgtcaattggttgttctgccagggttgtaattgcacttggcccatctgtagcactgacaacatcaaaacccgacttcttcaggttataagttagcagtgtcaccagagaaggttcatcatcaacaactaaaactgtcgtcatcacggtaactcctgtaattaatattacttctagtgtaccacgactttaccggcttctgacttgtaattctaatttttcgccttaagtgaatgaacattcgtttaattaaataagcaaaataaaaaggcatcactgccttttgtgtaaatcgcgttatgcttgcgccaatttcgacgcatgcttgcgactgattttcttaataacaaacatgccaacgagcatcatggcaccaaggaggaacactgtccactcccccatttctgaaacgccataaccaaacgatatcgtaatgattggtgcaaataaatcggtagcaaagaatgaaataccaaacacacgccccaagtattccggcgcactatcttgttgtcggacggtattaatcttaatgacaaatgacgcccgtgcaaagccgttcaagatcacgagaatgacgaatacccacaacgtttgcacaaacgtgcctaataaaaatgcaacgcccaacacataaaagtcccagtaaagggtcttcaatgaatttagatgtggtagacgggcaaacagcagaccagccacgataccggctaccgcagccaacgtcaaagcggtcgaataatccgttgcggttccgtgataactgtgttgaatcaaaaacggcatcgcgatgatgaatccttcgaagaagaaattgctccacatcgttagcagcattgactcgaacagccttggctgtgatacaacatagcgataaccaccaatcaaactttgccaaaatgattctgaatgcacgctctcgtgttttggcgttggttgatatttaattgccaggttcaatccaactgtaattaacaacatcaccccgaagatttgtaggaaagattgtagatcaatccacttcaagtgtaatagtagtccaccaaccagtggcccaaaggcttgtccagttgaaaaggctgcagatgcccaggcgttaaagcgcgccaaagcactcgtcttaatgacatccggcaagatagctcgtgctgccggataagcgaatgaaacatcaacatttaagatgaacgttaatgcaaataataaccaaagttgtggatgtgcaggattaatcaccatcgacaacgtcaatgtcccaattgcaccgaacaaatcagcccctagcaatacccacttacgattaaagcgatccaataccgaaccgacatacacatcattcagcagataaaccaggaagccaaatccggttaaccaacccaatacttgtgcgttaccgtaacttgaaaccaaaaaccaatttaagccaaatcggtacaccccatcaccaaaaactgatgcaaaattcgaagcaagcaatggaaaactaaacttcgctaatttcgattctctttcttgcatggttacccctctctgaaaaacataatgtgcttagtgtatcaaactctgtctgactcgtcactgccgaattgtaaacaaaaaccagaaccaacaatgcggttctggtttaagaatttcaattaattataggaacttaatgaagaccacacccgcagccatcacaacaacacccaagatttgaatgcgtgacacgctgatcttagctgatcgccaccagccgaattgttgaaccaacatagaaccaacaatttgaccaatcaatcccattgtaattgtcaatccagcaccaatttgtggcactgacaagacactggcaaagacgaacaaaccaccaaggataccaccgagccagttccagctcttagcttgcttcaattctgacatctttggcaaacgcttgtccacgatcaaagcaacaatcgtaatcaagatgaatccaacgaagaatgaaatgaatgatccttgggcaggtgcgtgtagcaaagcacccaagcgaccattaatagcttgttgcatcgctgagaatgcgccggcaataattgcccatacacgccaacctagcaattcagtgtgcgtctccttggcttggattgccttatccatcgcctcaacatccttattcaagacgtttggcaaaacaacggcaacgaccacaccggcaatcaaaataatcacaccaataacacgtagtgccgtcaaaggaattggttgtgaaccaaaccaaccaaacgtatcaataagcgtacccatcaagatttggccaaggattggcaaaacaactgtttgaatagctcccaaacgtgggaatagcaacacgtttgatgtcaaataaatggcacctagtacaccacccaaccaaatccaagctgggtttgattgaataaaggtcatcgttggaaatacttggtgtgactttacggcactaacaatcgccaaaaagactgaaccaaccaaaaatgagatcgctgctgaaataaatggtgagcccaccaccttcttcatatcagcgttaatagggttttggttcgcaagcatgaaaccagcaaacaatgacaaacctagaaatacaaaattcactgctcttctcctaaaaaataaaatctttattaatgaatgctttattattgtaagcctttaaagatgtaatgcaagcattttgagcaatctattttgtgaaaaataacgctttttatttttagaaacgcctattctaagctgttttatattttatatgattgatttttcttcacaagcttgtgaaataaaaaagagattagtcatcgactaacctctttttgacgatatattaatcttccttacgcttcaaatcttcgcgtggtccgttgtgcttacgacgtcgctttggcaagaggtaacgacctgccaagaatacaacaacaaagacaacgattggccagattaatagcttccaccaattagatggattcttccaatcatcagccgaattcacttgttgtcctgccaattgtgcaacttgcgcggcagtaacctttaatgtacgcgtttcagttgttttaacatcacctgacgcaacagtcacgtgcaccttatatgtgccaaccttgattgacttaatgttcttcttaatgtcgaatgtaaaacttgattgtggtgcgatatcgacgttgccatctttttcgtaaacaaccttatcattcttatcagtcacactagtcgtaacagttgcatccttaaccaacgtatttgccttgttgctcaaagtaacacccaatacacggtcagctgacaagtcgttcaggcttgctttgcccactttaagcacaggctttactggcgttgtatcgttttgtagaataactggaatttcagacgccgtatttgaagttgttgatcgtacaaacgagacaccacccactagttgtcccgcgaatgcttgatcaggcatcgtgattgttccttgaactgacgtttggccttgagctggaattgtgacactactttgaatgtcaatggtatcaccaaccttatatggcacttgtcccgttacgttttggctacctgtaacgtagttcaccttaccattttcgcgtgttgtcgctgtaccaccagtcaaacgaagcgtcatttctgaatccgtattgttcttaatatagaacgttacttgctctttctggcctggtgccagcttcaaatcaatcgatgacaagttgttcttgtcaatttgagaagctggaatgtccgctgtaatatcatatgcgggcaatgtgtctgctgaaaccggcttcgatatgccaatcaaagcgagtgccaaccccaccgcgtaaactgcatgtcgtaatttcataaccaataaacccctattttcgcttattataatgacttttcttttaaaatgcacgcaagtacgctttacaggattactgtacttgatacttttgaataaagatgtcttatttaactaagaatcgcatgtttttgaaccacataactgtcaaaacgatgccaacgattgccaataaactaacagcgtataataacgcctctatgaatggcacctttttaggatgtgcttcatctgttggcgcagccttttttgatagcacgatttgcttttgccaggtttgattcgtcccgctccagtttgcttgcacctgaatgcggtatttattgcctgtcaggcgcttggcatcgtttttaacccaatatgtcataactgaattaggcgccagctgcgcgttccgtcgcgtctctacaagaaccgttttatttgtggagacatcgattacttttgttgtaaaagttgcgccgttaataaacgatcctgaggtatttgcaacggcaatcgcaaaaccagtttgtttattgacagtttcatacgaaacggcatgaagttctgccgaagttgccggcaaatttcgtgtgtttcgtgcaagcaccgcaacggttgtttctaccgcatcctgcttttgtgtcgctgtcagtgagaaagagactccaccagcaataatcccatccaccggttcattcgacatggtaatggtaccagtgacctttgcatcgcccttaggcgcgactttaatcgtctgctgatccaaatgaattaagttttccatttgtgggccaacgttcccaatcacgtgatgatcgttatatgtgacttctcctagtggcgatgtggatgcagagcccgcagcaacgttcaatgacaattctgagtctgagttatttttgacgtcaaacgtcactgattcaacttgcttcggatttagcaataaatcaaggtaatttttattttgactgtccagttgggtcttagggattaccggcgtaactgtgtatggtgcattatcgtctgcggaaacgtggcgcatcgtcgtaaatgccagtatcaacgccaccaatccaaagagtatttttttcattttctgctctccatgctttgacaaaaaagaaaggacgaggtgcaacgccctcgcccttttcatttcgtcttaattagtccaagaaatcacgcaattgctttgaacgtgatgggtggcgcaacttacgaagtgccttagcttcgatttgacggatacgctcacgagtaaccccaaataccttaccaacttcttccaaagtacgcgtacgaccatcttccaaaccgaaacgcaaacgcaaaacgttctcttcacggtcagtcaacgtgtccaaaactgattccaattgttccttaagcatttggtaagcggctgaatcagcaggtgaaatggcttcattatcttcaatgaagtctcctaagtgtgagtcatcctcttcaccaattggtgtttccaatgaaactggctcttgtgcaatcttcaaaatatcacggaccttgtcagtcacgatgtccatttcggcaccgatttcttcaggcgtaggttcgcgacccaaatcttgcaacaagttacgttgaatacgaatcaacttgttgattgtttcaaccatgtgcacaggaatacggattgtacgagcttggtcggcgattgcacgagtaatcgcttgacggatccaccaagttgcataagttgagaacttgaatcccttacggtaatcaaacttctcaactgccttcatcaatcccatgtttccttcttgaatcaagtccaagaattgcataccacgaccaacgtaacgcttagcgatagaaacaaccaaacgcaagttagcctcagccaattcttgcttagcagtttcatcaccttgctcaatacgctcggccaaggcaacttcttcatcaccagtcaacaatgacacacggccgatttcctttaggtacatacgaacagggtcattaatcttcatgccagtaggtgcatcagcagcttgcttcaattccttttctgacaactttgtcttcttgttttcaagcgcacgtgcggttggctcgccgttttcatcaacgacagagataccagctgattcaatcttctcgtatagttcatcgatttgatcagcattcaaacgcattggctttaccaaagcatcttggagagcattttctttaatttccttgtcggccttgaactccttgatgatgttcttaactgccttatcaaattcagcttgatcgaactttgctgaaattggtgcttgcttttctgccatagcggcctccttaattacttgtgggtctgttgttcacgtaacgccgccatatactcaacactaagctgagcgactagcgcgtcattgtgcatttgattagcttctttaatctgacgctgtaacctactaattctatcagataatggggcatcgtggctaataaattgaacatacatgccaacttgactacgatcagcgaataattcgtcatcaaaatcatcaagcgttgccaaaatacgtgtcaattcaggtttctgaacaaagtccataaagcctgccatatcaacaattggctcattgccatgtgtctcacgatagccagttgccaacatcaacagcgtttcgtatggtacgtcaacgaacgtaaagtctggtgtgccagtcacttgcaaccaaacatcgttatcacggagcatccaagccaacagcattcgttcagctttttcaactcgtgaaatcgttcgtggcgttggcgccggaatcggtgccggtgcattagcttgccaatctccattcggcgcgaccggataattaggctctggtcgacggtaacccgattgacgattattcgtcgacctagggttagaacgattggcctgctgttgcagtagcaatggacgcaattgatcttgcaacgcctccatgccaatgttgaattcatcagaaatttcacgtagataagtctcgcgcataacgggttctgacaccgttgcaatgacacctaatacatcacttacgtaagcaaacaactcggtttggttattcagattgcgatccgtctttaaatagcggatattaaacgcaactggatcttcagtattatgtgatagcacattcaaaaatgcactgacatcattagcacgtaaaaactcatcaggatcttgattatccggaatgtgaatcacattcgccgtgatgtgcccgttttgcgcaactaagtctaacgcacgctttgtcgccttttgaccagctgcatcagagtcataactaattgacacgttatcagccatgcgagaaagcacttgcacctgttctggcgtcaacgatgttcccattgaggcaactccgttttgcacgccagcttggaatgcggcaataacgtccatgaacccttcgaatacaactgcgtgcttttgcttacgaattgcgcccttggcaaggtccaagttaaacaattcttgtgacttgttaaacagtggactctcaggtgaattcatgtacttcgcttgggtgtcgtcatttgacaaacgacgtccagaaaacgcgattgggtgactagcactatcacgaattgtaaaaagcacacggttcgtaaagcgatcgtgcaacgtgccatcgtcccattcaatgaacaattccgatgaacgtagcaactgataatctacttgttgttcttggaagtagttaatcaacacatcattttcaggtgcgaacccaagcataaacgcatcaattgtgccatcatccaagcctcgattatgtaggtaatcaagggcaccctcacccgcctcggtattaactagcaagtggtggtacaactttgtcgcatctgcgtacaattcgcgcagtgccttgatttgtggatcaaccacttccgttgcttcatcagatgtgtatgatgcatctaaatcaacacccgcaaatggggcaacctttgccacagcttgtgggaaagttgcattatcgatatccatgataaaactaaagacgttaccaccacgtccgcatgagaagcagtgataaatttgtttatcttcattaactgagaaagacggggtacgctcatcgtggaacgggcaaagcccaaacagattgcgtccttgtttcttcagttgtacatatggcgaaatgacatcaacgatattaacacgttgtcgaatttcttcgaccaactgttctggaatacgtgttgcgattgtcatcacccccaactctaaaaatgaccatttccagctcttataattatacgcttgaatgcacaatatgcaagtaagtttgtcaacccccattgaaaggcttcaaccgttgataaatcaaggtttcaatttttcaattaaaatattatgtaaactaaaaagccaccaaccaaaaaccggtcagtgacatttaatagtaatgttatttgttcgctgtttttacactgcgcatgactgtgaaaaaggccaaaattgaaacaatcatcaagacagttaagaaaataactccggattgcgacccagtcacaacgccgtctccaatatgacgatcagttgccgatgcaaaaatttgggcgacaatcgcggtcgcactggcaccaacaaattgttgcaaggtgttcagcacactgttaccatccgcattctcacttggtgccaagcttgatagcgtgatggtcatgaggttcgcatatgaaaagccgattccgaccattaacaacatatgtgtgagcatcagcgtccagaatgatagctccttaaagaatacggccatcaacaccattgccagcgtcgcaacgctcagaccaaacaaaattggcttaactgcaccaaatttgtccaacacgcgtcctgaaactggtgccagtacagaaccgatgaccgcacctgggaacataaatagtccagcagcagttgctgtacgccccaaacctagttgcaagtagttaggcaaaatgaatgatagccctaacaggattgcttgataaacaaggaagctaatcattaagcgatcatagcgcgagtgacgtaaaatggctaaattcaatagttgacgacgcttgtttaagaatgcgaatatcactagcaagacgactgccccaattaggaacattagtgacagacgttcgacagccatcaatagcaatgccaatcctaacccaagaaaaacaaacgcaccaaaggcaaaactttccgttcgcttaactgtttcaaccggcatgcttgtcagtcccatgattaatgaggctaccaacaaaacaatcaaaaaccagaagattgaacgccaacccaaactatttaacaagataccgccgtatgttggaccaatggcaggcgcaattgacgtggtcattgttccaattcccatcattacgccacgtcgatcaagtggggatttcgtcaaaatgatgtcaaacattaatggtaatgcgattcccgttccaattccttggaagacgcgaccagttagcagcactaatagattaggcgcaaaaccatctaaaatgacccccaccaagaataatagatttgcaataataaacagacgtcgtggcgaataattgcgaattaaaaatgctgaaagtggcacaatcacggcgatggctagcaaataaccagtcgtcacccattgcacgccgtttgcgtcggtttgaaactcattcattagggttggaaacgtaacgttcatcgatgtttcaatcaacaccccactaaaactcatgataccagccgcgattacagctcgtaacacatgccattcctttgcctgcataattccctccttaaaacaaataaaaggcgcccatcatctcaattagaaatgatgttcgcctctatgttcggcacaaataaattgtgctatctgtacgtaacaactcgtattactgtacagattttatgcaagtttgtcaaaatttttagtgattttcaaaccaaatgctaatttcgcgttcggcattttcaacactgtcagaactgtggacgatgttacgtacggcaccatcttcccaatcgcgaccataatcaccacgaatcgtgccaggagctgcctcacttggattcgttacaccagccatcgcacggaaattcttcacgatgtttgtccctgttaccaccatcgcaactaatggaccgcttgtcatatactccaaaatttctgggaaataaggtgcattgaccttttcggcgtagtgacgacgtagctgttcttctgtcgcctctgtcatcaacagcgacgtaatcttgtagcccttacgttccaaacgtgaaaagacttcccccatcaaaccacgcgcaacaccatctggcttaatcaaaaccaatgttcgttcttcagacatgtcattatcccccttgtcttatatgggttaatataccacaaattcaatttttcacacaccaatatcctgccagatgggcacaaaaaaaccagctttgacagctggttcattttttaatattaatgtgtgcgcaaatacttaaccgcatcatcaaacgtctttactggcacaattttcatgccaggcgcgtatttcttagccgttttgactgctagttggtaatttgtcatgccgtcagattccattgccaaattggccttggttggcttgatatatggggcaaagaaaatcttagcacctgatttatgggcgactatgacctttttatcgataccaccaatttcgccaacattgccgtctttgtcaattgttccagtaccagcgattttacgaccggcagccaaattttcattggccaacgcatcgtacatttctaatgagaacatcaagccgccagatggaccaccaatgtcgcccatatccgccgtcacttgtcgatcagacgtcacatcaactgcgtctgttagtgcaataccgatacctggtaacttcttagtcccggccaaagcaaccgtcttaccagttgcttctttcgtcttgccgttatgttgatagttgattgttagttttgagccaactttgtttttacgaatgtaattttggaatccctttgctgactcgaacgacttaccatcaactgacgtaatgaggtccccgacgtgcaactgcttcttaaaattagagttatcttgcacagccataacgtaaataccgttaaaggtacgtgtatatggcacgtcagcagctttaaacgctgtggctttggcttcattcacagcagagtccatgtacaccttgttaatagccacattgtcagcctgagagccgccaccattcgcctcatatgaagtcattagtgatgcagttggatcaagtaacgccataatggcaccaataccgttaacctgcgacatatagacagctgtgatcatatactcaccgtcaaccttaggcttcttgccatcaactttgatgtaaccggctagattgtctgcctcgccaggggtttcagcatataacggcaatggactaaccaatgccaacaaaactagcacagccgcaataatgccagaaattttcagccatttatgagacttcttttgtttttgagccatacgctacttctccgcgaacttttcagcaagtgcattggcaactggaccaggcaccaattcgtgtacgtctgccccaaaactaacaacttcttttagaattgaacttgaaatattctgatgctctggtcgggccatcaaaaagaccgtctcaacagtgcccaagaagtggttcatttcggcaatatcacgctcgtagaggtaatcagtctcgttacgcaaaccgcgcaccaacgtatcagcgttgatttctttcgtatactcaatcgtcaaaccagacatttcacgcacggttacgtttggcaaatcagctacggatgcctcgattagggtaatcttttcttcaggtgaaaagagatactttttcatcttgtttgtgcctacaccaatcacaacctcatcaaagagcgttgcagcacgcttaacaacatctagatgtccattcgtaaatggatcaaaactacctggaaataatacacgacgcattatgcttcccccttatattgatatagcttaaccaccgtaataccgtaatccttttccttcgaaaactcgaaattaggcaaatcttccggcaagtttgcattttgatccgtctcggccacaatcaatgcctctggcgcaatcaagtttgctgcaagaagcttctcaaggtcagcaacaatcgtttgcttggcatatggcggatcaaagtacaacacatcgaatggttgtgatcccatcaagcgttggatagctgcatctgcagtgctcttaatgacagtaaacttctctggtgccttcgtaatcgcaatattgtcgttaatcgtcttgattgctgcgaattgacggtcgaccaagactgcttcatctaaaccgcgagatacgccttcaatactcaatccacctgatccagcatacaaatccaacgaacggccaccatcaaaatacggaccaatcatgctaaaaatagcttccttaaccttgtccgtggttggtcgggttgcatcacctgggaccgccttcaatggacgaccaccaaattctccactcacaatacgcattacaattcctcttcttcagctggctcatccaccaattctgatggatcaaccgaaaattcaaacgcctcaccttgactaccaatggttgtatcaacctcaggccagtgagaaacatcaacagatgctacgaaacccaagcgttcaatcaacgctgactttgaggcaacatcttcttcattcatataaataacagcatatttcatcttttctgaaatataactgacaacgccaaaacgacgcaattggcgcgcttgacgaacatttttcaaataaaccacgacgcttcggcgtggcgttacttcaaaagccatttattcacgctcccgtaaactttcattctttttcaaaacaccgatcatgttaaaggcgattccaaacgtaattccccaagacatcaatgatgacccaccatatgaaatcaacgggaacgtcacaccagtaatcggtacgactccgacaacaccaccaaggttgaccagaatttggatgccgatatatgcagcgataccatacaacgtcaaacggatttgcatgttacgtgtcttcactgcgtatatcaccaaacgccaaatgataaagccaaatacagccaggataatcaaaatccaagcggcacctaactcttcaccgacaatcgccatgataaagtcggtgtttggctccggtagataaccggccttctggatactattacccagaccacgcccccagaaaccaccatttgaaatggcgtaatacgaattaatcaattggtgtcctgcatcctcagttttccaaggatcaatatatgattcaaatcgtagcaattggtagtgcatcaagggtaatttctcaagaaccggcaacagcacaggcaccattatcaaaacgccaatcacaataccaaccatcgtaattaaaccagtaggacgaatacctgacgttaagaaaatgattgccaccaaagcaaacagaattagcgcaccaccgaggtcaggcattagtgccgttagcaagataccaattccaggtgcgataaagtctttgtagtaatgaacacgttctttaatacctttgacgactttgtacggattgacaacatttcgcgcgaaacgcttggcgaaccataaaatcatggcaactttaaagtattcaaccggctgaataccaaaggttccaatgtaaatccaacccttggcacccgaggtaactggaccagcaaccagtgcgataagtaagccgatatccgttacagccaaaaataccgaaattaggtaatcaatcttggtcgacgaccagttgatgtcgacgctaaagataagcaacatcgcgctcacgctgataacgctaaagaacgcttgcttgaacaagaaggacgtcgaactccctgaattcatattcgagctagctgaatagaccatagttacaccaaagactaatacgccgatgattagtaacagcaagaccaagtcaaggtatttaaatttctctctgacgcgtttcggcgtatcccgaatggtttcgaataaccgcccccggcgtcgttttttcacagcttgcatcgttcagggctccttcattaaagtctataacttgtattattttagcacacttccccctgtaacatttccaacttcatgaaatcacaaaaaacgcccttcagcatgatgctaaagggcgttctattagtctaattttttaaaaagattagccttgttgtgcaatcttcttacgcttagcagccttctcacgctccgccgtaaccaaaatttgcttacggatacgtacgtgttctggcgttacttcggcgtactcatcatcgtccaagaactccaatgactcttcaagcgtcatatcacgtggcgtcttgattgaggcagtttggtccttgtttgatgaacgaacgttagtttggttctttgccttcgtaacgttaactgagatgtcgttgtcacggctgttcataccaacaaccattccttcgtagatgtcatcacctgggtgaatgaacataattccacgatcttcaacacccatgatagcgtaagtcgtagcttgaccttggttaattgaaaccaacgtaccgttacgacgacctgggttccagttcttaacaactggagcgtacgtctcaaacgtgtggttgtagataccgtatccacgagtcaatgacatgaattcagttgagtaaccaatcaatccacgtgaaggtaccaaccactccatacgagtcgtaccagtaccagttggctccatgttacgcatctcacccttacgttggttcaatgaatcgataactgaacctgagtactcgtcaggcgtgtcgatttgaacagcttcgaatggctctgattcaacgccgtcaatttccttgaagataacttgtggacgtgaaacttgcaattcgaatccttcacgacgcaaagtttcgatcaagattgacaagtgcaactcaccacgtcctgataccaaccatgcaccagcttcatcagtgtcatcaacacgcaatgaaacgtcagtgtgcaattcgcgacgcaaacggtcttccaattgacgggccgtcacgaacttaccttcgcgaccagcaaatggtgagtcgttcgtacggaacgtcatttgcaaagtaggctcatcaatacgcaaaactggcaatgcgtccaagtgtgatggttcaacaacagtttcaccaactgaaatttcttccatacctgaaacggcaatcaagtcaccagcaatagcttcggtgatttcaacacggtccaaaccaatgaaaccaaacaacttcgtaacacggaagttttgcgttgtaccatcaagcttcataacagtaacgttgtcaccaaccttgatcttaccacggaagacacgtccgataccgatacgtccaacgaagtcgttgtaatccaacaatgaaacttggaattgcaaaggctcgtctgagttgtcttcaggcgctggaatcgtttcgaatacagtgtcgaagattggcttcatcgtgtgctcttgcgtagccaagtcagcatccaatgatgacgttccgttcatagctgaagcgaagataactgggaattccaattgatcttcgtcggcacccaattcgataaacaaatcaagcacttcgtcaacaacttcagtaggacgagctcctggacggtcaaccttgttaacaacaacgattggcgtcaagttttgctcgaaggccttcttcaaaacgaaacgagtttgtggcatcgtaccttcaaaggcatcaacaaccaacaaaacaccgtcaaccatacccatgatacgctcaacttcaccaccgaagtccgcgtgtcctggcgtgtccaagatgttgatttgcttgtccccaaccttaacggctgtgttcttagccaaaatcgtgataccacgttccttttcaagatcgttcgtatccatggcacgatcgccaagttcagtacgcatatcaagcgtgtctgattgcttaagcaattcattaaccaacgtcgtcttaccgtggtcgacgtgggcgatgattgcaatgttacggatgttttcgcgctttgccaaaatcctattctccttgactatacgtcacttttattactctaatcggtgtaacaactaacaaatacgagccgctgaacacgcggcccggcttataggtcacgttcaattgacatgatatcgttatatgcttgttgtgttgccactagaactgctcctgataataacatattcacaggttggtcgtcaatttttccgactttaaaccctaatgcttcaccaagcaatgtcccagcagcatagtcccaaggcttcataacactggcgtaagcaactgctcgaccagtcaaaacatgtaagtatgaaatacctgcagaaccataaacacggtacccgattgcttgtttggcaatttcagggaaaccgtattgttcatataaaagtcgtgctcctgacaaaatcacgagaccgtctgccaacgatgtattcgttggtgagcttagtggttcatcattatggtaaaccccgtattcagggccaccgtgtacaatatcgtgattgacaacgtccataatccacgccatcaccggcttgccatcttcatagacagccaacatggtcgcgaactcagcatgttgcttcacgaagttcattgtgccatctattggatctacaaaccaaacacgaccgtccaaactgttaaccgcatccccaaacccttcttcaccaagaatcttggcatgtggatcaaaccgacgaatggcatccacatagaattgttcagtttctcggtcaacgttcgtcactaaatcgcgatgtccttgttttgtttcgacctgcatccgttgagagacacgcttcaaaacgttatcgtggacggtatccagccaaccaagaacagttgtatccagtttctttaattgtgtctcattcaactgctagccctccattttaaggcgcttagtagacgcttgttgggctgcctgaatcgtacggtagatactgtaatctgattctaccccgaactcacgatcaagttgcttttcttcagccttacttggcacaacagttttgaagtccttgtaggccgttaaaagtgactcacgatccacgccaccttcgtacgctgcagaaacagctgagtacaatgcgcttaccttgatgatgtcatctgttgaccaaccatccagcatgggatagttaaaatttttatcgccactgaccatccggactacccaatgtaacgtgtgccgtcagattctgaccatggcgtcgtcttgctgatgtgatcgtagtatagcgtaccgtgcaagtggtcaatttcgtgttggaaaacgatggctgggtagccttccaacttcaattcttggaaggcaccgttttcgtcttgatacttaactgtaatacggtatgaacgctcaacgtaaccaggtacatcttcgtcaactgacaagcaaccttcacccattgacaaggctgtttgcttaactgattgacgtgtaataactgggttgtagattgttcccttaaagaagtacgttggctcagcgtcttcgtcaatatctgagtcatccacatcttcatcaggaatcaaaattgaagaaaattgttgtgaaataccaacttgtggcgcagccaatccaacaccaggacgaagaccgtacttttcgttttcttcttcatcttgactgatgattaggtattccatcatgttctttgtggcttcctttacttcatcagaaagtgggaacgtcacctttgcggcttgttggcgcaaaacgggatcgccatcgcgcacgatatccttcatcaaatacatagctcttctcctaccattttgtttcttaataacaagtataccaaaattaaaccggttggttcaatttacgcaaatcgcgcaagtaagcagccgtttcatcattaataacgtgggccacgtcaacgtgaagcatcggcttgcggttgtcgtaccagacatccgttacaaccaatgccatatccgtatcagaggcactcactaaattttgatcttccgtataagcacgcaatgcattatttaacgcttgtcgcacaaccacgacttcttgtcgctccttatatggaatttcaaattcaaacgccatgacttcgtgcccccaaatgttagcaaccaacgtcgaagttgggcggttcattggaaaaatcaatagctcattcgataaatccttcaaagcaaccgccatcgcggcattcacaacttgttgcgaggcgataatttggcgttccgttaaccggcgcccgtaacgacgataaatcgtgactgcaatgacaccgagcaaaactatcagtccaatccatacaaacaacatcttacttacctcgtgagtcacggtaggccgtaatgatgcgtgaaagtttgtgtgcaataaactcgctttgcttactatccttttcagctggcgatgtcactcgcaatgaacggaatgtcgccgataatagaacaaagtcatggtaaagacgatccgttgacgttgcacgttcaggcaaatccgtatattgcgcggctaatgaaaaatcgttgtagttacgcacgaaatcttctaatgatgtcaccagcacaaaatgaccagcttgacgcttagtcaattcaactgccgacaaaccagcaatcatcgcttggagttccgcttcgtatgcagatgagatgcccgttgttaaggtggcaacctgttcagctggttcatcaacagccagcgttacataaccagcgataccgcgattcaaattaacgtcccatagcccgccaacgtaaatatacgttgccaaatcggctggtagcgtggctttcaaactgttggccaaagcaacttcttcaggcgtcgttgttggcacatatgcgcgtttgaattttcctttaacaccacgcacattgtcttttaatcgttgccagatgctttttgtcatcactgcaaacctccgtttcattaacttaagtgtaaccgaaatacgacaaaaaaacgactggttgcttatcgacgtcatatctcatacatccggtgtgaatatggtatttcatccgtatttctgataaacttacatataagattgttcggtacaagacagtaattaaaaaggagattaaccgattatgatttttaaggtttactaccaacctactatgaagcaaaacccaaagcgtgaaaacacgcaatcactatacattgacgctgttgatcaaccagctgctcgtttggctgttgaaacaaacacggactacaacgttgagttgattgagcaattgtcagaaaaggctttggcttacgagcaacaaagcccaaactttaagttgacggagttctaatctatggtaatgaatctggatgtacgtccagacgagacagccgtatacgcattgggtggacttggggagattggtaagaacacgtacggtattcaatatggcgatgaaatcatcgttgttgatgctggtgttaagttccctgaagacgaattgctaggaattgactatgttattcctgactatacctacctaaaggaaaaccgcgacaagattaaggctttggttatcacccacggtcacgaagaccacattggtgctatccacttcttcttgaacgcagttaacgttcctgtatatggcggacctctcgccttggcattgattaagaacaagttggatgaacacggcttgttaaacagtaccgaacttcacgaaatcgatgaagatactgttcttaagtttgacaacatgagtgttgagttcttccgcacaactcactcaatccctgatacgtttggtgtggctgttcacaccccttcaggtacaatcgtcgaaacaggtgactttaagttcgacctgacaccaacgactaagcagccacctaacctacaaaagatggcccgcatcggttctgaaggtgttttgctattgatgtctgactcaacaaacgctgaacgagatgaattttcaaagtcagagcgttgggttggtaagacgattgataagttgtttgatgaaattgatggtcgtattattttcgccacgttcgcctcaaacatgtcacgtgtgcaaatggcaactgaagctgcccttgcccacggtcgtaagattgctgtcttcggtcgttcaatggaaagtgccgttaccaacggtttggcacttggctacttgaacattccaaaggagatgttggttgatgcacacgaaatcaaccgcctcccacctaacgaagtgttgattttgtcaacgggttctcaaggtgaaccgatggccgctcttgcccgtatcgccaatggtacgcacaagcaaatttcaatccaaccggatgacactgttatcttctcaagttcaccaatccctggtaatacacaatctgttaaccgcgtgattaacgaacttgaagaagctggcgcaaatgttatctatggtaaggtgaacaacatccacacttctggtcacggtggccaagaagagcaaaagttgatgttgtcattgatcaagccaaagtacttcatgcctgtgcacggtgaataccgtatgcttaaggtgcacgaaggtttggcgcacgatgttggtgttcctaaggacaacacattcgtacttgataacggtgacgttcttgctttgacggctgactcagctcgtttggctgaccacttccctgctgaagacacttatgttgacggtaacggaattggggatgtcggttccgcagttttgcgtgaccgtcaaatgttgtcacaagatggtttagttgtcgttgttgcaacaatcgatttgaagaatcaagaaattacggccggtcctgatatcttgtcacgtggatttatttacatgcgtgaatctgaagaattgattaacgaaggtcgcaaggaaattttccacgctatcttgacagcaatgcgcgaaccaaatgcaagtgagcacagcattcgtaacgcagttgtatctcaactacaacgcttcttgtatgacaagacgaagcgccgcccacttatcttgccaatgtttattctaatctaaaaacgaaaacaccttcgtaactgcattaagcaagttacgaaggtgttttttagttcttctgtaagttttccaacaaatgttcgattagcgtcatatcagtcatatcagtttgacgtgattcaaccatttctactaatcgttgttccgttggtgtacgctcacccatggccttacgcttttcaaaagcgtacatcaccttgagcaacattttatccgatgttgagaccttatcgatatcaatcttaccacctagtagtgaaacactcgcacgtggcatgtaatcgtggacttggtcttccaagaactggattgtttccttatcttccggatctgtcatccccacaacgaagacccgttcaacaatatctggatcgaagacatgcgcaatttctggcaagcctgccaccgtacgtcggtaaattggcgcaaacacataaaccttttcaatccccggctcagcggccagtgctggacatttatgatagtcgcacaccggtaaatccaacgccgtcgcaaaatccttggcatatgcttcggtcgttccatattttgatgcataaataacaactgcattcgtctttgacataacgatatccccctactgttattttacttaagtgtaccgctgacatttgacttccatatgcgacaaaaaagaaaagcatcagcttattttttgtcgttgttgttcgtatttaattatttgctcacaatttgcataattgttggcaactcatttacttcataagttgcttgatatggcgtttcatttacttgttgatgaagatttacccaaagcgtgtccaaattgtaacgattaccaccttggatgtccgaagccaaaccatcgccaatcatgattgactcttcgcggtccatatcttgccggtgaccaaaaatcgcatcgaaaaattcagttgatggctttgcgtgaccgattgcatcagaaataaagacatcatcaaaatagcgcccaaagccggtatgttccagacgtaattcttgtgtgtgttgctcaccattcgtaccagcaattaatttgtacccttggttaacgagattcttcaacaaatcttccgcaccatccagcacaaaatagttttgattcagatactgacgatattctttctcaagcgcaataccatccacggcacggtcgaacgactcaaacaacttaccgaagcgcgtgttatgaatttgatccttattgatttcaccacgctcataggcagcccaaagtccacggttaatggtttggtaggttgcgaaggcttcatcaacttggttttctagaccatgatctcgaaaaatgttcatcaatcccacttgctcgccttttcggaaatctagcaatgtgtcatccaagtcgaaaattaggtgcttatacatgttttgcctcgcttctactagttatttaaactcagtataccaaaaaagcatcagtacaagaccaatgctttagaaaaaatattatagccaaaatggatacggacgtgttgtcaccatcaaatcataggcacgcgaaccaagttcttcaccatctgcatgcccaaattctaaacgtgatgtccggacacgaattgacgctgcggtaaagcgatgcacttctgaatagttgtaatgacgaccacgtactaattgaaccagcaaccacaaaattttcatgaaaaattgtgggcgctcgatcatgatcaagtcaattttaccgtcagttggatctgcgtctggcataattttcacaccgccaccgaaatacgggtgattagaaaccgtcaacaagtacccgcgcggcgtgtaaaacttacgaccgttggcaattatttcaactggaaaacgatcctgtcgtgacaaagcttcaatcaacgcgacaccataggttgctttaccaagcttcaatttattgaggatatttttaatgcgtgaattattggcaatttcaaccgtcgtcgcatcaaatccaatcccaacattattcaggaagaaacgacgttcacgtttaacggcatccatgtattcgccaatatcaattgattttggctcaccagcgtcaacttttgccaaaatcgtttgcatcatttctacaggcgtccctgtgataccgtgagcacgtgcaaaatcgtttcctgagcccgctgatatataagccaatgggatacttctttttgtatcaaaagcaagcaagccgttgataacttcatttagtgatccgtcaccaccgacaacaaccaattgtcgatcagccgaatcttcatatttggcatattgatatgcccatttacgcaattctcctggagctgttgatagacggctatcaaatgccactccggtacttttcaagaattgctcaacctctccccagacaaccatggattttccagaacgcgctgccggattgacaaaaaacgtgtaatgcatcttttttgccatctctctttctttttgtcattaattagtatacaaaaataaatacacctcgtcagcctaaatagtgtaccggtcacaaaatggtcgatttttatgcatataaaaaaccagaaccactacagttctggttacaatcattatttaacgccccagtatgtttccttgtaggcgtcacgcgcttgtttttcttctgcgtagacatcggcatgtttcttatagaagtcttggtgatattcctcagcttcccagaaagtcgttgcctcttcaatcgttgtgacaatagcatcatccccaaaaatacctgatgcctgcagttgtgctttcgacgcttcagcaactgcccgttgttcatctgaattaacgaaaattactggtcgataattgtcaccacggtcttggaattgtcccatcgcatctgttggatccgcagtttgccagtacagcgcgaccaggtcatcataggacaccacttcatcatcaaaccaaattttgactgcctcagtatgcccagtttcatgggctttaacttcttcgtatgttggattgtctttaaacccacccgtatcacccgaccggaccagcttgatgcccggtaaagtttcaaatggttgcaccatgcaccaaaaacatccgccagcgaaaattgctgtttgctctgccataataaatccccctaatttttaatgcattacttcaacttgatgtcccaagcagcaatttcagctgaaccatatagttgcttcatgtgcttcttagttgattcagtttggtaagcctttacaacttgcttgtaaatcttcttgttttgcgttcccttacgtgctgcaataatgttgatgtagcccttgttagccttgttaactggctcgacgtacaacgccttgtcgatgtccaacttagcatccagagcatagttagtgttcacaaccgcagcgtcagcactcttcaaagcagatgctgcttgatcagatgcgacttctttaatcttgaaatctttcttgttctcagtaatatcctgcgcgcttggcaatttcacgtcgtggttgtacttaatcaaaccggctgcttcaagcacatccaatgcgcgcttttcgtttgaagggtcgtttggcacgacaattgtaccgccctttggcaaatcagccaaagtcttgtggttatctgaataaatgcgaattggtgtcacgtaggtcttaccgacgcttaccaacttacccttaaaattcttgttctggacatcgaagtaattaattgtttggaaggcattcaaatcgattgacttgtcgactaatgcttggtttggcttgatatagtccgtgaacaactttagcttaatatcaatgccgtacttcttagctgcatctttcttaacgtattcccacaattgacggtcagagtcacccaccaaaccaaccgttaccgtcttttcctttgaagctgcagacacatcatgtggttgattagcaaataccgccaatcctgccactgcaacaaccgttcctaatacaacctgcttctttgaaattcccattttcatatcctccataaacctcagctttaaacaaaaaagcccgtttctatacatcaccctacaaaagggctagatatagaaacggacttaccgtgataccattctactttcatcatgccagtcacccgacatgaactcacaacgtgcagacagggagcgagatgatgctgtgtcgatacgcgtgtctggtaacggagaccaatccgtgtggtatttacagacttgctgctcatgccacccaatcacaggccattttcatcatcaattcgcacgtaccgtcacaccgacccgatactctctagactttgaatcaatcattactttcctgatcactttgtttttaactgtcgttttttctttatgagcattatattagcgttttctcattttaatgtcaacgcttttttagaattaattttcattaaccgctttcaacgcagtcgcaccaacgaaattaaccggttgcgtgaagtttggttggaagaagaaatcggccatcgccaggtcatcaatcgtcattttgttttgaatagctagtgacacaacgttcgctgcctgagaaatgtcatgttctgacataaaggccgctcctagtacacgacgtgtcgccttatcccacgtcagcgttgataagaccttagttgttgaaagcatgaaatcaggtcggtaatcttcctcataaacggtttcttccacttcaatgccacgcgctgccgcactcgctttattcaagccggttcccgccattgcaaagccgtaaagttcaactgccgacgtaccttgtgtccctgtgtacgccaagttatgaccatcaatattacgggcaactaacataccttggcgaatggcattggttgctaatggaatgtaatcgactgcctcggttgggttatagaagaccgtcgtggcatccccagctgcatatacatcaggaacactcgtttccatatattcgttggtcttaatggcgccgtttggtaacatctcaacttggcctcggaacaaatccgtattcggcaggaacccgataccaagcacagcgatatcagcttcgtacgcgcccttgtccgtcacaacccggatgccaccatctggcaactcttcaaacgctgccacgcgttgtcccaacgccaacgttacaccgtgttcaacaaacgccgcttcaagacggtctgtcataaccggactaaagtttttcggcaacacacggtcaagaccatcaaccaatgtcacttccttaccggtcactgagaattgttccgcaatttcagcaccaatgtagccagcaccgataacaacaacgcgcttcaacccatcagcaacatctttaatccggttagcatcttcccatgacttcgcgtaataaacacgatcactgtgaatacctggaatatttggtactaaaggctttgatcccgtcgtaatcacaatcttgtcgaacgtctcagttgtgatttcatccgtcaccaggttcttcgcacgaatttgcttgatattcaaatcagcttcaaccacttggtgttgcatcttcatcgtaatgccttgagccgtcattgactctggtgattcataaaacatacgttgctcgtctgacacgtggtttcctagccaaagtgcgataccacatgacaaaaatgaaaccgtcgtatgttgctcataaaccgtaatatctgcatctgggtgcagcttcttgatttgcgtggcagaaaacgtgcctgcgtgtgtactaccgataattgcaattttcatgttatgattccccttattttgctttcccttgtgcatttgcaaaccagccattaaacaataacttcacaataggtcgcgaccccgttgtttcgcaaaagaaacacccacatgttccttttaacggcttattatcgtccgataattaggtattgcacaaacttatagtaacaaacttcacaaaatagtcaaacctttttcgaaaaagaaattcaaaaaaacgtccgagatttctctcggacgctcttattaatgctatttacttaaaccagctatcaacctgcttttggtgagcagcaatccaatccttggctgccgtctcaggtgacttgccgttttggatggctaacatgactgactccatgtcttgctcatcccacttaaacttatctaacacccggtaggcctttggcttatctgccttaagacccttgcgcgtgaacgtattgattgattctgacttaccaaatgaccccttcggatcagacaagtacttcaaatcatacttttggaacatccagtgcggtgtccaacccgtcacgacgatatcttgcttagccttaatcgccttaccaagtgccacagtcatggcacctgatgatgacggcgttagcttccagccattgttggtcaaaccatagtcagccatcgccttttcagtggcgttggtaacacccgcaccaggctcgatacctgttaccgtcttattggcttgtgtcgttaaatcactaatgctatcaacatccatgtacgctggcacaaccaaaccagttttagcaccggtcaagtttgggcctagcatgtcaatttgtgacttgtatttcttatattgtgcagcgtgcgtattaggcaaccaagcagacactgatgcatccgcttgaccattagcaactgactgccacatgattgaattatcaagtggcgtcaaattaacgctataaccgtgttgacgcattgcttcagccaacacgttacttgatgcaacttctgagtcccattgcacatacaccaagttcaatgtatcttcagccttcttaccattggcaaaggtgttcacaacacctgaaccgaccatcgccacagcgactacaatcgccgtccacatcttccagtggtgctttgaggttggttgcttgtcagccggcttgacgttcaatttttgcgtgaagcgatcaatgatgatggccaagataaccaaagccaaaccattcacgaatcccttaccaacatccgcgttttgtacggccgacaagacaccacgaccaagtcctggcgcaccaatcattgacgcaatcacaaccattgacaaggccaacataatcgtttggttcacaccggccaaaatcgtgtttgttgccaatggtaattcaagcttaaacagcttttgcttaggcgttgatccataagaatctgccgcttcaaccaaatcctttggcacttggcgaatacccaagttagacattcgaacagttggtggtaacgcaaaaatcacggaagcgaaaacaccaggaaccaccccgataccaaagaaagcaaccgctggaatcaaataaacgaaaccaggcatggtttgcataaagtccaaaaccggttgaacaatcttagcaaccgtttccttcttggccatccagatacctaatggcacaccaataatgattgagaccaaactagacaccaagaccaacgtaaaggtgctcatcaaatctgaccacaaattttggttggcaatcaggagcaagcctaagaaggtaaacaacgggaagccccacttcttgccacacactagtatggcaaatactgtcaagccgatgataaccatccagcttggcatagccgttaagccgttagtaatgccgttcatcaggtgagtaccaccatcctgaatgacattaaagaacccactcaaagtggttgttaaccaatttacggctgactcaacccaatttgcaattggtaatttacttattaacactgtattcatcggttattgcacctccgtttcagacaacgcttctaggacacgaccacgaatgataacgcccagcaaacgcccgttgtcaaccactgccagtggtgtcggtgcgtcataaatcaatggcatgatgtcggcgaccaacatatcacgggcaaccgttggcatttcagtcatcacatcacgcaacccgatgttttcgcgacgagcacgtaaagcatcttcactgctaatgaacccctggaattggcgacgacgatcgacggcaaccaacccactcacttcttcggtacgcatcttcttcaaagccactgccggaccatcaacgtcaatattagtggtaattggtggaatcataatacgttctgccgttagcacctttgaacggtcgacatcttcgataaacgcacggacataatcgttagccggtgccgtcaaaatttcctctccagtaccgacttgttgaatttgcccatccttcataatggcaatacgatcaccaatacgtagggcctcgttcaagtcgtgggaaataaagataattgtttgactagcattcgcttgcaaatccaacaattcatcttgcatatcacgacgaatcaacgggtcaagtgctgagaaagcctcatccatcaataagatttcagggttattagccaacgcacgggccaagccgacacgttgctgcatcccacctgacaattgatttggatattggtccttaaacgccaacaaattggcattatcgagtgccttttcagcacgttcgcgacgttcttcctttggcacaccttgcacctcaagaccatactccgtgttctctagaattgtacggtgtgggaacaagccaaaactttgaaagaccatactcattttcttgcgtcgcacttccaacaattgttcctttgacattgttgagatgtcttcaccatcaatcttaattgaccctgacgtgggctcaattaaacgattcaacaatcgaataagcgttgacttacccgatcctgataatcccatgatgacaaaaatttctccttcttcgatggacaagttcgcgtcatagactccaactgtcgcacccgtctttttcaagatttctgttttagacgcttgttgctgaaccatttgcaaggccggcttaacgcgttttccaaaaatcttggtaagatgttcaatttccaccttagccatatcttcatattcctcctacttgatcgaatttctctcactttcgataagtgacaaccctattttaaacacgaagttgtcacttgcgtcaaatttgtttatgtagaccagcgtgtaccaaaaacgggacacaccccaatttgataggcttacaagtaggtctaccaattatttatgtcaggctctgattaacgtattattagtgaatatgatatgcttatcttaattacgtattctagatttggagggatatcatggccggactaaagcagcctcgctatcgggtgattgcattacgcatcgctgaacaaattagcgctaaccaactcaaggtcggtgaaaaaattcacgcccgttcaactttggccacgacatatggtgtgtcgtccgaaacggcccggcgtgctattagtgtgcttggtgacctaggcattgttgaagccatgcatggcagtggcgctaaggttgtttcccgccagaaggcccgaaagttcgtcgagagcgaaacagaggttaatgggttacaagacctgcaaatctctcttacagagcaaattaaggcccaacaagccggtttagatgccttgagtaaagatttacagcactttgttgatcaatcacagcattatcagcagcacaacccgttaaccccctttgaattagagctcaccgagccgtcaattttattcgataagtctttgagtgaactgaatttttggcaccaaaccggcaccactttggttggtatcgcccacgaagagaagttagttatctctcctggcccttacgccaaaattcatcaaggcgacacgttgtattttgttggggatgaaaacagcgtgcagaacgtctataacttcttttacagcaattaaaaagacgagcaagaactaaattcttgctcgtcttttgttttactattaattatgcgttgaacgtgtcagtaagtggtggaaccacttgcttcttacgtgaaacaacacctggcaatgaagcacggccatcagccaacttcacgtcgaaggctgcttcaaccttgtccaagttgtcacccaagaccaagatatctgaatctgaatccaagatgttcgttacaacaaagacaaatgtgttatagcgttcttcagccaattcagcttccattgcggcaacaacttcatcacgacgtgagaagacatcttcaacgtcaaccgtgttaacttgaccgatgcgaaccgttgcaccattcaattcgaatgactttgcgtcgccgtcgatcaattccttagctgaacgtgatgacaagtcagtaccggccttcaacatttccaaaccgtatgcttcgtagtcttccaaaccagcaatctttgccaaagcttccaaagcaggcttgtccattggcgtcgtcgttgggctcttcaacaacaaagtgtcagagatgatagctgatgccatcataccagcgatttctgcaggaatttcaacgttaagcgtttggaattcgtagtacaaaacagttgctacagaaccccaaggcttgttaaggaagtacaaaggtgcagctgatgagaagttaatcttgtggtgatcgtatacaccgtaaacagttacgtcagcaatgttagcaactgattgtgcggcctcgttgtggtcaaccaagacaacttcttcagtgtcagctgactcgattacgcgaggagcgtcaaccttgaagtagttcaatgcgaattgcgtttctgcgttaggcgtacccaaagccactgcttcagtgtcttggttgtatgccttgttcaacaagtatgacgcagcgaatgctgaagcaatcgtgtctgtgtcagggttttggtgtccgaaaaccaacatcttagccatcagataaatctccaatttctttttgttatttcaatgtattaactatacaacatttttaaggtgtaggcacgtaaattggtaaaaaagtattggttatatcaaaaaaacacaccgtcagcacagtgctaacagtgtgtttaataattaattcaaaaccaatggttgcacataagcgtgcatgcgaactggcgtaccagctgcttcgacatcaatgataaagctaccattactgtaacgctgtcccattgggtgatcctttggtgaaatatcgaattgcttatcacgatccgtcatcaccgttaatggtgttggttcatgtacatcaacaaccatcatcgctgcaatgcgatgtggatccttcttcaactcacgcataatcgcaacacccttgcgaccgcgactggttgctgaaatttcagtaaccggcatccacttgaatgcaccgcggtttgaaacaaccgcaatcgcttgcttatcagttgcaacggccatcttaaccacacgatcacccgcttcaaggttcattgccttaacaccagccgtacgattaccagtcgttggcacttcgtcgagtgagtaacgtagtcccatggcattttctgaagccagcacaaccgacttgcccactagcttcttatcgtcaatcaattccaagccgacaacggttgcgtcgtcactcttcaacttgattaacatggttgccttcttcttgtacgtgctacgtggcgccaaatcagcgaacggcgtacgcttaatcaaaccatcgcttgttgccacgacccattcaccagccatgttatcaacagatgacataatgcgcacatcaatcacaacttcatcattggccaagccagtaattgtttgtgacaagtgctcaccagcgtccttccacttaaattctggcaactcgtggactggacgataaatcacattacccttgttcgtgaagataaacgcatgttgtagcgtattcaccttttcaacaaagactggttcgtcatcatcacgcaaaccgttttcatcaccagatgccgtgtaagaacgcactgaggcacgcttcacgtaaccagcgcgtgaaaccaacatcacaacgtcttcatcagcaaccgtaacagtttggtcaatcttaagctcttgtacttcagcctcaattgacgtgcggcgtggcgtgttgtattccttcttgatggcttgcaattcagccttcaagaccttacgcaacgccttagggtctgacaaaatttcgttgtagttcgcaatcttgttagccaagtcttcaaactcagcttgcaattgcgtcacgtcggtattcgtcaaacggtacaattgcaacatcacaatggcttcagcttgaggctcagtgaagtcatagctatcaatcaaattttgcttagcgtccttacgatccttagaaccgcgaattgtggcaatcacttcatccaagattgaaagggccttaatcaaaccagtcacaatgtgttggcgatcttgtgctttcttcaaatcgaattgggtacgcttcgtaataatttcaacttggtgctccaagaaggcttccaaagccgtcttcaagccaacacgctcagggcgttggttgtgaatggcaaccatgttgaagttatacgtcacttgcaagtctgtcttcttgaacaagtaagccaaaataccttctgcattagcatccttgttcaactcgatagcaattgacaaaccttcacggtcagattcatcacgcacttcagtgataccggccacatccttgttcaaacggatttcatcaatcttcttaaccaaggcagccttgttcacttcgtacggaatctctgaaatctcaatttgagacttgccacccttcaatggcttaatttcggtctttgaacgcacaataatgcgaccacgaccgttttcataagctgatcgaataccatcagcgccttggataataccacccgttgggaaatcaggtcccacaacgaattgcatcaaatcatccaaagacgccttagggtgcgcgagcaagtaaaccaaagcatcgattacttcacccaagttgtgcggtggaatatccgtcgcataaccggctgagattcccgttgccccgtttaccagcagatttgggaagtgagctggcaaaacagttggctcgtactccgtatcatcgaagttaagtaccatctcaaccgtgtctttttccaaatcgcgtagcatttcaccggcaagctttgacaaacgtgcctcggtgtaacgcattgcggcaggcggatcattatcaattgatccattgtttccgtgcatttcaattagtggtgcacgcaacttccagtcttgtgacatacgcacaagagcctcataaattgatgagtcaccgtgcgggtggaaattacccatgacgtttccgacagacttagcagacttacggaactgcttgtcataggtatttccatctttgttcatcgcatacaaaatacgacgttgtacgggcttcaaaccgtcacggatgtcaggcaaagcacgttcttgaatgatgtactttgagtagcgaccaaatcggtcacccatcaccgcttctaggctgagctcttgaatgtttcctacttcaaccattcagtttcaaatcccttctagtcttgccaagtctcaatgactggcgcaacaaaatcatcttcagcctctgctgtctcagcaacatctgcatcatcttctagcagcgtgtttccttcttcagccaaggtaaaggcaacattggcttcaatccacttacgacgtggttcaaccttatcacccatcaacgttgttacgcgcttttcagccaacatagcatcgtcaattgtgacacgaattagtgtacgttgggcaggatccattgtcgttgcccaaagttgctcggcgttcatttcaccaagtcccttgaatcgttgcaatgtgtatccgcggccaatcttcttttccgcttcagccaattgtgaatccgtccaagcgtattcaattgactgcttcttaccagttcccttacgcaacatgtatagcggtggcaaggcaatataaaccttaccagcgtcaatcaatgggcgcatgtacttgtagaagaacgtcaacaaaagcgtttgaatgtgtgcaccgtcatcgtccgcgtcagtcatgataataaccttatcgtaattagcgtcatcaacgttaaactcaggtccaaccccagcaccaatcgtatagatgatggttgagatttcttcgttcttcataatgtcagccaacttggccttttccgtgttcaagaccttaccacgcaatggcaaaatagcttggaacttacggtcacgtccttgcttagctgaaccaccggctgagtcaccctcaaccaggaacaattcattttgggcagcattcttagattgggcaggcgttagcttacctgatagcaagcgttccgtcttgcccttcttcttacctgaacgggcttcttcacgagccttacgggcagcctcacgtgcttcacgggcacgcaacgccttacgaatcaagctttgtgagaattcaccattctccatcaagtagaaaccaagttgttcagaaacaaccccatccacgattgaacgggcttcaggtgttcccaacttgtccttggtttgaccttcgaattgcaacagctcttctggaatacgcaaagaaataaccgctgaaagaccttcacggacgtcagaaccttctagattcttgtctttatccttcaacaagttaaccttgcgagcgtattcattaaacgcctttgtccaggctgaacgcaaaccagcttcgtgagtaccaccatctggcgtgcgcacattgttgacaaatgacatcgtcgtttctgaataaccgtcattgtattgggcagcaacttcaacctcgacaccttgggcaaacccatcaaagtacatgatgtcgcctagtgtgtctttgtcctcgttcaggtagctaacgaacgccttaataccttctgggtagtggtattcttcagaacgttcttgaccagcgcgctcatccgtcaaggtaatcttgacatcacgcaacaaaaaggctgattcgcgcaaacgttcggccaatacgtcgaagttatagattgtcgttgaaaaaattgcaggatctggcttaaacgtcaccgttgtaccgtttgattcctttgttttccccaacttgttcaacgtaccgtcaggatgaccaccgttaataaagtgctcttggtacttttgaccgtcacgtacgatggtaactgttaggctcgttgacaaggcgttaacaactgaagatccaacaccgtgcaagccaccagatgtcttgtaaccaccttgaccaaactttccaccagcgtgtagcactgtcaaaatgacttcgggggttggctttcctgaagcgtgcattccgacgggcataccacgaccgtgatcgacaaccgtaatcgcgttgtcggcatgaatcgtcacgttaatttcatcaccaaacccagccaatgcttcatcgactgcgttgtcaaaaatttcataaactaagtggtgcaagcctttgccatcagttgaaccgatgtacattcctggtcgcttgcgaaccgcctccaatccttcaaggactgtaatggaatcatccgaataagtattcttgtttgccatggacgcttcccttcttgcttttttaatctgtcgtcttacgtgaaaaatttctttttcaaagcgttccgttcttcataatagcccaacaaaggctctagttgcaatagtgttaaataaatttaaaggtaactggtgtttcaatcgtggtaatatattaactgttctgttatttgaaacagatagcaattattctatttaatactattttataaggagtattcatcttgacgatttttcattttgtcataagttttttgttggcctacttttttggatcaatgccattcggttattggattggcatgttgttctataagaagaacatcctaaagcttggctcaggaaacatcggcacaaccaacactttccgtgtgttgggtacccgtgctggtgtcgccgtactactacttgatatcttcaagggatcagttggtgccctaatggcgtacatctggggaccggcgcccgcttggacagttatggttgtcggtcttggcgccatcctcggtcacaccttctcaatgtggattggcttcaagggcggtaaggccgttgcaacctcaatgggtgtgctattgatgtacaacccaacgatgtttgtaattgcgtttgcgattttcctaaccgttatcttgctaaccagtatggtatcaatggcttcaatgattgggttcaccctggttacgttgctatcaatcttttggttgcacgattggttgttatcaattatcgccttcgcgttgacgattttcgtcttctaccgtcaccgtgaaaacattgtccgtattaaaaacggcacagaatcaatggttcactggggccttggttactggcgcagccaatcaaaaaactaaccacaactattcaacacaagcacagctacaactcgtagttgtgctttttattatgcaccctgtgtcaatatcataataaaaagccctgctatcaaatagcaaggccaaataaattgctaattagaaaaatgttagtgagtatgaacccgtgaatgtttgggctggtgcaagtgtattaataccaaatttgtgacgcaactcaccgtcggcatcaactgtgtccgcaattccccaccatggctcaatcgccacaaaaggtgcttccttggcatatggcgtccaaataccaacatacttggcgttttggatgtgcatcgtcaccccgtgtgattcgttcaactttgccaaaacgattgaaacgggattttgatccaagcgcaagataattgcgtcatccttgtagtcatcacgacgcaaacgcaacggaatacgtgagtcaaacgttgattccaagttattgtccaagtatggaccaaccagctttgcacgttgatacttacgttgtggctcaacattgatgtagtaatccgtgaacttttcaccctcttcaagtggggcccggaagccggggtgtccaccaaccgagaagtagatatcatgcgtgtccgtgttcgttacaacgtacgcaattccaagcgtatcttgctctgttagacggtacaaaacgtcaaattggaagtggaatggatagattgaaaatgattcgtcattatcaacaagtcggaagcgggccgttgtagcagtcttttcaaccaaatcgaattcattatcgcgggcaaatccgtgttgcgccataaagtacgtcttgtcacgatacttgtaacggtcaccacgaaggcggccaacaaccgggaacaaattaggtgcgtgacgaccccagaaattaggatccgccgtccacatatattccaaaccactttccttgttcgtaacgctcgttaattcagctcccatttctgaaataacgaccgtaatattatcattctctaacttgactgacatgccactctgcctcctgtaagcgttttccaatatgtcaattataacaaattcgagcatgcttttctattcaagaaccatgaaaaatgtatgcaaaaaaagaggcttacctgtgtaagcctctttttcaattactcagttgcacgtgggaaaaagtcacgataacttttctgcaacgcatccgttgtaacgtgagtatagatttgcgtggtgctcagactgctgtgaccgagcaattgttggacggtacgcaagtcagccccgttattcaataaatcagtggcaaacgtatgccggaacatgtgcgccgacacaacctgtgtcagccccgcttttttggcgagctgtttcaggatatactcaatcccactcgtcgtcagtgcttgtccgcgttggttcacgaataaggtatcgtgtagcgtgtctgattttgccagtaaggctggccgggcatcggttaaataaatcgccaatgcatcagccgcatattgaccatacggcacaatacgcgtcttatttcccttaccagtaatcgtgataatacgagcttgttggtcaatcatccccaacgtcagccctgcaacctcagaaacacgcgccccggtaccatacaaaatttcaagtaacaaacggtttcgtatgcctaagagactggtgtcccccatcacaacttcgaacagcttgttcaactctttttcgtaaaaataacgtggcaagtggcgccccgccttcttcagttgtacaccagcaaatggattactggccacaaattcgttgcgttccaagaactgataaaaggcacgcagcgaactcaccttacgggcaattgtccgactcacatcacccttttcataaagagctgataagtaaacgcgtacatcatattgatcaacggctgtaatatcaaccgttttctgatctccggtctcaattaagaagcgttcaaactcattaatatctgatcggtaagctttttgggtgtcatctgaatactggcgttcaacacgtaagtagtccaaaaacaacccggttaatttcgccgtatctgccatccttatgccttctcagtttcttgcttctcagccttgtctgaagcttcttcgtcatcctttggcgttgtaccatcggcacgtgtcttttcagttggcttgtcccatgacacaaagtcacagtctgggtaacgtgagcaaccgtagaacgtacggccacgcttggtcttgcgttcaacgatttgtccgataccacacttagggcaacctagaccgatttcttcaacaatcgtttgcgtgttacgacaatcagggaagcgtgaacaagcgtagaacttaccatagcgccccatcttttcaagcatcggtgcgccacagacatcacagttaaagccagccaagcggtccttcaagacaatcttttccatctcaacttcagccttttcaagctcttgtgagaatggcttaaagaagtcatcaatgaccttcacccagttttccttaccgttttcaacgttgtccaaatcggtttcaacttgggcggtaaacttgatgttcgtgacatcagggaagaattcttgcaccgtattttggactaattcacccaattcagttggcacaaacttcttcgcatcaatacgaacgtaaccacgcttttgaatcgtttcgattgtagcagcatacgttgatggacgaccaacaccattctcttccagcgccttaaccaaagcagcttcggtgtaacgggcaggtggttgcgtaaagtgttgttctggtgacgtctttgccatttggaccaggtcacctactgctagttcaggcaacttgttatccttctccttggcagctgggtaagccttagtaaatccagcaaacttagtctttgaaccattcgcacggaacatcacaccgttttgctcaatggtaacagccatcgtgtctaagatttctggcgtcatttgactagccacaaaacgtgaccaaatcaattggtacaacttgaattgatcattcgtcaacttatccttgattgaagctggtgtgcggaagacagatgttggacgaattgcttcgtgggcgtcttgcgcaccttcctgctgcttaccttgtaccggcttagttgccgcatactcagcaccgtattcttcatggataaatgttgaagcgtcagccttggcgatttcagaaatacgcgttgaatcagtacgcatatacgtaatcaatccgacactaccttctttaccacccaagttgataccttcgtacaattgttgcgcagccatcattgtcttacgcgtacggaagtttaattgtgtgttcgccgtttgttgcattgttgatgttgtaaaggccggttgtgggttacgcttgcgttcctttgcctcaaccttcgtgatatcaaagtcacccttttgatcaaggcgcttcatgacatcttggacagcatcattgtctggcaattcagtcttcttgccatcgacaccgtaaaagacagccttaaacttcgtcttatccttcttgaattctgaatccagcgtccagtattcttctggttggaaggcttgaatttcgttctcacgagcaataaccagtcccaacgcaacggattgcacacgtccagctgacaagcccttcttaactttcttccacaagattggtgaaatagaatatcccaccaaacgatcaaggacacgacgtgcttgttgtgcatcaaccaaatccatattgatctttcgtggttgcttgaaggcatccttaacagcatccttggtaatttcattgaagacaacacggttttcgccggcgtctaagtccaaatcaagaatgtgtgacaagtgccaagcaatcgcttcaccctcacgatccgggtcggatgcgaggtaaacgtgcttagctgccttggcttctttctttaagcccttaattacatcacccttaccgcggatgttaatgtacttaggctcataattattttcaatgtcgacacccatcgttgactttggcaagtcgcggatgtgaccaatacttgcaacgaccttataagaacttcccaagtacttttcaatcgtcttggcctttgatggtgactcaacgataactaggttcttctttggcttagccttagacttggtctttgaagccgtcgcacgcttcttcgctggctttttttcagttgtttctgccatatgcgtggacctctttctttcaaatttattgttttctactatatatagtaagtattatgctttaacaattatgtactatacactaccagtctagactttgacaaataacagccgtttcgtatgtgcaccatttaacaaattcagaaggaattgttgataatatctgcgggtgttaatgccggtattgcaccggctgcaattaacgcatttgtaccgcctgaaagcatcgtatcaattcggcctggtactgcataaatatcccgatttgcagctaacgccagattggccgtgataagtgaaccggagcgattttttgcttccacaaccaggcatgccgcacaaagtcctgcgataatccgattgcgttctggaaactgatgtttagccggtccgacccagggtaaatactccgacacaaccacgcctgattcaacgacttggctttgtaagccgtcgcgacgacgcggatacgcaacctcgaggcccgtcccaatgacaccaaccgtcgcgccatgctgcgcaagcgtttcacgatgcacagcttcatcgataccagtcgctaacccagatatcgtaataatgccagcgtccacaaaagctggcacaaaacctttaacaatttgttccccatacgatgacatttcacgggtgccgacaatcgcgacacccggatagcgggcaaataaaaaattcccttgataaaacaaaaccactggtgggcaatcaatttcagctaaccaagttgggtattcgtcgtcagcaatcgtgacgtaatgggtcgttttaagtttttcgaactgctgtgtcgcaacatctgattggcaaaaaacacgactgctagcacgctgttgttgtggcacacctgccaattggtgcacctcttggatcgacaactcgtttaagccatgcaccaccatgtactcccacacccgcgttctaccaacaatcccaactcctgggacaagtaataaccataataaaaaatcacgttgtttcatagcaccctcctagtaagaaagagttgcaacaacgtgatttttccatttttagtctaaataatttttaaccggcgcaaacgttttacggtgaattggggtcactccgtgcgttgccaagccagccaagtgttcagccgtaccatagccagcattatgttcaaagccgtaaccagggtaatcgaccgcgtaggccgccatcaattcatcacgaaagttcttcgcgagaatcgaagccgccccaatcgaaatactgcggtcatcccctttaatcagcttttcttgtggcaacggcaaatcaactgtcatcgcatcaatcaacaacccgtcaacttgtactgataggttttcaatagcttgcttcatcgccacgcgtgatgcctcatagatgttgatctcatcaatttgatcagcatcaacaaccccgaacgcgtaagccacaaccttatctttaatatcttgatcaagtgccagacgcgccttttcagacaactgctttgaatcatgaactgcaattaaatcgaatgaatcgtcaatcaccgcagctgctgcgacaaccggcccggctaatggtccacgaccgacttcatcaacccccgccaaaacaagaccattctgccaagcgtcacgttcaaatgttagtcgctccgaaaaagccttggcttgttcagcctgtttggccaatcgtttgtcataactagctaacagtttctggaccccagtccgttcgtctgtacgccaaatagccaactgttcgggcgtcacatcgccttgcaacgccgtcttaatagtcgcgatggtttcaggcttggtcatcttgtacaactccgatgttgtcctcaggcatttcaaccgtgtattcacccaacttaccacgacgcaaatcaatcaacaaacgttctgacgcacggtcgtaatcgtccttgaagccaagcttttgcgtgattagcaacaataactcaacgtctgtattattctcccaagcgtcttctggcaagtgataacgagcaataatagcagttgggttatactcacgcatgaactttaacgttgccaaggcaatatcgtcttggttaatcaattgatccttgatggcacccgtcattgccaagtgttcaccaacacgttggtcctcaaactttggccaaagcacacctggtgtgtccaatagctccaagtttgttggtgtcttcaaccattgcaacttcttcgtgacacctggacggtcaccagtaatggcaacattcttcgttaccaagtggttcaaaagcgttgacttaccaacgtttggaataccagcaaccaacgcacggattggcttgtccttaacacccttttcttctagggcagcccacttgtcagccaacaccttacgggcagccttcgtcatgatttgtggcgtcttgtgaccacgtgtgtccaaggccacaacttccatcccctgagcctcgaagtacttcttccaagccttcgtgcgttctgggtcagccaagtcagtcttcgtcataaccaacaaacgtggcttttgtcccaaaacctcgtctagttctgggttacgtgatgaaactggaatgcgggcatcaaccaattcgaacacgatatcaacatactttaaattttcgcgcattaggcgaaaggctttggccatgtgaccagggaaccattggataatttgagccataatgttcttcctttcggtactttatgtatgacggcattaaccgccttaatcttctgaagctaagtagcgcgtccacgcttcgtcaaacactgacatgctgtgtaggtaagacgcgttttcttctaagtagcgtgacaattcatcaaagtcttctgcttgcttaggaaattgttggtcgtaaaaagccgcattcgcaaacgtctgaacttcatcaaaggtcatcggattacgttgggtcatcaaccatgaaaaaaatgggcgtcgcattatttgctatatcctccacggaataaaaacttgtccttagctggatcaatcgtcaccgctttcacgcgcataccctgcactttcggcgcttttccaagatcaatcaaaatcgtttgttctgatgtgtcgatggtcaaccactttggtaaatcgaccatgttaccaagataccccataacatacttaacaggcaatggtaactggccaactgccactgacttggcgtgtagcaaaataccgccattcttagtcacttcaggcaccatcttcataccaaaatcaacgttttgccccaggagcttgtacgtaccatacaccatcatcccagactttgtcatctcaaaacggaatttgtctttcaatgccggatcgttatttaggtactgctcaacaagggcgttcagttctttacgatcaaccgcaactgtaaatgacgcttggccaatttgtggctttgtatcagtcacctcagttcgatcttgtggtaacagaatcagcacaatcaccagtgccaccaaagcaaccaatgtgataccaattccagtgataattccttggacacgctcacgagatggcattaccactccgaagcgtgtcactttacgtggttccatactacttctccaaccaatcttcagtgtgctttgccattctcttcaccagcaatgcactcattttgtcatatcctttatcatttggatgatagtgatcaagcgttgtaatataatcattcaactctttatcactcttgccattcaatgtatccgtgaccatctcattatccagtgagccacgatttgctttttccgcctcggtaactaactttttacgggcagctggtgtttggtattgaccaaacgttagtgtattaaatgttgacacataatacacacgatcatcaaccgaagctaaattagcattaatgccattataaattttgacatcctcattcaaatcagaacgattagccagataaacatatagtgggttgtaattcccgaataagaatatgggcgcgtcaggatttttcttttcgagataattgatgagtgtcgttaagttttcagtgtagtccggcatactagctgtgaccttatccgtgactgatcgctcggacttcgcaaaaatcgctttaaacagcgtttgttgcaaatcattaccgccaaccgtcatgactaacacatcggcggatttaatgtctgaaacagcctgtttattctttttaacacgcttcaatatttgatctgagcgatcaccagctttaccatagttagccgtcttaactttaacatcatacttatctgccaacaatttcgccgtgcgcttggtgtaaccttgttgcttcgtggtgtcacccacgccttctgtcaaggaatcaccaaccgccaccaatttaatggtttgcttgttagcagcataagccggcacgctggtactcaaagttccgaaccctgtcactaacaaaaatgtcgcgaccatcactttaaatttgcgttgcacgctgctcacctccttaacaaagctccgacttactattttaccatagaaaaagcgttccgcccggggacgaaacgccatttttttgctactttacttggtaactgaaaccaattgcgccagcaccagtgtgcgttgacacagttggtgacgtttgttgcacaacaatcttgatatctgggaagatttcgttaaccttatcagccaattcttgtgcctcggccggaataccagcatgagaaataccaattgcttcgataccgtttggtgcagcttgcatttgctcaacaatgctcttcaagtaggcacgcgttgacttagcaccacgccccttaacttcaacattgatgttaccttgctcaatgtgggcaccaatcttgatgttcaaaacaccagcaatgaagccagccgtctttgacaaacgaccacctgcaaccaagttatcaaggttagacactgtcaaatacaattgcgtgttatcgtgaacgcgcttgatttctgccaagatttcttcctttgaagcgccttcagcggccatcttagcagctgccagcacttggaaaccaagggcacgatcgataaagtctgaatcaaggaccgtgatgtcaccatcgaccatcatggcagcttgacgagcagcgtcagccgtacctgacaatcccttcgtcaagtgaatcgaaatgatttgcacatcatctccgaccaatgactcataaacttctgtaaagacacccaatgaaggttgtgacgtttgtggcaaattctcagccgccgccatcttatccatgaattcaaccggtgacaatgtcacaccatcttggtagaccgtgccatcaatcataattcccaaaggaactacctttacatcgtattgtgaaacttcttctgccgtcaacattgctgttgagtcagtgacaattttaacttgggccatgttcttaattccccgtttttgtaagtaatttaatgatacctcattatctcattttaaagttgataattcaaggttctcaagtggcaaaacatgttatctagtgttatgaactagatacaaaaggcagctgtcgattaatgacaactgccgttaaaaaccgtatttagattgaatccggctcgcgaatccaagccaacgccaaagcacctgcacccaagtgagtaccgataaccggtccaaagtacgtcaattcaattggcatatctgggtgacgttgttgcaagtcttcgcgccaggctgctcccgcttcttcagcgtttgcatgaatgaccatcgcacgcaaaggatactttgactctgcacgggcttgatcaaacaactcttctgcacgagccatcgccttcttcattgagcgcactttttcgaatggcacaatgtagtttgattcattgtcaaacgtcaaaataggcttaaccttcaacatcgttccgataatcgctgacgcatttgacaagcgaccaccacgaaccaagttttgcaaatcatccacaatgaagtattcgtccatcgtttgttgcaattcatccatcgtcgcaatgatgtcagcaggttcagcaccggcttgagccatttgtgcagccttcatgaccaagtggcccatcaaacgtacggtaatctttgaatcgtagccgtaaacagtaaagccgtccactgcatcagccaagccagccacggtgttcaccgtacctgaaatcgttgatgccaagttaacaacgattgcaccgtcgtaaccatcagccttcaaagattcaaacaacgtaatccactccccaacagccggttgtgacgttgaagggaacgtttctgacgttgccaatttttcataaaattcagaagtggtcaaatcaaccccttcgcggtaaaccgtaccatcgataatcaccggaattggcattaccttaatgtctagcgcaaccacttcatctcggcttagataagccgttgaatccgttacaatcgcaatcttcatctcaaaatcctctcaaattaattgttagttgtaatgttctttggcaaacgcacaaaaataatcaagccaattacaaacagaattgatagtgcgccagcagcaaactgcacgcgtcccgtcacctgtgataggattccaaaaatggctgggccaataatcgccgaaaactttccgaaaatattaaagaacccgaaaaactcactactacgttccttgggaataatttgtcccaaatatgaacgtgacaaagcttgcatcccaccttgtgatgagccgacaccaaacgctaccaaccaaaattgattagggtgattaataaaaattgcaaataatgtaataccgatataaatcagcatccccataatcaagatattacgattaccaaagcgatcggctaaccagccgtacacaatcgaaaatggaaaggcaattagctgtactgccaataagacaacaatcagttgactacttggaataccaattgccaacgcaaatgaagacgccatcgtgaaaatggtgttcaccccgtcgatatagaagaaataagccaataggaatcctgacaaaacaggataatggcgcaaatcacgaatcgtttcagccaaacgacgtactgccgcgcggaccggatggtcatttgctggtaaagcatacacctggcgcacattcttaacgaatggcaaagtaaatgcaaaccaccaaacagctgacaacacaaacgcaaaaatgacaacgccgtgtgctgataggaaacttcgtccaatcataaaaataatgaatggtacaaggcctccaaggtacccaaacccatacccggccgaactaacccgatccattcggctcggtgtcgtaatgtccgtgatataactgtcgtaaaagacgttagcagatgagtacccaacaaatgataacacaaagactgctaacaataacaaaagattgtcagctggcacggttgctaaaccgagtgtgccgacaatccccaatgccgtaaaaatataaaacaagcggcccttcatgccttggaagtctgccaaagcacctaaaatcggtgccaaaactgctgccgcaagtgttgcaacagaatttgcatagccccaataggcagttgcgtgggtcgctgaaatgccaccattcgccgcaacggacgtcaaccaaattggcaacaccgctgtgacaacaatgataccgtaccctgagttcgcccaatcgtaaaagatccagctccactcggttttattaaaaagcttcttcattcttactccttaaacgcctcgtcaatcacatgaccatcagttggcgtattaaattgtaagccaagcaacttagccatcgttggtccttctgacgtcaaatcaatgtccaacgtcaattcttgaccggcctcaatatcaggaccgttcaaaataagggtcgttgtgtaatcttcgttgtctgggtggtaaccgtgagttcccttgtagcggtccacttcaccacgttccaacatctcgtttgtcacttcttcaactactgctggtcgacgagtttcatcagtgaagtagtagcccttttgagcttctaccatcaatgaagcttctgggtcggcaccgaattcgaccaactcgctgtgatcataaacggccttaacaccttcaacttcactgaccatcttttgtacttgttgcaaaagactggcatctttcaagtaaacgtacgtcgctccgtcagtgtgcttagcaagtacttgccagttacgagcgacacgaccgttgtgcgttgcacgaagccaaccacgatcagcaaacaacatgttcaagtgaatcatctttgacacgttcatttggtagtggtcacccaacaccataaagtccgtatcgtcgaaaatacccgcatcctttgttgcttgaatcaaatcaccaacgtgttgatccaaacgatccaaggcatcccaagcttgttgtgtgcgaacaccatagcggtgacggtgcgaatccatgtccaccaagtgaatcaacgtcaagtttggcttctttgtcttgatcgtatcaaccgcagctgccgtgatgaaattatccagttcaggttgttgaatacccttacgcaagtgaccaaacttacgatccatttgcaacaagaacaatggtgaactggcgcgtagtgacgttgtatattgatttgtccaaatacgatttgggaaaatctcagcaatattccaattaatcttagcgccggccgttactggccacaagaaagcagcggttgtcagtccagcctcacgcgccaagtcatacactgttggcaccttaatgtgctttgcgtaccagaaccaatcgggtgattcacgttctggttgcatcagcgtcgcattaaccacgccatgggtctttggataagtccctgtgatgattgacgtgtgtgaaggatatgtaattgagggataaacacccttaacttccttaacccacgtaccacctgcgattaaacttgcaatgtttggcaaaaattgcaatcgtgcggccaaatccgcgcttccaagtgcgtccaaagaaattacaactgcatgcttcgccatgctcttcctcctacatttgcttactcaatgagttttccaaacgatttaacaaaatacgggccatgctcttctcttcagccgaccataatttaaaaatcgtttcctcataatgggtgtgttgttggttgacagccgtcaacacatcgctccccttaagcgttaattcataaatcaattgacgacgatcacggcctaccgcaatgtttgataccaattcttttttcaacaatgagctcaattgacgagacaacgttgaattatccaagccagtttcctcagaaagcttatcttgggtatcaaatccttctgagagatggtttaacaattgccattcagcaatggtcacaccttgctctttcgtgattctcgttaaaatggatttatattgtttttcggtatcgcgcaatgcttctaagacagttttcatgccggcctcctgatttaactaactaattatacgctttttgtattacacatgtgggacaaaaagcctgcacttacgtttacaaagtggctgtcgcaactaatgcaacgatttttgagccatgtaattcagaaacatgcagctcgtctgcaagccaacttgcattttcaaacgtcactccgccacccggcaaaatggtcaatcctgccggtgcttgggcaatggtatcctttaaatgactaaccgtttcagtaatcggttgggctaaatcaccaccgtgcgttaatactcgcactacaccgtagtttgccagccagcgtaaggcttgttgctggcattccggcttaatgtcgtcaaaagccatgtgatacacaacttgcatcggttgcgctgcctcgagtagctttaccatgcggtcacgggctaaacgcttttcttgatcaacaaccccaaatgtcaccattttcacacccaaagctcggaaatgaattaatgaatcgcgcattgcgttgatttcagcatctgagtaatcaaaatcaccaccacgtgggcgaaccatgacaaccaagtctacgttagcatcatgggccaacttcacggcagtcgcaaccgtattatcatctggtgtaatgccacctaagtctagtcgactatttagttcaacgcgatccacgccagcggcgattgctgcacgcattgtatccaaatcagctaaagcaatttctttaatcatgacgcaccctcctgtattctaattcctattttactaaaaatgggacaacgattacagatttgcattcctggttaagagacccttaatgtttgctagacaataaaaggccggattacaaggaatccgacctctgatgatggactaatttaattttgtgcttgcgtcggcttgttttgacgtagcttttgaaccatcgcaaagtccggcgtcaccgccatcgttgtttgaccttcaaaaataacaaaacctggctttgagccattgggcttacgcaaacgacgaaccggtaagtaatcgaccggtacattagctgaatcacgggcctttgagaaataggccgctaacatcgcaccctcaagcaacgtttcctcagaaggttcagcgtcgtgaataatcacgtgggaaccaggaatatcctttgtgtgcaaccagatatcagactttgccgctgtcttcatagacaagcgttcgttttgcaagttgttcttaccaacttcaatcagcgtgccatccgtggcatagaacttctcaggttgactcacttgcggcttttgcttcttcttgctttgcacacgcatgtagccttcttgaatcaattcttggcgaatttcctcgatatcctttggtgatgcaatatcgatttgggccaacaagttctcaaagtaatccacttcttcttgcgccatcgcaatttgttcatttaggtacttaacagacgtcttcaacttgttgtagcgtgtaaagtacttttgcgcattctgagatggaccgatttggttagacaacgcaatcttcaaaggcttgttgtcgtcataatagtttggcaactcaattgacgtcataccacgctcaatttggtgcatgtatgtcgtcaacaactcacccttaatcttgaattcatcagcgttatcggctgcatccaattcggcttgttgcttcttaattttcgtcttgttcttcttcaactcattacgaacgacacgcaacacaaccgctgcttgttgttgcacacggtcacgctcagacttctcagcaaagtaaccgtccaacatttcgctaagcgttggatattccacaatgttaccagccaacgtcatccaatcgaatggtgcgaaatcaacacccttctcagttgaaatcaaacgtggtgctggcttatcaaagtgagcaaaccaatcttgtgccaacttcatcgcatcgccatcttgttgcaatacagttgctaattccatcgctgaatcacgggcgaatccttggaaagtgtgttgaattcccttagctaaatcagacacatccgggttatccaaaatcaaatttgccaagccatccaacgtctcatatgggttcaccacatcttgcttaggtggcatgacatacgtaccacctggcatcaacgtacggacacggttttggtctgctgggacgtgcttaatcaaatccaaaatgcgttgtgttggatcatcaattaagaacaggtttgagtggcgacccatcatttcaagaatcaaagatgtcttctcttcatcacccaattcattgcgtcctgacgtcgtgaacttaatcatacggtcgttcgcaacttgttcaacgcgcaacaattgcgcaccttccaagtgcttgcgaagcatcatggcaaagttaggcgcagtttgtgggttagtgtacttaatacgtgaaatttgggcgcgcgcaaatgaagggtgcgcactcaaaaggactggataattcgtacgattattacgaatcaccaagaaaatttcatttggataaggttggtgaatcttcataatgcgaccaccagccaatgtttcattcaactctcgcaccattgcgtgcgtaaagagaccatcaaaagacatgatttgtcccctttcttttttcgattaacgttctgctaaaaagcgacgtgagacagattcatcatctgctagcttagcaattagaccagccatgccatcaaacttcatctcgccacgaatatagtggtgccaacgaactttaacatgttcaccatagatttcagttgcaaaatcaaacaagttaatttcaacggtcttaggacggttttcaccaaacgtgacattatagccaattgaagccatgccaccataccattgattgccaacttgtagttcaaccgtgtaaacccccacacctggcaggcgctcaccaggcgttgtctcgatattggctgttggatagcccatttcgcgtccacgcgcttccccgtgaacgacaacacccgtcgtttcgtatggttgtgtcagaagaacgttcaattcgtccacacgcccagtatcaactaattgacgtgcgcgggttgaagcaccttcttcgccatccacatcaacgcgggcaacctcgatcacatcaaaacgtccttgcgcatacgctggcaagtgagccatatcagctgctgcgtcacgagcaccataagtgtggtcaaaaccagctaccactgcttgggcatgcaacccaaccatgtattgatcaacaaaatcttgtggggctaccttagctaacgccgatgtaaagttcacaacgtacgcgatatccaccccaagtgacgctaacaactcgagcttgcgtggcaaagttgttaaataagtgagtggggcatcatgtgtcttaaacacgattgacgcatgttgatcataagtcagcaccgccaacttcaccccacgatgttgtgcttcaacttgtgcgcgctcgataaccgcacggtgaccagcatgaacgccatcaaaaaatcccattgccaacacaactggctcatcagcgattttctcattatcaaatgggtgatgtaatgtcataacttccatttcaactgccctcacatccaaaaatttcaatgcccttatcataccataaaaccccgcactaggcggggtttagtcaggattagtcttgatttaacgccatttataaatgaatgaacatttatttattattctgtcaaactgtggcgcttaccagcttgaattgcttcgttttctgtcatttgcaccacattattcaggttcgtatttgatggcatgctcccagtaccgtaccagtaaaccttactcgtaccgcctcccgtcacataaaccatacggtcgccctgccctgcttcttgctgttgcgcttgtgcttcaggttgagttgattcgacgactggtgcagctgcagccggtgcggcagccttttcgactgtaccggttgccattcctgtcgcataatcaatcgttgcgtttggactgacattggcaagatacacgacagttgcaccaccattaccacttgtctcgtgttgtgagccgaaacgaatttcaatcgtttgaccgttttggtcataacccacatatgctaaacgcacctcacgtggcaacaattcgtcacctgaatacaacggtgttacttgataatccaaacggtaatttgggtgcaaggccaaccagttgtccagttgattctcatagtacaacatactatctgagttaccttgatccataccagaatagttgcctgaattcatccaggctgtctctggtaccaagttacggggctcatcgttcagccctgaaaattggtaaccaaccaagtgaccacgagccattaaccaagcactctttgcaccatccccataatacatcttgtaattgtgccaaccggctggattgtatgacaatcttggcgcacgcttcgctgttggctcttcatcgtttgacaattgaatgtggctatcaactgcacgacgcaaatgatcgagtggttgcatcaccatttggcgtgatgttgcatacgctaatggttgttgcaccgcacctgttaaaccatggtcatcagcctttgccaatcccttggtagcatcacttgcttcagatttactcgttgaactcgcaactgaagacgacttttcagtcgacgttgccgaagatgaagacttctttgacgaagaacttgacgatgacttctttacaactttatgcgacgttaccgctgaagatgatgtcgtatcagctgattcactatctgaaccaccgctaaacgcactgatgcccatcagcgctaagataacaattccagctacctttaattttttacccatatacctatactccttatgcatttttgcataagctaagtatacagaaaaacgcccactaaatgcgagcgttcataaaatggtcacattattgtcttagttacgttctgaagcaagggctgcctgtagaatagcttcacccttcatcatgccgtaatccatcatattgatatctaccactgggtaatcagccccgtactcttcctcataacgagcgtgcatgtacttcacttgtggtgcaatcataatcacgattggttgatccttggcaatttggtcacgagcaaccatgtcagcaacaccaactgttgagacatccaagccatccttttcagctgcatcgttcatcttgttagccaacattgaaatcgacatacccgctgcgtcaaccaatacaatatgcttcgtcataatcattaccccaaattcttatcttctctattattgcctaagcaccatataatgatagcgctttcattagttaaattgtaaatcacgcacaaataataagcaaacaaaaagaactaacctagcgcactaagttagttctttagacgtctttagtgatacaaatcaaaacgaccctttgataggacttccttcatcccaccagtttccatcaacgacttgttcatgataaccttcttcaacattgaagctggatatcccttgacctcgtgatcagtacctacgacaccaatggcgctggtattaccaattgagcaaaccgttcccaatgacttgtaactaaactccgtcaattcgtaatccgtaatgtctgcaatcacgttcttggcggcaatttcacccatcaccaaggccaattgggctgttgttggcaatagttgctcactctctggatcaatcgctgcggcgacgtcaccgaccaagtaaacatgactgtcttccggatcttgcaagtaacgattcactgaattacggtttcgctttcccgtgtaacccgaatcagccatcacgtgtgaaccacggacaccggtcgtccagataatcgtgccagcgaccacttcgcctggcacacccgtttgacgatctgagtatttcaatacgcccggttcaacagaatcaattcccttaccagactcaattactgccccgcgtccacgcaaaacgtcaatcccgtagttaaccagcttttctgagaagacactcaacggacgttgggcaccgtcaaccgccataatttgaatttggtttggcgcagctcccgcaatttcagcatacttatctcgttgctcagacaatgctcccaacaattcaacacctgtaaaaccagctccggctaccacaatgtgcaagtggcgtgggtcgttatcttcgcggtaagcatgcatttcgtcttcaatatgttgataaatacgctgtgctgattcaactgaatccattgccaacgcgttttcttgcacgcctggaataccgaaatcttctgactcgaatcccagcccaacaatcaagtaatcatatgacaatgcatcatgattagccaattcaacccgacgtgcttgcttatcgattttcgtcaccgtatcttccacaaaatacgtcatcttatcatcaacaacatgatcaattggatacgtgattcggtcggcatccaatgcacctgctgcaacttcatgcaagtctgttgcttcgtagtggtatgggttgcgatcaactagcgtaatctccaaaaatgaggcgtcgccacgcttttgcaactgacgcaacgccatcaagccggcataaccagcccccaaaatgacaacttttgtcttttccatcatattatcccccaataatatcaattattcttacaagtagaatactggctaaatatgaatatttttaacatgagcccttatcctacacaaaaaaacgagtccgcgtaaaaaacgtgaactcgttaaaagattattcaattgaaaatgttcggaatgggcggtattgacccttatcctcacgccactcaaagactgatttcacatcaccgtcgtgggtaatcacaattttctcatcaattggttcatgcacatcctttggcaatccgataccattttttacctttgcccattgttcatcagtgattgccacatgtggataatgagcaactgcgctacccaatggttgtaaccaaacatctacattaccagtttcgtccatcattgcttggatgtcggccaaactgtgggcttgtgacaagtcatagccacccgccttttgacgtgtcaattggctcataaccgctggcacgcccaaagtcttacccaaatcaacggccaacgtgcggatataagttcccttagaaacttcagccacaaacgtaaacttttgcgtcccgttctctgcatcgaatgtcgtatcagaagtacgttcgaaacgacagatagtcgcatgacgttctggtcgctcaaccgtttcaccagcacgtgcatactcataaaggcgcttaccattcaccttaactgcagaaaacattggtggaatttgaataatgtcacccgttagcttagccattgcatcagcaatttcttcatcggtgaacggacgcgtcaatggttgtgattcaaccacttcaccatccaagtcttccgtcgttgtcgcaaagccaaatgtcacttcaccagtgtaaatcttacctgactcttgcagaaattcgattgttttcgttgccttacctaaagccactggcaaaacaccatcaacagagggatcaagcgtacctgcgtgcccaatcttcttcatgtgcaaaatcttgcggagcttaaacaccacatcgtgtgacgtcattccggtctctttgtaaactggcaaaataccatccatgattcagtcctcaattctcatttagtatatgtatgaaaatagcgacccatcacaggtcgccattttctaaatattagtcgttttggtgcaattgacgaatcaaatcatcaatcttgttaccatattggacagattcgtccttaacgaacttcaattctggcgtcttgtagatttgcaaacgtgaacccaattccttacgaatcaagccagttgcagcttccaaaccagcagctgccttttgattaacagatgccaactcagacaagacactgtagtaaatctttgcttgttgcaagtcaccggtaacttcaacaccagtaactgtcacaccttcaacacgtgggtcgcggatgcgcttaagcaacaaatcgttcacttcacgttggatttcttgttcaagacgtccaacacggaaattttgttgtgccattcttagctctccatttcctgagggaattagcgaggaatctcaaccatttcgtaggcttcgatcacgtcaccaatcttctcgtcgttgtagttttcaatcgtcaaaccgaagtcgtaaccgttcttaacttccttaacgtcatccttaaagcgacgcaatgaagccaacttaccatcgtagataacgataccgtcacggatcaagcgaactgatgagttacgcgtaatctttcctgacgtgaccattccaccaacgatagtaccgatctttgaaaccttgaacaattcacgaacgtcagccgtaccaacgatttcttcgcggaattctggatccaattgacccttcattgcagcttcgatttcgtcgatagcgttatagataacgttgtgcaaacgaatatcaaccttatcagcatcagcttgttgcttagcttgtggtgtaggacgaacgttaaatccgatgatgatagcaccagatgcttcagccaacgttacgtcagattcgttaatcgcaccaacggccgtgtgcaagatatcaaccttaacaccgtcaacgtcaatcttacggaatgaaccagccaaggcttcaacagaaccttgcacgtcggccttgatgataacaggcactgacttcatttgcttttcagccatcttgttaaacaagtctgaaactgaaacaacgttgttacggttacgctcggcaatcaaagcacgctttgcacgctcttcaccagcagcacgagccgtcttttcgtcttcaaagacaacgaaacggtcaccagctgatggcacatcgttcaaaccagtaatttcaactggtgttgaaggaacagcttccttcacacgacgaccgcggtcgttcgtcatcgtacgcacacgtccgtaagtgttacccacaacaattgggtcaccgacgcgcatcgttccttgttgaaccaagaccgtggcaatcgttccacgacccttgtccaaacgagcttcgataactgaaccagcagcacgttggtcagggttagcttgcaagtccatcacatcagccgtcaacaagatcatctccaacaattcgtcgatgttttgtccaaacttagctgagatgttaacgaagatggtgtcaccaccgtactcttctggaatcaactcgtattgcatcaattggttgataacgttttctgggtttgcaccaggcttatcaatcttgttaaccgcaacgatgattggcgttccagcagccttggcgtggttaatagcttcaattgtttgtggcataacaccgtcatcggcagccacaaccaagatcgtgatatcagtgatatcagctccacgcgcacgcatagccgtaaaggccgcgtgtccaggcgtgtccaagaacgtaatcacacgaccttcatcagtcttaacttggtaagcaccgatgtgttgcgtgattccaccagcttcgccttccgtaacgtgtgagttacgcaagtagtcaagcaaggtcgtcttaccgtggtcaacgtgtcccatgatcgtaacgactggggcgcgtggcgccaagttttcagtgttctcttgctcttcttcgaagaacttgtcgatgtcggcgatgtcgacttcaaccttttgctcagcttcaataccgtagtcggcagccaagatttcgattgtgtcagcatccaatgattggttttggttaaccattacacccaacatgaacaacttcttgatgatttccgttgcatcacggtgaatcaacttagcaatatcttgtacgttcataccaactgagtaaaccaaagtctctggcaatggttggtccttacgtacagtaggtgctggacggttctcgttgttacggttacgtcctggccccttcttgcccttcttgttgttacggttgttaccgttccagttgttgtttgggcgaccgttgttgttaccaccgcggttgttgttgcggttgttattgttgttacggttaccaccttggttaccgttaccgttgttgtttgaacggttttggtttccttggttgttgttacggttttggttgttaccaccgttgttttgtgcagccttaggagcagcttgcgcgttttgcgcaggcttcttaggtgcctcagccttcttttcggcctttggcgctggcttagcagctggctttacagcgttcgtcaacgtcttcacagcgttatcgtcaatcgttgacatgtggttcttaacgtccataccagccttttcagctgctgacaccaagtcctttgatgaaacattcaattccttcgccaattcgtaaatgcgcttggtcatgtgtcatcctccctagttttctagatattcccgcatctttttagcaaatccgcgatctgcaacagcaagtactgttcgcgctaatccggttgcatcagctaattcttgacgtgtcaaagcggttgaaaatggcacgttatagctgtttgttttatctgtaaatttcttcatgctacttgcaccgccatcgtttgcaaagaaaaccaaactggctttcccgttacgaatagcaccaagtaccatgtcctcacccgtcactagcttaccagcacggcgcgctaggccaaggagatttaatagcttttgcttattttgcatcgccgaacaattccttacgtgctgcttggtgatcaacgtaggcaatcaactcatcataaaagctgtcatcaagcttcgtttcaaacacacggtcaaacgtgcgcttcttcttcgccatctcagcaacttctactgacaatgagatgtaggccccgcgaccattggcacggttggttggatcaagctcaacgttaccctcgggggtgcgtacgacgcgcacgagttccttctttggtaccatttcaccagtcacgatgtcttttcgcattggaatcttacgtggcttcatgagcacacctccttaggcttcgtcagtttcctcgaagtcgtccgcaacatcagcttcaacaactggtgcgttagcggcttcttcttcgcggttcgccatgtcagcaattactgcatcgcgttcgctttcaggcttgatgtcaatcttgaagcccgtcaaacgagcagccaaacgagcgttttgtccacgcttaccaatggccaatgacaattggtaatcaggaaccaacaccgtaacggcacggtcgttagttgggtcgaagataacttcaacaacttcagctgggttcaaagcattcttgatgaattgggctggatcttcagtccattcaacaatatccatgttctcacctgacaattcgttaacaacggcttgcacacgcgcaccgcgttgaccaaccatcgtaccaacggcatccaagttgctgttgtgtgagtaaaccgcaatctttgaacggtcaccagcttcacgggcgattgacttaatctcaaccgttccgtcgaagacttctggcacttcagcttcaaacaaacgctttaccaagtcagcgtgcgtacgtgacacaaagacttgaggtccacgttgttcgttttgaacttgtgaaaccaagaccttgatcttgtcacccatacggtacgtttcgtttggcatttggtcaccttgcttcatggcagcctcctggttacctggcaaaatgatgtacaagaagcgtgagtcttgacgctcaacttctcctgtgatgatttcgttctcgtaaccgatgaacttgtcatacacaacaccacgctcagcttcgcgaaccttttgcatgatgatttgcttagctgtttgtgcagccaaacgtccgaagtcagcaggtgtgacttcgaaacggatttcatcaccgatttcgtaagccttgttcaattccaaagcttcttccaacgtaatttgctcgtaaggctcgtcaatttcttcaacgacagtcttaactgagtaaaccttgatgttacccttcttttgatcgaattgaacttcaacgttttctgattcgtcatagttcttttcgtaggccttcttcaaagcctcttcaatcgcttctaccaagacttcagccttgatacccttttcttgctccaaagcgtcaagagcttgaactaattccttactcatttggattctccatataaattagaagttatttgcttgacgtgcttgtgcaattgcagcgcgtgggacttcgacttcagaatcatcatccatcgtaatcgtcaacgtctcatctgagactgccgtcaactcaccagcaaagtctttcttaccatcaatcttttggtacgtcgaaacgcgaaccatcttgttcattgcccattcgaaatcttcaggggtggtcaaaatgcgttcttgactgattgttaggttagcagacttgatgtcggcgcgtggcaccgcaattgtcttgcgctttcccttaactgtgattgccaacgttaattcgtcgtcagtcaccgccgttaattcaccgtcaatttcgttttgtccgtccatcggttggtttaacttcacgtgaatatacttttcaagtgcccactcgaaatcttgtgggcgctttagttcacgctccgcaccaggtgatgagacatccattaggtatgcctctgggaatggatctggttcgatttggtccaaacgttcaccgatcaattcagtcaacatcaccaaatcatccatgttaattgcgccgtctagacggtcaaccaacacacgcaagaccatatctgaatcttgcttttcataaatcacgtcccataggtcaaacccgtggtctgccaactcaggcgtgaggacagcttgcactgtttctacaacgtttgccatgttttccctcccttcgttccgtaaatcatctatgtcagaggtaaaaccctaaaaaaatgagcggccaaggaaattcgttcctggccactcaactaagagcttattcattaacagtatttatactaacactattcttacaaaatggcaaccagcatcgtcttctatataaagagatgaacctattttacaggtttatggctgaaattgtttataatggtggcaacattaccgaatggagtcatcattatgcaaatagaaaaactagtactggccgcaattaatgtcgttcgccaggcgtttggtcatggaacttttgttgaccctaacacaatgaccacccgaacagaggccgataataatattcaccgttatctggcggatgcacctagcattaacgatgataccatcgcgattgatgtgtacgagacagctgagcaaccaatcattgtcttcacatacaaccacgatgatcaaatcattgctggtgaaacatggacctggattatgctagatgaagctgttgtatttgacggcaccgcatttcgtttgatgagcccagatacagttgaacgattgcatctacaacttaacaagcaactagcacactatgccaagtaaacaaaaacgggccgaatcatcgtgattcggtccgtttttatctatttaaaacttcgcatcaataatcttggcatgttgcaactcagcaaccgtgtgagaacccgtcaattgcattacaatctttagttcttcggccaagtgttcataaactgactgcacgccagccgcaccaccttgattcaagccccaaagcattgggcgtccgagtgcgaccacatcggcacctagtgcaatagccttggcaacgtcctccccacgacgaatgccagaatcaaatacgactggaacacggtggttaactgccttagcaacagccgccaatgtatcgattgaagccggtgcgccgttcaattcacgaccaccgtggtttgatacccagataccatcggcacccgccgcaatggcagctagtgcatcatcaggatcttgaatgcccttcacgaacactggcaagccattagccatctgcttaaccttggtaatatcagacaaagcaagatcctgcttggcgcgggcataaatttcagaaattcccaatccttcaccagaaccggccgcatttgagaaggcagctagattttccattggcaatgggaaagcaaagttattgatgatatctgcctcacgatatccacccaacgtcgcatcagcagttaaaataattgccttgtaaccattctgaacagcttcatccaacaaatattggttaaactcgtcatcgcgagacatatatagttggaaaaacttcgccgtatcaggcgatgatgcagcgacatccgcaatacgtgagttaccgtacgttgacaagctgaaaattgtaccagcggcgccaacacctttgaccgttacgcgttccccattttcatgcatcaagccgtgagctgcaattggcgcggcaatcacaggcattgatagcggaatatctaataatgttgttgataggtcaggcgcgctgatgttttgtagcatgcgcggaataagttgatagtggcggaaagccgtttcgttgtcgtgcaacacttgttcgtcagacgatcctccgtcgacatagccaaatgcacccgcctctgtgtcacgttgtactgctgctcgcaagcgtggcaaatcgatgatgttcaaagcctcttcttttgtactaccttgataagccatctgtgattaccttctttgattaaattgaataagtgcaaatgaaatttacactttcagtataccgccctgtctttcaactggttcaaaaaaggtgtaaccgattacattagtgttgcgtggccccatcaatctttggcgcaacatcttgctcgtgatgatagaacttgtaatacaacaaacccgcaataactggaatgactgcagccaacaaataaagctcgcggaagttcaatagcttttcgacatcccccaacacaaacggaccaacaccgattcccaaatcaagtccgataaagtacgttgacaatgacacaccaacgcgaagcgcgtttggtgccagcttcaaagccaccgcttgaccgtttgacataaaggttccatagcccaaaccgataaaggcacctgatagcaacaacataaagccggaatgcgttaccccaagcaacactagccccactgccaatgaggcataggctggatacatgacataatcttcaccacgtgtgtcaaagatgcgccccgccattggtcgcgtaaacgtaatgaccaaagcgtatacgacgaaaaagaatgagctgatacttaccaaatgaattgtcttggcatatgaagacaagaacgacaacactgatgagtatgagaagcccatcaagaagccaatgcctgcaatgaacaacgccttacgctcaatcaaattatcaaacgtcatatggcgtaattcagccttacgttcaggcgtcaaggccaaattgtggattggcaaaagcaacgttgcaatcgtcgtcaacaaaatcaaaactgatgacacgatcacaatgaaacggaaattcgtgaggttcaacaaaatcatccccacaaacggaccaatcgccgcagccaatgacgtactcaacccatagaagttgatacccaatccctttttatcttcaggaatgtaatccgtcacaatggcattcgtcgcggttgacgtcattccataggcgaacccattcaccaaacgcaccgcgaacatgaccccgatattcggaataatcaagtacgccagcgttgagaccaaatatatcaatgccccaaaacgtaatgattgcttgcgaccaataatgtcgagctgttgtccaataataagacgtgcaatcaatgtcccaataacataaatccctgaagccaatcccgcctgtgctaggttggcgtgcaaatttgtgtgcaccacgactgcaataatgaccatcaatagatagtaaacaagataaacaataaaattgatggctgtaatactaataaagccagcgttaaaaatgctggtaaccggttttcccgttgtcatgtaaacataactcgctttcgtaaagtctgtgtctcagtctaaccatcaaccctagcgaggacaaaaatgagattttcgaaaacggaaaaaccattttttgttgttgtggtcgccttttctatactaagaacagatattcacagggagacaaatactatgccacacacgaatgaacaaatcgcacacgattttgcaattgccattgctgcccagaactatacgaagagttctgtccgaaacattggttatgcactggatgattatgatcaaatttatcaccaagtgttagagcaacttgcacttacccaccacattgcggtataacctaaactaactgaacgagtaaaaggcagtgtcagcactgcctttttgtgtttgcggaggaacaaatttgtggactggctactacagaaaaaagaacgcgataaattaacgctcaaaaactacctgatgaggcaaccatttccgatggtccccatcaagcaagtcattaacgacctcggttggtcaaagtaccttgtcatgaactacgggcaagccctagctgatgatttggcgcaactagatcaacacgaattggtttcgtttgatggtgcgcgccaacacttcattgtgcgaccagggcacagtatgctgtttgacgagttgcgtctacagtacctgaaccgtgcgccgaaatatcatctactaatggccttattatttggcacgtttgaaaccgttgctgactttgcggtgcaacatgatttttcaacgccatatgtccgcgaactattacaagaactgcaacaagatttgcaaccctatcatattcagattaacgattctttcatattaattggcaatgaaaaagaggttcgttacttcttcttccgaatcttgtttgattactatacactccaaagcaaccccctcccaggggcagccattgaatgggcacaaacaacttgggcctacttaaaaacaaccagtcccaatccaatttcacccgccatcagcttgattgtggaattccagctgggcatttggtacgtccgaatgactcaccaacacatcattacgcccagcgattcggcgccagtgcttgatgagacaaccgatttacccgcaacaacgcgtttatttcttgatcgcatgcgtgaacacttaacgcagtcattaggtctgtctgacattgaagccgggtatgaagcgcgttttgccttgagtgccctctacgcctttggtttcgcacgcaaagaacactttgaaacgtatatgccgattgaaacgcgcctcttgttcagtgtcgtctcggatatcatcgcccgtgagctaccggctttcttcggaaacgcttatctgatgacgcataaattaatcgacgccattcagcatgatttatacacaaccaatttacgcttagtctacttccacagtgcacttcgaccggagccaaacgtcgatgaagccatctcacaatttccagtttatgcgcaactgacccagcatctcatccaagccatcgcgactgagacgaacattccacatgacaccttgcaaaatacgttattcgaggattacttcaatacgttcatcacgcgcttgccacaagaagaagttttgcccattatcacggttgacttggaattcgtcgataatgccgcacttgggcgtcgcttagctcagttaatgaacaacatgccggcattaaatattattttgagttttgatacaccagactctgccgacttggtcatttccaatacgcacttatctaacaaccaacgacacctctacctgaaggccagtccgacgttggctgaaattgaagaaattcgtcaggtgctccatcaaatcacggttcaaaaattcgaacgctttaccgggcaaacaattccggttcgctttagctaaaaaggcacgtcgcccaataatcgggtgacgtgccttttagcattaaatcaatgtaaacttttcaatcattaactcagggtggatgatcttcatgtcagtcgtgccttctgtggcataaccagcttcttcaaacgtttcttgcagttggcgcttaaaggcaaaccatgagcgcatgtcagcgcgcaacaactcttcaatttgttgcaacacttcacgtgggttatcaaccttggcgtcagcgcgaatttcttcgcgaatcttttcaatttgttcagcggagaagtactttggctcatcaagcaattcagccacagcttctgacaacaatgggttaaccagtacgttttcagcacgtgacatcatcttcttaacggctagctcaatcgccatctccgtcaaatacgtattcgtgatgtgcaacgcaaccttgaccaacggtgacttttcacgttccttacggcgcttctctagctcgtttcgcacgtcagctggagatggaatttcatagctcatcaatctattctccttagtttttattaccttaatcataacaaattaattatggtttgtttctgattgaattgtacccgttttgaggacaactattagctagacttgcttggtgcattttgctatagttacgttaatgcatggaataagccatgtaatacacgactctaaaagacgccggtagtcaggaatgattaccggcgtcttttgtcttcattttttagccatttggcatataaatatgtacgtcatccccatttaaaaagcgcataatgaatatgtagtcaaatataagggggaatcattttgaatacagtagaagcattacgcgcaattgtcggtaagtcacacgtgattacgtcacctgataagtcattacgttatcgtaaaggttatcgctcaggtcgcggggatgccttggcagttgtcttacctggcacactaatggaactttgggaagttttgaagatcttgcatgataacgacctaattatcatcatgcaagcatcgaatacgagtttaactgagggatcaattcctgcaccgggctacgatcgtcaggctgtcgtggtgaatggctcacgtatcaaggggatgcagctcattaaccacggcgaagaagctttggctttccccggtaccacgttgtacaagttggaaaacgccttgaaggctattggacgtgaaccgcactcagttatcggatcatcgaacttgggtgcctcagttattggtggtatcaataacaattcaggtggtgcgttaatccaacgcggtccagcttacacggaacaagccttgtatgcacaaattgacgaacatgatgaactccgtttggttaaccacctaggcattgccttgggtgatacgcctgaggaaatcatcacaaatctagaaaaccgcaacttcaacattgataatgtgccacacagtcgcacgcgtgttggtcataatcgtgattacgaggcgcgtgtccgtgacatcgactcagatacaccaactcgttacaatgccgatccaaatgaattgtacgaagtctctggtgcttctggaaagctggcggcctttgcggtgcgtctggacacctttcctaaggaaggcgcatccaaggtcttctacattggcacgaataatccagatgtcttagaacgtttgcgtcgccacattttgtcagagttcactcacctacccgtttctggtgagtacatgcataaagatgcttacgagatggccaagaaatatggaaaagattctttgattgtcattgaaacgcttggtaccaacgttttgccttatctatttggcatgaaagcaacgactgagcgcatcttggatcacattccaaccttcaagccatacttccctgaccgcgttttgcagcacatgggccagctcttccctaatcaactgccaaagcgtatcgaagactacagcaagcgttacgaccactacttgcaattgaagatggaaggtgacggaatcgacgaagcacgcgcctttctaaaggaattctttgcgactgaagatggtgattatctagagctagatgacaaagaagctgagcgcattgcgacccaccgttatgtcacagctggtgttgccattcgttatgaagaagtcttccaagacgaccacattgaaatcttgccgctcgacattgcgttgccacgtaacgagttcaagtggttcgaggaattgccaaaagaaattgaagataaaattcaatacaagctctactatggtcacttcctcgaccacgtcatgcaccaagactacattttgaagccaggtgtcgatgcgcatgagttgaaaaaggaaatgttggccttgctagataagcgtggtgtcatctaccccgctgaacacaatgtcggtcacttgtacgaagcagcacctgccttggtcgcccactacaagaagaacgatccaacgaacagttttaacccgggtgttggtaaaaccaccatgcacaagtactggggaaattattaattagctactaaagaggctaggaattgcatcctagcctcttttttcatgcaaaaaagcagcaccacgtgggcactgcttcaatatctattcagttttacgaaattatcaagcgcatcgtgcttagttcaagccacgacgattaatttcacggtacaacaccgatagcgatgcattggctaagcgcgtactacgctttgcaaccatcactcgcttgacacctgcgtccttcagcacagcctttgcccatgccttcgtaccagttaaaatcattgttgtttcctcctttgattttctctatattcgtgtacaaacacaggttaacatatcggaaaggacgactgcaaaaagacgtaaaaactgggtaaaaattacaagcgttctcttgcatccaaacaaaacgggaacgtttgttggggtggttaaaacgcccgaacttcctcacggtaaatcgcaacttgctcttttagacggtcaatattatcggcatcaaacttatctagcactgcttgcgctaattcaatggcaaccatcgcttcagcaattactgcagccgctgtaacagcggttgtatctgatcgttcaattgaagcacgatggttttcatgcgtgtcgatatcaacactttgcataggtcggtaaagcgttgggattggcttaacaaccccacgcacaacaatcacaccacccgtagtcataccaccttcaaaaccaccaagattattactcccacgggtaaacccgttttcggcatcccaaaaaatctcatccatcacttcatcaccgaacttttcggcattgtcaaagccaccaccgaagtcgacgcctttaaacgcgttgatactaacaatcgcgcgggcaattttagcatctaacttttcggtagctgccacgtacgaccccagtccaactggcatcccagttgccatcacttgtaccgttccgccaacagtgttcgcgtcacgttttgttttgtcgataacggtttgcatctcttcatcccccgaagcatccaaggcgcgcgtcgggaagctttccgtcaccgcgcgtagctcatcaagtgatttaaaatctgtcaaccgactcaaatcgctctttgctggaccaacattacgaacaaatccgtggacatcaaccccaatttcctgtaacacagctttcgctacggcgccaaccgcaacacgcatcactgtctcacgtgccgatgaccgttccaacacgttgcgtaaatcagcttgatgacggtatttaatacctccgaccaagtctgcgtgacctggtcgaggacgcattactttacgcatcgaattttcagcgttcgctggtgtgttaggatccataattttcgtccagtggttgtggtcatcgttatgcacgtttagcgtgattggtgaccccagcgtcttttggtgacgcactcctgacaaaatcgaaacagtgtcggtttcaatcacctgtcgttggccgcgaccgtatgcatgctgtctacgagccaactcctggtcaatcatatcgctcgttaagtttaatcctgagggaatcccttcaataattgccacttcttctggcccgtgactctcacctgctgtcatgtatcgcatttttattctcctatctctgtttcactcaaattgaccacacgcaacgcatgtgagacgactaaaattagatttatcacagcaacaattaacaaactttgcatcacaactgccaaatgttgttccgcaaaatgcccagtcacaatcggcataagtaatgccgcgatgctaccggaaaagaagtaccagccagttgctcgcccggtaaacgttgggttatgtgcaataagttgtccaacgcctaactgcagtgcaccaccggcggctgacataccaaacattaccgtcgccacgctaatcaagaaaatcgaatttgtgttaacaaccaacaacataatcagacttaataaagccatactgttcattaccaccaataaccatttttcagggagtagacgacgaccagttagtaggaacacgagcccaacgccaatcaaagaacctatgctgtagcaagtcatcagcaaatgggcgcttgtctcatcgaagccgcgcacaagttgaaagtaacgtgttacccattgcgtgaaatgaatcatcaaccacatggcggtaaagccgtatgctaaaaatgtaaattgaaccacatcccactgccaatgcggcgctgtttttgcaccagcagaatggatttctacctctggaatttgtgtgccaattagaatcaaaaaagcgatgattaaaatggcgctagctacccaaaacacccagccaaaccataattggtggctatttaaattgataatgatgactggcaaaatcccttcaccaattgagatcatggctttaatcagcacattaccacttgaacgaccgtcatgtagcgcaagtaacgtcgggtaggccaccgcatccagcatggcattagcaatgccggcgaaactcgttaaaacaattccttgccaaatctgcgttgataccggtactagtgtaaagaaaacaccataagcagccatcgccagtaataacagcgtttttcggggccaacgatcagaaagttcacccaaaaatgggtaagcaatcaattttccaataccgattgccgatacaaccgctgtcgctccggctaaatttgtgtgccagatactcgttaaggaactcatagtctgtgccaaaataattaatgcaaaaccttgcacaacgtacatgaggtaaatggtaacttgcatcctaattgcaactaacttactcatatttgtgcctcctctcgttgaatcgccgtggttgtcatcagatttaagtagtccgcaactacctgatctggcaaaatatttttaaatcgtttttgtagtcgttctcgcatagcaagcatgcgaccaggttgaactaccgccaacttatgattagctttaataccagcaacctcatcaactaacgtcatcctcgtcaccattgcctgtaatatctggcgatcaacactatcaatttgactgcgaatcatatccaaaacggtgggctcatccatatgacgagtaatttcagcaacaatttcgttaggggttttactatcagttgtaatcattaagtctgccatccgagcgtacttaacctgtcgattttgccaaagtttaaagaaggacgccaatgagtgttgctgcattaaaggccgcatgtcatcagtcatcaacaggcgttcagtcacagtactaaagtcgctatttagccaaatggtaaaaacatctggtcgactcatcaaatccatacaactttgggtttcgatgaccccaccaccagtactgatgacggtatcaggttgttcaaggacctttgctaacatcttcgcctcaatttcacggaaagtcggttcaccgacttgtgaaaagaacgctggaattccttgcccaacatgttcgacaattgcttgatccaaatcaataaaatgcttacccaaatcacgggccaattcttgaccaactgttgttttaccggcacccatgaacccaattaataatatattcatcctaaacccctcctaatttgttgaatatttgttagcgccaacaataactggtcagcgtctccattggccactaaatcgtttagccgtgttagttcggtcataaagcccgctaccgccgccatcgtagccgtccgattgtttaataatatttgtgtccacaggtcgggactagctgcagctatccgcgtcgtatcaagaaatcctggcccgacgaactcgtgcttttgtgtattttcattggcacctaaagttgcaaccaaggcatccgcaattaaatgggttgcatcacttgtgagtgcaactaatgcatcatgttgttcaacggtaactgtctcaaactgactacccaatggcgccaataattcagctactttttggcggtcagatttttcgcctatcaagaagaaacgtgcttgttcgagcataacttttcgccgaccgttaagaccggtttcatcagtaccagccattggatggccaccgacaaaatgcggtaagtgctcagtcgctgtcataatcggccgcttaactgatgccacatcaacaattaagttgggcgtgtgtagattttttagaatagccacagttttcgttggtggcactgcaatgactactaagtcaaacggcatttgactaatttccttgggttcgaaagccccatgaatcacaccaattgctaatgcatcacgaatattcgctggctcaatatcaaatcctaatacttcatagtccggtgcttgcctcaggcgttcggctatcgctgctcccatcgcacccaatccccaaattgcaattttaagcatgcattagcacctccatatctcgtttaaaatcaggatatgacacggcaattgctgcctggtcagcaatcggggcatcattgcttgtcagtaattgtgcaatcgattgcagcatcgcaatccggtggtcaccgtggttggataatgactcagccggtgcctgcaatcttgacaccccggtaatcaaaaaaccgtctggtgtcggcttaacgtcagcaccatacgccactaaagtttcactcacggtgttaatgcgattactttctttcacacgcaattcgccggcatccatgactcgactatcaccttcagatcgcgcaagtgctaacgtcagaatcggcaattcatcaatcatagtggtcacttcttctccctgaaccgtcgtgccgattaactgtgacacgctgacgacacggacatcagcaatcggttcaccgttttgaactcgttcattcagcaatgtgatgcttgctcccatccgacgtaacactttaacaatgccgaaccgtgtttcgttgacatttacatcctgcaagacaatatcacttcctggttgcaacgtcgcaccaaccagccagaatgcagctgacgacatatctgccggtaccgaaaccgtagtcgcaattagtcgctgatcacctgaaacaaaaatcatgccaccctgacaatcaactgtaaccccgaaactaggcaacatgttttcggtgtggtttcgtgtttgaaaatcatcaaaaacaataactggcactccggcactcaaaccggcaaggagcaaacttgttttgatttgcgctgaaggcacctttaacgtttcattaatcacatcagtcatgatgccacctcgaatagtgactggtagacacccatccgtcgttgtaatatcagcgccgtagccagtaagcaaatccacaattcgattcattggtcgccgactaagactggcgtcacccgtaatcaccgctggaattcctaaacctgctaatagaccaatcattaatcgtgtcgttgtccccgaattaccaaaattaaacacgatcggctcatcaaattgacgcttttgaatatcggcaatccccaagctatcaataataatgtcgttatgttcggtgataacgacatctacccccaactgttgtatgccatgaattgtttgacgtatgtcgtctgatagcaacggctgcatgatatgcgttttaccgaccgccatagcacctaagataatcgcccggtgcgtaatactcttatcgcttgctacacgtaattggccgtttaaccccttttgaattgtcatcatatttcctccagatacaaaaaaacgaatcgagcgccatgaaagcactgattcgtttagaaaaatatccagctggtcatattttttctatttcaaatcaagcgctttgatgatttcgcccgattcgcaatagaaaatgcttctatttcgggcacgtcgtgatcgacgtgcccggcacattaatcacgatgattagaaatagaagtaataagcattattaaattgtgagttgttaaatgacatagtctttcacccgtttctcataatttattaacaaaccaaactatacttgcttattttttattcgtcaaccccgatttttgggcaacaacttaaaaacgcgcccccaaacactgtccgggcgcacgcttttcactaatattctttattaatttgatttaaccaaaagaaatacatcatcggtataaacagagcaatgaagaacacaccaaagtaaaccttatatgctaacgtctcgttatacatcacaatcgtcaaaataactggcatgagcacgatttcttcagtaagtgcaatcaacgttttcttttgaacacgtcgcttagctacgatgtactcagtttcagaataaacatcctgactaacgcgacctttttttcgtaatgattgggctatcaaactaccggtcagtacaaaaacaccacccgcaatttgcaagccaagtccgatgttgtggtcagctgcatacatcacaacgtagccagtcaacagaattagaaacccaacaatgtactgcaccacattactaatcgccaacacgcgatacacttctttttcttgatattcatcaagatcaacggcggaagacgccgcccacataaccattttcttttcaacggattcccacattatatccacccctcaattacttaaacctgaaaaaatttataaactcctgatatataaaattaaaagccgcagcaaccaatacaatgagccaattagcccaccccatttgaccgtccatcataaatagtcctaacgcgacaacaactcccacaaacatcgatacgacagccgtctttacatgagaatgccgatcttcatcattatttttagtttcatacaccactgtaatcaacatgaacggcaccaagaaaataaacgccgccataaatagcggattgttaaaatccatgacctccgaccaactcacattgcctgttattttttgataaactaacgcacccaccaaaaataggttttgtatgaccacaaaaacggcaataactttttgcatctcaccccaaagccgttcatctacacgcttacctttcatgattcctacccctcaatccaaaacagtgcatccaacgttgtatccagcgctttagcaatcccaacggccaatttcaacgtcggattatacgcccctttttcaatcaaacttaaagtctgtcgcgtaacgccaactgtcgctgccagctctttttgtgacatgccagtcgcaacacgaactgctttcactttattttccatatacatttctccgaagaaaggtaatatataaattccttttgtattatatacattactccagatacttatagattgtcaaattaattcttaaattcgaataaccaggcaatgtaagacaactgatgtataaaaaaacaacgtaacacccataaagcgtttacgctgttttctgcttaatgttttgccataatttcaaaaatcatcgctaaattcaatcccagccaaagcaaactcatacctgggccgtacaaatgaatccaaaccgaccataccatttcacccatggaaactaaccacacccaaaacaacgggtcggtaagcagtttgataagtcgtctcatttattccttaactcctgtgccatagtttctcttcaaccgtttatggattaacaatccaccgattaccgctaaaccgattgttggccaaaacaggccattgcctgggataaataaacttcctaataatacaacaactgcgattactaacatcgttacatcaaatacaatactaggtttaatcccgcttttgaacccaacttcaaatagatgatcatcctgtcgccacttggcattttcgaaccctttaaacagtgcaacaaaaaacttaatcacccaaaatgtaacaacgatagctgacataatcccgaatacaacgcctaccaacgtaaaatttgaatttggcgaaacatcctgcgccaacacaacataaaatagctcgactaaaagtaaataaatataaaccaatacgcttcccgcccctcactagcattagtcaccatgctaccaatgttacatttagatttcaaacccacattcattttattgcttttatatttaattttttgccatttaaatgatatataaatctattttatttacattttaaggttatttaaatcggtttatttatcgtattttaaaaacttcattaacccctaaataatgtatgcactgtgattcagaaaaaacaccgcatcattgacacccacactttgtttagtatagtaaatattatctaatatattaaaaaaggagcgtttatgattacagatatcgtgggaaaccggctaaaagaaattcgccaacaacggcaattaaccctacaagaaaccagcgaattaactggcgttagcgccgcatcgctaaacaacattgaacgtcatacgacatccccatccattgatacgttgtggaaaatatcaagtgggctggccgtgcccatcaactattttttcgcaaccgatacagttgattttgagctggctactcctgctgattttcatgatattcctagtgacaacccaggagtgaaagtgcaatcaattttcagtaccttagcaaataccaaatttgaagtctttgacctcaacttatcttcgctaactgagcgtgagtctgctgcccacgtcccagggactgttgaagtactactggtaaaaaccggcacactaacaatggcgattaacggccaatcgtatgttattccagctggcagtttagcaaaattcaacggtgcctttccacacgtgtatcgtaacgacgcaaaggaagaaacatcgttcatcagcctcatgatatacgatcgttaggaggtcattatggcaatcaaagcaattttactgggtatcttagcggccctatttttttcgctgacttttttgttaaatgagatcaatctatctgattcaggttattggatatgggtcgccaccttgcgttatttatggatgttgcccatgattatgttgctaggtcgcgtaccacaactaaaatctgatttcaggcaggtttggactagcatgaaagaggcaccgagttactggtttatttggagcaacgtttgttttgtccttttctacgttcccctcacctggtcagcgcagttcataccaggatggctcgtttcaagtctctggcaactcaccattgtttttggtgtactaaccacgcccttgatgaccgtcacggacaattcgggatataagtaccgcctcaaaattccgggaaacaaaatcaaatggatggtcgtcatcttacttggaattggcctcacaaccgtccaaaccaatggcttcagccaggttaccccgatgttttggtttgccattgttgccatcattattgcggcgatatgttatccactgggtaatcgccaaatcggtaaccggtatccaaccttcaatggcttggaaaaagtttttgggatgctaatcgccacctatccagccttcattgtcctgagcattatcgggtatttgaaagctggtttgcctagtcaaggcacgctggtaagcacgttcagtgttgcgttgtcgtccggtgttattgccacggtgctgtttttccaagcaacggccatggcagcccgaaatatggaaaccttagcaacagttgaagcaacgcaatcatttgaggtgattttcactgtcttgttgggcttggtatttcttgggcacaccttgccaaaccatctccagctaaccggtttagctattatgctcttcggtatcaccggcatcaatttgtccggcaactggcgccttcgtaaaagaaactactcataagtaaagaacccgtcagcaattttacgctgacgggttcttttcctattttgtattatgcgccttgccactcctgctgaatcttggctaacacttggaattgcgtctcagttaatgttgcgaaatgcttggcaatagcatcatcatcaacggcagcttcaaaatcaacaatttcataccataaagcatccgcggtgttaccaagcgcaattgtctccatctcacctgtttcagtgtgataccactgggcagaatcggcacgtggaaagtccataatacggaagtatccctttgtaccagaaatcgtcactgccttcggttgcttagcttgcattgagttagtaatcgttgccatttcattatcttggttaaccaacaaggtcaccgactgttcatccacgccagtttcgaatggcaccatcgctgattttacaacgttaggtgcactggtcataaagtataaggttgattgggtggcgtatccaccaatgtccaacaaggccccgcctgccaagtctggattgaagaaacgattcgttggatcatatggcttatggctgccaaaggttgtgttgatcattttaatttgcccgagcgccccgttctcgaccgaattgcgcaggcgcttgaatagtggcatatgaactggtgtcatagcttccatcaaaactagtcccttttcctcagcaagtttttgaacaatcgcatactcttcgtatgacaccgtaattgccttttcggccaagacatgcttaccgtgttcgaaagcttgtttgatgaattcaaaatgtgtgttatgcggtgtcgcaatataaaccgcatcaatattatcatctgccagcaattctgccactgtgccataagtcgttggaatttgatacttatcagcaaactgcgccaacttctcctgattgcgtgcagttactgcagttgctggatggttgtgtgccagcaaagcagccgccatctcattggcaattgtacccgttccaataatcccccaatttaacgtcatcatagtacccccattcatttatgccactaacatatcacaagaaaaaccgttgataaaacagaagttaaaattcacataaaatcacttttgatttctgccatcgaacaaaaaaagtgaccagcaattgccagtcacttacgtcatctacgcctgtccagtttcaggattagctaccgtcttcgaatttttaggtaccctaatcatgaaccaaatggccaatgacaaaattaacaaaataatgtaaacatacaacacaacagtcaaattcccgccggccagcgacaaaataattgctcctgccaggctaccaaatccgaacccttgataaattaacgcgtaattctgactgtgatttttcaaaccaaagtaatccccaaccaacgatgggaacactgtaattgtgccaccaaaaaagaaaccaaccatcatcatcatgccataaaagaccggtgcagccagatgctgactcaaggtcaagaccaataccgcaaccaacgtcgcaccataagataaaatcagcatcggcttgcgaccgaatcggtcagacagtgatccgatcacaaatcgaccaaacgtattggcaatagcaatcaatgccacaaccgtcgtcgcacgttcaattgatagaccagccaagttagtcccaaggttggccgcaattcccgttaagtacacgctcaatgaaatcgtaaacaaggccacaaacaataggtacgcctgtggtgtgcgtaacatttctaacgttgtgaattgatgcttggccgttgtattagccgtttgggtttctggtgcatcacgcaaaaataatgacccaactaaaattaaaatcgtcactaatgtcccccagcccatcagcgcacgaggcaaattatttacgaggtcattacccagcaaagctgaatctacatacttaaacacaaatgagccgagaccataaaacgcaatcgaaatccctgaaataaagcccgttttctcagggaaccacttaatcgcgtttgataaagttgccatataggcgattccgtcagccgcgccaagggtgacgccagcgaatatgtagtatagccataattgcgatggtgaatgaagtcgcgacacaataaatgccgaaagtccaaacactagtccagcagcaaccgtcacacggcgaatgccaaatcgtttgaccagtttaccaacaaaaatggttgataaagccagcgttagcgatccaattgaaaatatcaatgacaccgaaccaaggtgtggttgcacagcagcaacgtttccttgcttgtcgagtgacaactccccaaacattttcaaaatcggtgtattaaatatggaccatgcataaaatgttccaactcctaattgcaccagcgcggtcccaaaaataactaaccagcggttatatccccctgattttacctgccccgtcataacaccctcctaaatgtaagcgctttctctctgttattctattctatcacccacttactaaatgtgtatatgtttggcatattttttgtgccagaaacgacaaaaaaacagcgtgaccactgtatttcacgctgtttttacttttgtttaattagcaattattgattgtctggtactttaagtaggccgtaaataacgcctgccacaactgcaccaatcgctacaaagagtagatataggaatggtgagttcgtcaaggcgaccacaaagataccaccgtgtggggcaagcaacttaatgcctgccaaaccaactaatccacctgccaacgctgatccagccacgaagcttggaatagcacgtgctgggtctgcggctgcaaatgggatggccccttcagtgataaaacttagtcccatcacaatattggtcaagccagcttcgcgattcttttgactaaacttacgcttaaacaatagtgttgccacgaaaattgccaacggtggcaccataccaccggccatgacagcagccatcacggttgagccgccagatgcaacactcgcagctaatgttccagttccaaagacatacgcggccttgttaacaggtccacccatatcaatcgcttccattccgccaagcaaagccccaagcaaaatagcattggtcccgttcaaaccagacaggaagccgttcaatccactattaatggctgacatcggaatgttcactaggagcatcaagaatccggtcacaagtaccccaaacactgggaagaagagaattgatttaattccgtccaatgcctttggcaaaccagcaaatagacgcttcatagccaacatcacgccaccggccaagaatccaccgaccaaagcacccaagaatcctgatggcactggttgatgactcgtatctaatccaacattgaaaatactgtatccattggctgcaagcgcacccgcgacaaacccggctactaaaccaggcttttcagcgattgaataagcaatgtaccctgccaaaactggcaacataaaattgaatgccgtatttccaatttgtttgaagaatgcggcggctggatggtaggttccaagttgtgacaaagcatcatgtggtacgcctagactctggtcaattaggaaggccaacgcaatcgcaattccaccaccgataacgaatggcaacatgctcgagacaccactcatcaaatgacgataaaaggctttccctaatgacatcttttcatcactcacacttgaagaagccgtctctgatgtttcgtaaattggggcatccccagataaagccttatcaatcaaggcctcaggatggcgaatcccttcagcaactggcacattgaccaaaggcttattagcaaaacgggccatttcaacctttttgtcagccgcgatgataacacctgccgcctcagcgatatcttgatcatttaacttgttgccaacaccactagcaccgttagtttcgaccttaatacgaactcccatcgcaacagcttgcttttttagtgcttcctcggccatgtaagtgtgggcgattccagtcgtacatgctgtcacggctactaacaacggtgcattttgattaacgcctgcgatatctgcgccaatttcttccggtgctgattcatcaaacaagtcacggacatcagctggggtcgttgcccgcatcagctgatctgtgaacccatcctgtaacaaaaaccgtgataaattagccagcgcctctagatgggtattactggcggtgtccggtacagcaatcataaagattaaatgaactggttggccgtccaaagcgtcgtaatcaaccccagctgctgacctggcaaatacaatcgtcggcttaagaaccgtggcgttcttcgcgtgcggaatcccaataccgtcacctaaccccgtcgatgtctgtgcctcgcgcgccaaaatcccctctaaaaactcattttcatttgaaatacgaccagtccgtttcaaaccggcaatcatttcccgaaaggctcccaccttatctgttgctcgcaaatccaaaatcatggtttcggctgctagcaaatcattaatgcgcatgattactcccccataatcaattaaatttcaactacttcaacattattctgaatctctttaattttcgccggcgtggcaatatcgtcgctgaacgtcgtggctgttgcactagcgacccctaacgagaacgcagcgaccacatccgcagatgttggccacgatgcaacgaatcccccaatcattgaatcaccagccccaactgaattcttgacttgtccgacgattgggcgggcaaaatacgtatgctcagctgtgaataacaaagccccgtctcctcccaacgaaataatggcattttgggcaccggcatcaatcaacttgcgacccgcggcttgtaaactaggcatactagtatctgccagattaaacagtgcctgcacttcgtctcgattgggtttaactaatattggctttgccggcaaagcgcgttgcaagtcatcaccagttgtatcgattacaaatcgtgcctgtttctcaagtaccagcgcaatcaattcatcgtacgctccggctggcaagctactaggtgcactaccagaaaatataacgatatctgccggtgttaactgatgaaaaacttgtttaaagccttcccattctgccattgtgaccaccggtccaggtgcattgatttctgtctcagactgccctttcagtttcacgttaatgcgcgtggtatctgcaattggcgtaaatttagttttcagaccaagaccatctaaagtacgacttataaattcgccggtgtagccgcccaagaaacctaacgccgtggcttcaaccccgttagccatcaatatccgactaacattaatgcctttcccacctggataagcaatcgcttttcctgcacgattcgtcataccgctttggtagttggctacctccataacataatcaatggatggatttaaagtgactgtatatatcatgattctccccctacgatgatatcggtttttgcctgataggccggagcggatgctaacgacttatcggtaatcaaagtaatatcagctaaatcactcaccttggcaaaagcgacgcgatcaaacttgctattatctgctaatacaaagactttattcgaccggttaatcaccaactttttgatagtcgcctcttctaaatccggtgtcatgattcccatgtcagtattcacggcatcagcacccagaaaactgacatcaaaggccagttgacctaattgctcggcagctgtcacgccaatcgttgcattcgttgacaatttaacttggccaccaatgataatcactggcaccatcaaatctgctaattgcgatgcgtggtggactgaatttgtaacgacctgaggtgcgggttgcaagttacctaataatgcaatcatggcgcccgtggttgatccagcatccaaatagattgtttcaccaccatgcaactctcgcatcgccgtccttgcaatgacttgcttcgccgataggttcatttcattcttctggcttaacaacgcttcatgttggagtgtctgttgttgtttggttagttccaccccaccatgaattcgttgtacctcaccagactcggctaactgatccaaatcacgtcgtaatgttgatactgaaaccaacattaattgttgcaattcttgtatcgaaatccgcccccgtttattcaacagtgccagaatcttgtcatgtctttccgaaatcatcatgttttaattacccgttataaaatgtaagcgcttccttttcagctgtaactatagtgttatttggttcgttttgcaacgtttttcatgcaaaaacattcattcacaatcaaaaaagagctatccaatatctttggatagctcaaattaacttatttttattcccagtgggccttatcaaacgttgctttgtcgccatgaacattaaaatgaccacgttctgcaacaaccttaactgcttcacgcaagttttctgtcacatcttgaacttgtgaaacatccatcaagaagtcaactagttcatcatcccaaaccagtcgtgggtcagcaccaaactgcaaccaaacactgtcactagtctcgtcatcccagtcactcgccccgtggtacggacgatcgtcaaccaagatgccgccaccataatgggcgacacttttatcgtgtgccattataacgcgtttgtacaaaggactatcttcacccgcaccaaaatagtgttgtaaccaaatgagtttatcttgccacgcacttggattatgccaaggcgcggttgatagaatgtaaatctcatactcattagccaggcgattaacagcttcaatcgcccctggaattggtggcaaatctcgaaaaatgcctggaatttgatccggcttaacgactgactctttgctcatatcaatctgatttaacacagacaacgtgtcgacaagcacattatccatatcaagaaatagtttaggttgcgtcatttttcactccataatcgttgataaagaaagcgcatacatttatttaggtaactttagtatatcaacaaatcatacgttgtctaccaactataatatccgaaaaaaagcagacacaccaaaaaaattggttacgtctgctttcgtctgagggaataactctgtagttataaaaaacttatatttgttgatattttaatttgagattgtgaaagacaagcatacgctagtactccctcagttgcggctagccgcaataatgctaatcggaatcgcaccgattagcactcatattaagcttcttgatttagttcaagtagcaaacgataaatcgcaccatacaaattagcatcattgccgaatttaccaggcacaatatcgacatgactaatcatgcgattaatatacggatttccattgtaaaaagactcgtatgcttcacgaatagttgccgtgacaatcggttgggctgaaataccaccaccgatcacgacccgttcaatgtcaaccgttgcttgcaaattttgaatctgcaacgcaattgcctgcgcatattgattaaaaatgcgcgtagcttgcggataaccagcgttgatgaactcaaacactttttctccatcatgaacatccggcaactctaattcagtcgcgatttccttaatcatctcaaccgccgacccagtaaacccaaatcgtgatacacgatctgtggtaattttatggtaaataaatgacaattcaccagcttcataatgagcaccataatgtaactgcccattaattacaaaaccaccaccaacacctgttccaagaactagtgctaaaccattcgcaaccccttttaactcacctacccatagttcagcaagcgcagcggctttcccatcattttcaatagctaatggcaaatctagttccaacgccttctttaagtcgacgccgtctaaaaacgaccacatcactccggcgtgaatagtgccagtatcatgattgacacgaaccggcaagctaataccaacacctcgaatatcgtcatgatacaatgcgataatcgcctgtaattgcgcaacaaatgactttaaatctcgccgattcgttagttgattaccacgttcaaccaattccccactatgattaactaaaccatatttaactttggtaccaccaacatcgatggccaaataatgattttccatgtttatccctttccttcacgagctgtctcacccaatttatcagtatgacgctcatggcgaattgtggccttcataaaggccacaatggccaataacaataacataaagctaataatcacgtaattagcaatttcacttgtttgattaaaccaaccgttcaatgccttaagcacatatgggcttgctgacacaccaacgttgatccccaccaacatcattgttgatcctaacgtctgtgagaccgcgtttgtctcagctgctaaattactaaagattcctggcataaccataccaaacgcaaatccgtaaccagcaacggctacagctgatacgataagtgactgactctgaatcaagatgaacaccatcgccattgctaatgttgcgccaatcgcaatcgagtagcgccctaacaaacgcttaatctggccaaataacaatgaagacaagaattgaaatgctgttacaagtcccgtgacaaagctggcatccgcagctgttccataacctcgctcagcaaataccggtgccatttttaccgtgataccaaagtatgccgtaaaccagaagaatgcaaatagtgctgaaaaaatcatcgccccatttacgcggacatgaccactcgcagtgacatgctcttcctcaaccactggtgtattatcaggtactaacaaaccaaacaagaccaatgggattgctccaagcgcgtacacaccaaacgcggcgtgccaaccaccacccattaggaacccaacgacccacgtcagcaaagttgttaccatcgctgcagccgcatctcgatagccaatcaaggcatcacgctcatgacccgtgtaatacatcgaaatcaatgagaatgataacgaattaaataatccgacaccggcgccaaatagaaaacggctcgctagcataatcgtatagttctcggtaaacatcggtgtaacacccgcaattaccgaaaccaataatcccagaacgactgttcgtttatttcctattaatcttgtcacaagcggtgacaacaaaacaaatatcaaaatacctaaacttgacacagacatcaataactcaatgtccgtttgcgagtgcccacccaaagtttgatgaatcaatggcacggttacctggacggctgctgccgcatttgttagcgttgcaatcgatagcaacgctactttaaaccaaaaactatgtttattcatattaatcattactccccaaattaattcctgttttacagatgtcgaccaacactaaacaatgttagaacggccaacataatcatgaaaacgttatataaaatcgccaacattttaatcgacaaacgttgacttaacgttgtaccaatataaccaccgataatcgctataaccgcgagccacggaacaagtcctaaatcataccggctataatcatttgccatcacaatggtatagattttagaaagctgtgagaaaaagatacttgcgattgaataaattgctgcgtcacgcagtgtaaaaccaaaacaaattaccaataacgagacgttcagcggaccgccaccgatggccaaaaaaattgatattgccccaaaaaacacccccaatccaaacgatgatagccaatgtggcttttctacatgctttcgttgtggcatcgcccgtgtatagatgatcaaaaaaattaacgtcaaaaacaaaattatggactgcgttaactgaactttattttcagggaaataacgcagtaataccgtcaacaagccatcccctatataaccgccaactaatgatcccactgaaatttcaagcaacattggcaagtcatacttaaaacccgacttaatttgcttaacaatcgatactaaacacatcgtaaagacaacaacggttgtgtaaaagctaatgacttgtactgaatctggcgagaatatatctgtcattgcttttagtacaatgccaccaccaatcccagccaacgctccgattaccgttgcaataaatgtcgcaacaacgtacaaaacattcagcataaacgcctcattcttccgtcaaactacgaccattcgtcgcaataacacgttggtaccaagcaaaagagtccttcttttcacgctgatacgtaccgttaccgtgattatccacgtcaacatagataaacccataacgtttgtccatcgcaccactacttgccgcaattaagtcaattggcccccaagcggtataacccataacatcaaccccatccaattcaattgccttttcgacttcgagtaaatgttgtttgatgtaatcaatacggtaatcgtcatggatctgaccatcggcatccttatcgtcataagcacctagtccattttcaacaatcatgaccggtttttcgtagcggtaatacagtgtattcaaggcaaaacgtagcccctgcggattaataccccatccccaatctgactttttcaaatatggattggtatagcctgtctctaacccgttcaatcctttcaatattccttgtgtcttctgacctgtcacgtgggtcaaataataactaaacgacacaaaatctacggttcccgccgctaaaatatctttatcgccggggtgttctgggagcacaatatgcttacgatcaaactcttttaacttgtaatttgggtatttaccacgaacctggacatccgcataaaacatcatgagtttttggaaatcctcggtcccttgtacgtccgccggatcaggactattagggtacgaaaagtgtccattgtacatcatcccaactttattcttgtcatttagttcatgcgctaacttaacaactttcgcgcttgccaaaaattgatgatatgccgcttgcatcttatcgttctcactggcatctaagctaataccaccagcgttccaaggcatcgtcgacatattattgatttcgttaaatgttagccagtaccgtacacgcccatcgaaatgacgcaatagcacctctgcataacggacaaacaaatcaaccacttcacgcccttgccaaaatccgtatttttctaatcccatcggggtatcaaaatgttgaatcgtaaccaacggttcgataccgtatgacaaacacaaatccacgattttatcgtaaaactccaaacctttttgatttggttgggcgtcatcaccattcggaaagatgcgcgtccacgccattgaaaaccgatatactttaaatcctagttcagcaaataaggcaatatcttcttcgtaatgctcgtaatgtttgatcgcattgtgtgttggataaaacttatctgaatcaattgcatcagtaatctcacgaggggcgccgttttcggctaacgtcatcatatcggctgtactaagccccttaccgtcaacatcataagcaccttcaatttgttcagctgaagtggcgccaccccagaggaacccagttggaaaagccataggtatttaatctcctttattgctaaatattttgatgcaaaaagaagtataacgaggcacaacacataaaagatagcgctttcataccagttggtacggtgttgcaaaattataaagaaaacggttacaacatctgcaacactgttgcaaaaaaataagggaatgcctatcattcccttacaaattcttattcatcatcaatcattggattatccgtaaatcgatgttcctgataacggtgttcaatcaccgtcttattttcaaccgcctcaagatggcatgagacataatcagcataaagtacatctaaaatatagctcaccgcaattcctgtactgaaattaccataattttgaattagtcgttcatgtgtgctgataggtagcacaatatcagccgcccgggacagggtgttcttcccaaatgatgtaatggcgattatgttgacactgtagcgcgaaatagcgtctaagacccgatatagtgatcgcgtttcacccgaatatgaaatcagaataaatacatcctgttcagatgtgtgttgcatctgaaactccatcatgtctgttcgttcaatcaccgtaactaaccgcccaactctggtcatcttatttgcaaataactcagccattaataagtgatctcctgaagaatatataaatatccgattagccccgtcgagtaaggcgttggccctttctaagtcccgataatcttgtaaaccaagcgtgttgtccgagacttcagcgtacatttgtcgaacggcattggctaccgaccacatactatccccacgtttaaacggcttgttaacatccacatcttttactgactgatccaaatattgtttctctttaatgaaggcatctttaaaatccggaaatccagaaaatcccaatctttggcaaaaacgtgtcactgttgaaggtgaaacaaacaaagacgctgctaattgtcgagctgttagggcagccacatctaaacgttcctgcaaaaagaaactagcaagttctttttcagaatcgctcataagctctgtatcttctagtgcatccttaatcagcatctgaatcccccttgctttttgaaaacgcttactttattacagcataacataccgcttacccttgtacatcgaattcctgagaaaatcccgcgcaatttaacaaaaattgatcaccacattctctcctttaactagctaatctataaaaagcatgctcttttatacaaacaaaaactgcgaaagtgtagactctcgcagtttgtagcattcctattgtttattgtcgtagtaatacgcccggaaatttttcgccatcatgaacaatcagttttctttcggattaactgtcaccttttgaaatccaaacgacagctttttcaccgctcttttataatctacaatcgaaaaatgatttgaggtacttaaaatatcgaattcctgattgctatcttctataacataccccgtccgcataaacccattcttttgataaaaactcagccgcttagctctttggtcagcgttatcagcggatacgtcctgcggttctatgttcaaaacaatttcttgattcggattttctctaatcaactgctgaagaattttcgttccatagcctctcgatctaatccgcgcgttagttgcaaggtacaacacaaaaattgtattctgcgttttcgttgtatagatcatgcctactatttgatcatcgtcataatacgctgagaaagagattccttttcgcaatgttaaaaactgcaaataccaaagtggtaactgttcattagctggaaacgcttcatgatacatttttaccacagattgatagtcaggcaatgttggtgtaacccgttttttctgtaacatgctgatcccccttattcttgtaagtatacaaattctttatcaacatagccacatgataatccggttaaataaaaaacgacgaaacattaagtttcgccgtttcatctgatgggcctagcaggactcgaacctgcaatacccggttcgtagccggggtgtttatccaattagcatataagcccaatatttaattcgttgcctcaacaacataattaaatatacgccctttgtttttgtttgtaaagtctaaaacctcaaaaaagtaattatttttttgcaggccgttatcctagacatatttgctaccttcacgaattgataatggcgtcatttcgctttcatgggttgcaataaactcacgcacccaaccaggatttgttttactatactgacgtaatgcccagccaatggctttgttaatgaaaaactcggacgaaccaaagttagcagttagaatttccgtcattaacgctgtatccgtttgatccttcaaaaacaattgataaagaatcgccaaacgacgcacccaaaagtcatcatgtcgactccaagccaacatcgctgcttttgtttcaggatacgtgacaacaatatggccaacttcgtgcgccatgttatcaactgtatcccaccatgacttacgcatcgccaatgcttggaaacgcgctaaatcatcaggacccaacaaatccatctgtgctttcaacatatccaaggccacatattggtattcacgggcatcttgttcccaagcagcctctacaaaatcccagtcaatcacgcccttttgcttggcggccttgataaacggtttggttaactctcggcgaattggtgttttaattcctaaaaacggaaactgattgcgttggtacgcagccatccccactgccgtttccgggtctgcatgcgccttaagtagatcaaatatttcttgcatagcgcacctccctcgcattattaagcacaagtatagcaaaataaaacacccagcctcgtatccaaacaaagttaggtgttaaaagtcatattttaaattaagcagctgcgttttcaataacggccaaaacattcgcacggtagtctgatgactcatcattcaaacggcacatttcgtagtaggcatccttgtagtcaaaaccatcacgacgcgttgcagcgtaaaccatcaacaagttgcaagcatcttcagctgaatcaagatcacgtagcgtctcaccggcttcgatagtacggatatctgacatgtagtcttcgtaatcaaacgtataccatgtttgcatttgctccaaaactggggcagcccaaccttcttcacgaacaacagatgaaactgtttggcccgcacgcaacttacgtagcacattgttaaagtggttgtttacattaataatattcgtcgtcatcacagcagtcatgtcgtttacctctaaatcatttttatcaatgcatttactatagcacgaacttgtgaaaaaaggaacaaagaaacacccaaaacgccagtgaatactcttacatagccgttttattttgtgaaaacgttatcattattgcgactttgcgagcttttcagcaacgcggtgattgattttagctttcacatcgtccgtccaacgtgacaaagtagtgaacacaaaaaacgtgcctagctcaaaagctaaacacgttaatcaagattacttattctcttcttgcaattccagcaaacgagcacgcaaagcatcatcgtatgccgtcaagtacaaaccatacttaccacgcttgatcaagacgttcaaaacgttggcaataaaggccttatgttcttcttccgtgaacttacggtcttgacgcttcttgaaaatttccttgtgagagtacttttcaggaataatcgtcacgctatccgtcttaggatcgtaaccaaatgaaggaccgataatcatccctacataattcaaatcaaatccttgcaacgtataaatcgttccgacttgcgtaattgaaccctcacgcttagcccagtgcgtacgttgtggatcccactcgtcccaaggcaagttaaacgtatccatttcaacgttgtggcgtccatcaatacgcgggaatcctgacgttgcaacaacacgactttgaccgaattctttgttcttcgccttaatggcttcgtacaaatcacccgccttgtcaaagaccttgaattcaaaatcagaattgtttgggaatgggtgcaatggcttttcagatgtcaaatcatccatccagtccacttgttcttggctggccaccatacggtattggaagtccatgtcgaattggtggtatgggtgcttgccaatcgtcttaaatagcaagtccttgtcccagtacatctttgattggaacacttgggcgaagtcgtaaaccacgaccacaaccttagccaaatccatcaagtcctgcaattggttttcaccattgtagtgcatgtatggctctggctttgacaatagcaagtgcgcttcgtcaacgaaaataacatcgtacttccagttacgcttttgcgcgttgttaatcaatggcgtaggacgcgtaatatccttgtcgcgcatacctggaatatcaacggccaaatccttgtaggccttgaatagctcagggtggttaacaactaacgcagtcttgtaacgcttgtcagtcatgtacttagtaaccaggttcatcaaaacaactgacttaccggtaccagcagcaccttggataattgccacacggtgatcgttttgcttcaaaccatccccaatgtaggcgttcatgttagaaataacggcttcttgttgcgctgatagattatcaacgaaaaattgttcttgtaaaatcttattcataatgctttcaattatacaacgtgcacgcgcattaagccacgaaccttcctgacaaaaaatacatgtacatttatatgccatttctagcacttcgtccctgataaggcattctctagcttcacagtcatgtgaggctttttattgcataaagccttgcaccttcgtctgattgcggtatactatccttgaactggtaagtaatcacttacttaccaaatttacacaaaggataatatgactatggctcaagaaattatcaacctatctgacgtcaaaaaatcgtttggttcgcagcccgttttaaaggacgtatcttttcaagtccacggtggcgaaattgttggcctaatcgggccatcaggcgctggtaaatcaacaatcattaagattacgcttggtatggaaaaagctgatggcggccaagcaaccgttttcgacacagtgatgcccaatcgtgaattactagctaatatcggttacatggcccagactgacgcgctttatgacgctttaagtggtcgtgaaaatctcgctttctttgccaaaatgaaaaatgtcaccagcgatgtcgtaacagaaatcaatcacgttgccgaagtggttgatttgaccaatgacttagacaaacgcgtcagtggttactctggtggcatgaagcgtcgcctatcgttggccatcgccctgcttggtgcacctgaactactagttctggatgagccaactgttgggattgatccatcattgcgccaaaaaatttggactgaattaacacgcctacgtgatgaaggtcgcgccattttggtaaccactcacgtcatggatgaagcggaactaaccgatcgcgttgccctactacttgacgggtctgtaattgcaaatgatgcacccaaggcattagaacaacaatacggtgtcgcttcaattgaacatgtctttttgaaagcggaggcccaacgatgaaaacatttgcaatcgctacacgcgttttaactgaattgattcgcgacaagcgcaccctcgccttgttgtttgtggcgcctctactggtgctcgcactaatgagctacgtctttaacgttaataccacgacaacaagttcaatcgcgacagtccaagtgcccaccgccatttacaacaaccttgatgctacaaaacacgtttctgttaaggcttatgattctacggcatcatctaagaaggctttggaagctgaacgcgttgatgcaatcattgattattcagataacacctaccatgtgacttatgccaacacggatgtttccaaaaccgcattagcgaagatggccttacaaggcgccatcaccaaatcaaacattaccggcatggcggatgcgctaaaagctttagaagctaacttgccggccgctgttcagacaaaaaaagtcgctgcgcaaacaccaaaaatcctgaacacctacaattacggcaatgccaactcaactttctttgataagatgatgccgattttgatggggttcttcgtattcttctttgtctttttgatttcggggatggccttattgaaggaacgtacatcaggtacacttgaacgtttgctagcaaccccagtgcgccgtgctgagattgtctatgggtacttaattagttatggttttgtcgccgttgttcagacattgttaatcgttttgtttaccatcaacgtccttaacgttcaagtcgctggttcgattttcttagttatcttaacgacccttttgttggcattagttgccttagcgttaggaattttcatgtcaacatttgcacaatccgaattccaaatgatgcaatttatcccactggttgtcgtgccacaaattttcttttcgggcttgattgatttgcatgctatggccgactgggcacaatggctagctaacttgttgccaatgaagtacgccgcgtccgctttgaccgatgtcatcctcaagggagccagcttctctgacattgccggtaatttgcttgctttggtaatttttattatcattttaacgattggcaacattgttggcctaaagcgttatcgaaaggtgtaatttaacatgactgatcaagttttaagttttgatgaatggctaacaactactgatatgcctgatggcaagcgtcgtattctacgtgctgcagtaagtctattcgcacaaaacggcttccatgcaacctctacggcagccattgctcaagaagcaggtctcagtgatgcgaccatgttcaagcactttaaaaataaaaacgcgttgctggatgcgattctggcaccactccttgaacaactagtgccaaatgtcagtgagcaattcgtcacatctgttcaagataaagcaaccaccattgatgatgttatcgcattcatcgtgtctgatcgttggtcattcatgcaacagaacaaccaagtgattcaggtattagtaaacgaggccctagctaatacgactcttagagaacatatgattagcgaaatcggcccaaagttaggtcatgtgacgacaattttgcaaggcctaatgcgtagtgattcatctattaatcctcagttaacgggctatgatttgcttcgcattattgcaggtcagctgatgattcatttcatgtcacaatataagttccagacccaacttaataatgaaacggtactcgcgaacgtcaccttaatgacccaacaagcactgcgttaacagaaaaaactggtaaattcgccacaaatgggtgaatttaccagttttttgttttcattaccaccaggtccagacataatcattctggacggtctcaattactttccacaaatagtggttaccaaaataccaggcttcgatgtacgcagcgagtgttattaaagcaatccagattgtgtccttgccaccattccgtgcacgctttctaaaatatctagcattaaaccagatggtcacaagtaatggtccgaacaccaatgcaactagtaacaaaactagcaatatcagtatcaacatccatatgaagtcattaccacctttgacatcccatatcggattaatcaaatgccaccaaccatagaaaacaaataacatgtaggcgggcataaagaacgctgtcacaacgtctagtatgataagttgtactgttttactcttcatccggttatgctcacaattccttggccatcaagatatctgtttgtcgatccgtgcccatgtagaaatcatgggattcaccagtctttaagaagcccatcttctcgtagaaagcaatcgcatttgggttgtactcccaaacaccaagccaaatgcgatccttattcaactcatgggcaaccttttcagcctcagtaatgaagacgcgtcccaatccacggcgttggaaactcttacggacatagatgcgttcaacttcgagggctgattcacccatatcttcagactgggcatccccaacattcaacttcaaatagcccgcaatttcatcatctaccatcacaaaataaaataatgactcggcattttctaattcttttacaagcaccgattcttgatatgcatcagccaaataatcacgtaaattttcaggtgtgttttgagcaccgaaagtatctgtaaacgtctcgattgaaatctcacgcagctcattcacatcagttacgcttagtcgcttaagtgtcgttgtcatatttctctcctaatactctcgttgatggactttcttcacggcattccagtcagttgcaacattctcacgcattcggtgcaacaagctattcagtgtttgcacttcatccgctgtgaatccttgcaacgctaccgtctctgaataatcattttcacgtttgataacgtcatacagttcacgacctttatccgttacttccaaatgcttaattttcaagttttctgtgctgtctcgcttcacaatcataccgtccgctagcagcttcttaacggcacgcgcaacggttgtacgatcaaccataatcatctcagacaattcttcctggatgataccgggattctctgcaatgcgggctaaatacaagtactgacccttggtcaaatcaaaggctttgaattcaacattactaattgaatccaaagctctggcaatcatgccaatttctctcaaattactcgtcatattgttatcctcatgaactatcatatcttgtttttgttgtatatgcaacaaaacgcccgttaatgacaacggacgtcagagtgttataagttcaaaatatgtggaattgtgccggtttcaacaatgaccaacacacctagtacgatgtaaacaaacgccgtgatccatcgaccaaaacgttcaaacacttccccaattttcggaatcttcgccaaacgttgactgatgaaagcaagcagcaatatattaatcataaatgttgccaatgccacggctaaccgaccagctgataaggttgccatataaggtgtaaataacccgatattatctggtaaacagctagacaacgcaattatcatcatcgtcaaaatgagcgacttgtcttcgcgttcttgcgcaatcttgagtgcattttcatctgcctcacatgccgcaaataagtaacgaataccgaacgcaattggcacaaaccccaaaaatccaagcacccaatccgccggtataaatttaaaaacaaacgcaaacagcatcggcaccgttaccaaaattgttgatcctattacctgtccaatcaaaatctgacggtgttctgttttcctaggatacatggcaaataacgtcaacaaaattaatagcaagtcgatcgcagtcgtccaataaagaatcgtcgtagacacgattgtgctaaccatctgttcatccctttcctaaacatgaaaatattaacatgtttaatggagacgatttctcatcactcacctatccggtatgactttcaggtacgtggcaaaaattttcttgtatgcaaaaaacgtctacgcaagtgcatagacgttaatcgttaattacaaggcatcatatagttcgtcagaaacgggctcaagccattcaggtgttcccgcggtaatcgcgatgtgctcaaaccaactgtccttctttgccccgtgccagtgcttcacgccatctttggtcacaatcgtatcaccagcttttaatgattgcgctgattgcccttcttcttggtaccaaccttcaccagctgtgacaagcaaaatttggtaaccatcatggtgaatgtgccagttattacgtgaacccggctcaaatgatactgatccaacaccaattttgtcatcgggtgacgtcaccaaattcgttagatacgtatcgccaacgaagaattcaccgtatggattcaaaacaccagccgggaaaatcgttccttgcttaatctcttcgtactttgccattacttttctccgaatacttcttttgcaatgttaaatgctgaccacgcctttggccaaccaacgtagaaggccaattgcgtaataatttcggccacttcatcagcagtcaagccgttatccttggcctttgccatgtgaaatggtaattgctcaaaagccccagttgaaatcaatgccgtaattgtcgttaatgaacgatcacgggcggagaattcagcttcacgtgaccagacttgaccaaacaatacatcgtcattaagctccgcaaactttggtgcaaattcaccaagttcgtcatgtcctgccgttactttttccgtcatgataatcacccctaatccaaagtgccaccgtaaactgggaacccactaaattcaccataatcattaaacgttactttgtttaacatggccatatcgtcatcagaaatcgtgaagtccactgttgcattagccgtcatgtgtgcttcagacgttgcttttggcaatggcaatgtgttcagttgcaataagtagcgaatacccaattgcgcaacggaaacgccgtacttattcgccatttgttgcaagtttttgtttttcaacatttcaccgtgaccaaatggtgagtaggcttcaatttgaatgtcatgcttttgggcgtactcaaacacgctaaatggtacgttaccaatgtgcgccaaaacttgatcaaccgccggcttcacatcactgttatccagaatattctgcaagtcgatttcatcgaagttcgacacaccgatagcacgaatcttaccagcagcttgagcttcagatagcgcacgccaggctgccaaattcccttcaaagaaacgctcatcattttggaattcaacccaaggttttggtgagtgaataatcatcatgtcgatgtaatcgagattcaaatcgtttagtgaacgatcaattgcagcgactgcctcttcgtagctcttaaattcagcttgcaactttgtcgtgacaaatatgtcttcacgtggcacaccggcgttgcgaacaccacgacctacaccaatttcattgccgtacgcttcggcagtatcgatgtgacggtaaccaactttaatggctgtctcgactgccttggcgacatcatcattatcttcaatcatccaagtcccgaacccaatcttcggaatcttaacgccattgttcaaagtataggtttcatcaaaaatcgtcatactaatgtcctccgtttatttaagaatcacacgcaccgttgcatttcgtggcccgtcagcaatcatcggtggcatgtattggctacccgcgtatttcgtccggtaagcgtcatcaatttgatcttgcaggccttcattacctgtaactggcaccagctcaaatgctaccgtgtactcatcaccagcaatcataatcttgccagcgccttggtctttagcggcgttataccagcgcgaacgttgtctgttccaagcacgtacatagagttcgccgttgaccacaacagaccaaatccacgttaacgtgccaggcgttttaccgtcggcacgataaggcgcaatatgaaaatcatcggcctgcgcaaacatttcttgttgtgttgctgttaatgtcatcatttccacctccactactttatgccttcagtatattgcgctataatcaccattaccaatgctttctttttatgactaactataacgaaaggtaatgatatggaactacgtgttttacgatattttctagaggttgcccacactggtacacttaccgcggcagccaccaaactcaatgtgacgcaacccgctttatcacgccagctaaagttgctggaaactgaattaggtgtcacacttatcaaccgtgatcataaacccgtttccttaacccctgagggcatctatttggcaaagcaagccgaggacttaattgctatcgctgataagacagtcaccaatctacagtcaaaagacgcgattgccggtgtcatcacgattggtgcagcggaaactaagatgttcaaccacgcaattaaggcaatttcagccatgcaacaagcttatccgaatgtgactttcacggtcatctctggatccacaactgacttactagatcggcttaaccagggcgaactagatttccttttcgcgctcgatttcacccaaaaggcctcgtacgactatctcgattttccagacgaagatgtccgtggcgtattcattaataaacagcatcccctggctaatgaatcagcaattaccgccgatcagctcaaggaatacccgctggcaatttcacgtcaatcctctttcaacgattcgctagtggaagaacttggcctcaatgcatcagatttgaacattcgcctcaagtacaacttaatcggcaatgccgggatgtatccaatgattgataatcaaattatgctcgtaggtatcgagggtgttatcaacattcctgaactacgcttcaaaccattttcaccaaaaaacgtttcagttggctcaatgatttggaatcacaccccattcttgtcgccgcttcacgaagaatttattcgttctctagaagatgaattgacgaacacacctcgtgatatgtcataatagcgagtacaagggggaattaaacatgagcattacagtaaacttgtactacactggtgaaaatggtgcagctcaagcattcgctaaagaaatgaccgaatccggcgttgtcgatcgcattcgagctaccccaggcaacgagcgttatgaatattttcaaccgcttgatgacccagaaacaatcttgttaattgatgcatggcacgatcaggcagctatcgatacgcaccacacgtcaccaatgatggctgaaattgcgcaattacgagagaaatacgatttgcacatgcgtgtggaacgcttcattagcgataaggacggcgtgccggcatctgaccagtcatttattcgtaagtaaaaaagcgagctctagtagctcgctttttatatttgaaaagaacttctccagagcagtacgtcatctgccaaatacaggaaagacaggacctcaaactgctttgtaaaactcggcgtcgtatactgcaggtggaggtcagtatcatgcaacatgcaacgcaattcgacgctacttatgatgaaacatatgacacgatgcccaacggcaacatccaatttgaattgaccggtatttggcgtccggtgtgttatgacaaacagtcaaacatcctgacgttctgctctgttacccatcccaaaaaatatccaaaaccaatgacacttttcgggatcaaaaaacttgagctgcagacagcttctgttcgcactgaacaaatcacccaattcaaagatcaaacagaacaagtttttggtgagcacggacagcttgtgcatatttttatgcaaaaaacacacggcctaactcctgagcaatttcgtgaacagttttctaagatgccaaccagcattggccctggtgatattgattggctcgcgttgttagatgaaaatcacgcctcgctaaacaaactcaccttcatcgaagagttttggtaccgtctctttctggggattgcttgtgtgtatcataaccacaattggattaactacgataaattcaactatgatgaagcctatcgttatcgtgtgtacctggttgtcaaagaaatggtctgctcgacatattttgaatattcggaacctgatccattcacgctaaaactgctcatgtttagtggcttggccattaccctgaccctgactttggcacacttgattcattttaagccagttggggatgtctcaaattggacgttttatctagccggttttatcatcggaatatccttaatcatttttgcgacaacattatggattagtggtcgtattcgctcgtcctcgaccatgcgtttagaccatcaactatatgcatggctgggtgtaccaccatcaaacatcaccattccactccaccgcgccagcaagaaaaagctggtggtgactaatattacggcataaaaaaagagcgattaaatcgctctttttcgtctacttcaataattctgcttctaacagttgcacggccgcttgcacagcatcccaaggtgcaccaacaactggtgaatacgtcaaatctaaatcgctaaacgcttcaaccgtcatgccattataaattgcagttgcaaagacatccgcgcgtttcgccacttcgctaccatacttacccaccaattgggcgcctaaaatcttgtgtgacactttgtctgcagtcacacgaatcgtcattttttcagcacctgggaaataacccttgtgatcatctacgaccgcagttgtcgtgattgccgtaaagccagctgcagttgcttcgtttggcaacaagccagttcgagcgacaatcacgtcaaacgcacgcaaaacctgtgagccgatgattcctgcaaagtgtgactcacgacccacaatattagcaccggcgacgcgaccttgtttatgcgccgtcgtacccagtggcaaatatgtctcacctaataagcggtgcttggtctgaaccaaatcacctgctgcatacacatcgggcagatttgtacgcatttggtcatcaaccactaccgcgttttgatcagtaacggtcgcaccagcattaaccaacaactcactgtttggtcgtacacccacaacaaccaagacaaaatcgaatgcgtcatccgtcgttgacccgattaggtggtacccggcttccgttgtttgaatttcagtaatcgtttcatcagttaacaccgtgacaccattatcggtcaatgcatcatgcacaaaagcacccaaatcgggttcaaccgtcgataacacctcagccccacgttgtaccagcgtcaccgaaacatcacgtcgtgtcaacgcctctgccatttcgatacccacgtaacccgcaccaacaattgctgcgcgcttaggttgatgttgcaccaattgtgcttcaatatcaaagaaatcgcccattgtatgcaatacatgaataccggcgccttcaccagcaatcggcaattcctttggcacagccccggttccaaccatcaacttgtcgtacgtaaatgtcaattggtcgccaccgcgcatcgcagtcacggtgtgattcgctgcatcaatggccgctgcccacgtattcatgtaaaaatcgatgtcatacgccttcaaatcatcaaccgttcgatgcgctaaattctgccactgggtcacttctttactgaccgcgtatggaatcccgcaaattgacaagtttgggaattcatctgccaaaatcattgtgattttaatcgtgccattcagttcacgggcgcgtagtgcagctgaaataccagcatcacttccaccaatgatcaacatctctgtctgtacgttggtcatttaatcgtcctcttattttctaatagtaagttaattatatgtaggagaatccaaacgtgtcaaacacaaaaagccagcagatgattaatcacctactggccgaatgttatttctagactaattgaattaatgcaacaccgacaaccataataatgatgccgagaatttgcatgtagttaacgcgctttttaactgattgataccagccaaattgttgcacgatgatggttccgattaacatacccatcaaaccaaggatggcacccatacccggtccaagcactggcacaacgattccaatgaagaacacgaatagtgatccaggaataccgcccaggaaggcccaccatggtgctgccttcataccttctcgattaaagaatggtcgttcttttatggcaactaaaattgttagcaaaatcaacgcaccaacgaacgacacaaaggcaccatcaactggcgcacccaacaagtgacccaagtgtccggtaatggcttgttggaatgacgcgaacattcccgtcaaaattccccagacgtgccagaaaattgacccggttggcgctgatccgttcttgttttccaaacgcgcgctcaagacaaccgcaaccaatacaccaatcatcaccaagatgacgccaatgaccttcacagctgtcaacgcaaccgtttctgcgccgacccaaccaagggtttggatcatcattgacatcacaacttgccctaacgttggtaggacaaccgtcttaaccgcaccaacattcttgaatagcaaaatgtttgatgtttgataaagcatcgagaagattcccgctgagtagacccaccatggttggtttgtcttagttaacgcaataatatcgcccaagaaatgtgggttttgaataaatgcaatagctcctaagaaaatcacacccagtgaaaaactcaagaatgccgcgcgaaatggtgacttcaaagcaccacccaaacgcgcgttaattgggctttggttagaaaccgcaaagccacctaataatcccaaaatgtaaaacattaattaactcctattccaattcaatctgtattagccgttctgtttcttagcggtggtatgacaagagtgcctctggcaaatccagttgtaacttaccaaccatgtaagtactcaaaatgcggtactcaacaccgtcaatacgactcgtttcatcgtacatttgccacatcatcctttcacctacgctaatattcgcagattcatcgtaggaaaccacaaccaacttcttaccgtcatactcatacaaatcaagtccgactacgtaatcgttaattgctggtgcagcgtgcaagtattggttgatcttttcttccaagtttgcatcagatgtattggcatatgaaccatggctaaatgattggcgaatagtgttaattgcactaattagaatgttattcatttttatgacgtccttactctcgtgtcttaaattcttaaatgtcgataacgaatttaacgagtgccgacgtgtttacttttttaacgtgtacacagcatcgacactatgctgcgcatccaccaggttgttcagaacgcatgttgggaaccctccacttattttttgcaagtgttattatgcgctcatttaaacgttttaacaagatgcaagtcgccttattggtattgaccaatcagtcgcttatcaacgatctgccaaacatcagtcgccacatcagccacaagctgttcatcgtgcgaaacgaacagtacagcttgttgggtttcttgcagatatgccgttagggcttctaaggctggaatgtccaaataattggttggttcatctaacaccaacagctcactcgtctgtagtaatgcttttactaaagccacacggactcgttcaccgccgctcatttgaccaaccatttcattgacctgcatcaaacgaatccccattgcacctaagaaatcacgggctacctgttcagactcggtgctggtcatcatgacattttgcagtgccgttttcgtcgtatctagctgacttaaatcctggttagccacgcttactcgcagattgtaagcatgtgttgcgccgggtgctcctgataacaagtgctgaatgagcgttgatttaccagacccatttggaccaacaattgccacacggtgcccggtttcaattttgaatgtcacgttctcaatcaaaagattatctgcttgcgaaaccggcaaattcaaggcagttacaactggtttacctggtcgaacattcagtggattttgtaactttagtttagtggcatcaaccggcttctcaaccttgccaagacgttcaatgcgactattcaacgctttcttttgttgtgaaaaccctttttcaaccccattcagcccagatttcatcgcctcaatttcagcgtgactgtgcttgtgggggttaattttctttgctcgattcgacttttcgcccgctgttttcgctcgctgagctaatcgtttcttttcgtttgtgacttgcttatagtcttgcatctgagcgcttcgttttgaagcagtagcagccaagtagtcatcatagccaccattgaatgcggtaacggtgccattttcaaacgaccaaacgacagtcgccacctcacgcaaaaaggcacgattgtgcgagacgacaatcaccagccccttaaaccgatgaatagtattcaccagccatttgtgatgatcaacatccaagtgcgacgttggttcgtctaagattaatatatctgggcgttctgaaatagcttggcgaatcaaacggtgcgtcatttcaccgccagactcacccacaatgtcattaatttgtggcactatcgccacatatcccggtaaattaatccgaccggtataatccgtatcaataccctgcagcatgtttagtaacgtggtcttaccagcaccattttcaccaacaaccgcaacaacgcctgcggtcggaattgttagactatcaatctcaaacagcgtttcactatcgatagtctttacaacattttgaatttgtccgtgtaacataaaagcctccaatctcaccacaatgagattggaggcactctaaaaagcatgttcattaaacacgcagaagtccacactaaaaccaatctcattgataactatctatcattatgaaatcagcttaattgcgcaatggaccttaccccgtgttcttaaagtaagtgtagtatgacagaagcgttagtcttggtcaagtttgacaacttaacgctgactaatctgacgtgaaagatgcacaccatgtttagcgatataaaatgcccaactgaagctatgacgaacccgccaaaaagtcttataaggctgttcaacgtcttcaaaccgcacaagctgccaaccgccccttttgttccaccctgcaaacacatctgaaaattcaatcatcaattgataccggttaacatgatcaaattcattagagactagttgattgtcttcgtatgtcatccagtagctattcaattcttgtaatgccgtttttgctttataaaataaccagcaccagcttgcgattgatacgggtaacagccacaacatcagcgttccaaacaaattaaagacgtaaacaaagctcgttaaatttcgatgcgtatccaacatagtcagaaatgctaatagcaccttcaatataaccacagcaccaaccactcttgccgatcgacgccaaacggaacctatccaaaaacgctttgcagttgtgacttcgtttaatttattgatcaattgctgatattcattgtgcgtgtagacacttttatccatattatttagtccaaattctcttttcttgaacattaataataatcaatccacgtgaagaaattgtgtccacatccttgtcacaacaaaaaagccggtaacatctaccgacttcacgtatttttaatattaatcgcagtacaaatgaacagcttgcttagctgcatctaccgttgttgcatctggattcccgtagacgtgaatgtgatcaaccggcacgtcttcaccatcgaccaccttgtagccagtaaagcctactggatcgctagttgcatcgaaatagtaaccaccgtggcccttatctgccaaaacccatatttgactatctgaataatccttaagcatccagtccaaacgttcaatggtgtaatcaacaccatattcttttgcttccaaaactaatgcacgttcagttggattagccggcaaaatatcgacaacattcggactatctgttgcactcacttgacttgattgtgtagcatatgtaaacatccccatcgctgcaactgatgccaataatacttgtttaaacataaaattctcctttgtgttcccctatgaaatatattcccacaaaggtttgaaaaaaatacgtctatcacttagtaagcgcatcactctcagccaacatccccaagatttcctgctccgttaaatcagtatcattaacgttaatcgttacccaatgttgcttattcatgtgataaccacggtctacaccacgtgttttaatcatttcgtccacatgatcaggtgacagcttcaaagacaagtacaaaacaccctcacgttcaaaaatcattgccgtaattttgtcgctgccattatgcttcatgactgtccaagcaatcttttcatgtgatgtggatttattgaatggataggtttcgtgagttgcagagtgttcgtatacaaggtcaatcaatttttgtttatcatacatgtcagtcactctccaaatgggttttgtttcaccttatcaaagcatcacccatttagctaactttatttttatcgtgacatcagcagcaaatcttactgaccgtttacctcaaaaataatttcatcgccaacgtttgctttaacacccaaaattaacgcattatgaactgaatctgatttctgtgacggtatatcgtttatatgcacaattttcccgtttagacgaacaacttgtccaaccttagttctcatcggcaaatcctcatctaaggcaacgagtgtcatgtccctaactgaaaatgcatcaattactttcgccatacttttctcctgagttctcatttgctttgcgtaaaatgatttgacaaccacttagcgattaacatcatcgtttcctcagaattatcactttgaaccatttccaaaataaaatcccgtgcaacttcgttataatcatcacccaacggttgataaccattctcctgcaagaaaagtaaaaccacaagccccgctgtccgcttactaccatcaacaaataccggcgtcttaataatctgttgcatcatataagctgcttttaaccaaaccgtcggataaacttcttgcccaaacacaacctgcttcggctgatccaatatcacttcaaacgcgcgtggtgattggatgccagcattgccgccaaatttaagcactgcttgttcattcaaagaaagcaattcttcacggttcaaatattgcgtttccgtcatatgattcgtctccatattacctattctataaacgcattataaccgcgaccatttcctttgttgcaacataagtcaatccaatactcgcctaaccttccaaaataaaaacgcccaacatcactgttaagcgttagtaaaacattagacttcttgagccgtcggacgaataatcatatccgtaattgacacgtgctttggttgatctacaacatacgccactgcattggcaatatcttctggatccaacacattcatacgcatttcttcttgtgagacatgcttaaacatttcatccatcgctgcttgcatttcaggattatccaaagtgctcatcaactcagttcccaccgaacctggtgaaacaatcgttgaacggataccatgcaagcgctcctcttggcgaagaccttccatgatagcacgaacagcatactttgttccgttgtagacagctgattcaggataaacaacgtgaccagcaacagagtcggttgtgataatcaacccatcattttgttattgcataattggcaatgcagctgcaataccatgcaaaacacccataatgttaatgttgatttccttttcccagttttcaaactttgcgtctgccaacttttcacgtggcatgataccagcattgttgtacaaaacatccaaacggccaaacttttctacggctaggtcaatcaaagccttaacttgatccttatccgtcacatcagttgcttgataaataacgttatcgccaccaatttcagatgcaatttccgccaaacgttcctcgcgtcgcgctcccaaaaccaacttggccccctttgaagcaagtagcttagcggttgcagcaccgatacctgatgacgcacctgcaataacaacaactttattttcaatcgtcattttgtcactccttttaatcatatttcacaataaacagtctaaaagacaatccttacataaggtaaacatcatccgtaccgcaataataacatgtgcggccagaccattaccaatgcctttgttttatggtgaactataacaaaaagttattatatgactttagtcagccaccaccaacattgacttaatactcttacgattttgcatatcctggtaggcctggttaacatcatctaacgcgtacgtatttgtaaagacacgtcctggattgatattgccgtccaacacctcttttagtagaaattgcttatcatatgtcgtaacagatgccgaaccaccagcaaatgcaatattttggaaaaatgtatcccctagttggtacttgtggtagtgtggtacaccaactgcaccaatacgaccaccattatggagaacaccaaaggcttgttcgacagccgcttcagttccaacacattcaagaacagcatctgcaccaccaccaagcacttcgcggaccttagcaattccttcttcaccacgctcagccacaaccgccgttgcacctgattgtaatgccatttgttgacgatcttcatgtcgactcatcattacaatttgtgaagctccacgcatcttagcagcgataaccgcacattgcccaactgcaccatcgccaataacaaccactttgtcacctggcttaacatcagcagaccgtgcagcatgataaccggttggcatcacatcagctaaagtcagcaacgacttaatcatcccttcagaataatccgatggttgccctggaaccttgactagcgcccaattagcatagtggaagcgaatgtactcagattggaagccgtttgaccaatttgttggcgccgcgtgacgatcacacgtgccatcaaaaccagcacgacaagcatcacattcaccacacccgtgtgtgaaaggcacaatcacaaaatcgccaggctgcactgttgtaatctcagatccaacttcctctacaattccaatcgcttcgtggccatcattcactgaatgctctgccttttcatccccattagcgtacgcccaaaggtcagacccacaaacacatgcacgaaccaccttgataatgacatcatcattgttctcaatcactggcttatcaactgtctgcaccgacatttgtccagctttttcaaaaattgcagttttcataaaatcacccctctagattattactacttcaaaaacataccattcagtaatgtattattgatgatttacttttcactatgaaatgaaatttagactatcaccccaaaataaaaaggctttatcagccctttatcttttatctccataaatcaacaattgaaagtacaagcaacaacgatattgccacattgaacaccctataatgctttttatacacaccattaatcgcttgtcccaaaatcgtccacgtaaatgttccaagacttccaatcaagaccattaacaccagtcgaactgaaatgtgaccccaaatcccggtcaatgtgaacgcacccaaacctgtaatgaaatacaaatacactttaacgtttgtcatttgaatcaaaaagccggtcataaagccacccgcttcttcatcttcattaccaggcacgctaataagtacgtgatacgtcagatatgccaaatacaaacttccaacgaccttcatcactaatacgaacgtttcattagactgtatccagctcgcaaaaatggatgcgagtgccccaataacaaccaagccacctagcatacccaagtttaagggaacactctttttaatgccatgattctgacctgaaaccatcgccataattgtattaggccccggggtaaacgacatcacaaaaacaaatatcaaaaatgaaatcataatagctcctctaatctaattgcaaatgcaataagtttcctaacatattatcagaagataattgcaaatgcaacttgtttatcataaactaatttaaaggaggaacggcatgtttaatacaatcagacttattggtactatcactagatcaattcaagttcaaagcaataagaagttctcaccacttggactaggaaataacgcatttttgtatattattcgagctattgaaaatccaggtatgtttctcggcgaactcgctgacgcactaagcatcgaccgttcaactgcattccgcagcataaaaaaactagcaaagaacgggtacctcgacttgaaatcagacgttcacgacggtcgcctacagcgggtatttccaacacaactcgcgaaagatatttacccagaactattcgagtttgaaaaatcacaatcaaaacatttattggaaaaattatctaaagatgagcaagcggaactgttacgtctgctcgaaaaaacccagcattaacactttacacagtcggtcaatttgaccgactttttttataataatattgcaatccttctcgatttttctcaaacgccacgaacgcatctaatcggatatattcaccgatatacataaaaaggatgcaccatcagatgcaatcctctccaaaaatcaatttcacctagtttcggtgaactattatgacacgaacggccataaacgccggtccaataggcttcttattaatcgtttctagtgttacccttttcatcgtggatggcacgaatcttaccatcgttctccaagtgaccagttcccgtgtaaggctttacttcgtcaaagaagacacccttctttgcgtagtggtcaagcaattcttgacgtgatgcctcaaaacgtggtggcaaagcgaacgtcgtacccaagtcgaacaatgattcgtccaacgtgaatcctgggttcgtcgtagccaactcaacacggtttccaccaggctcgatgaagtatgctgaacggaagtatccacggtcgataaagacttcgcgcttgtaacccaaagcctttgcacgctcccagaagtacttcaagtcttcttctgactcaacgcccaaagcgtagtggtcagttgaacccttaccgaagcgtgagttaggtgcatcttcagccgtttgaaccaattcaatagcttcaacgccttccaagtcgatgatgttacccttaactgggatttccaacaagtcttcgaagaagcgaccagttgcagcaacatctggcacgtgcaattcagcaccgataacaccagtgatttggaactcagcaggaacatctgacatgtagttaatgtgccagtcgaagttcttaccttcagtttcttgcatacggattggcaagtcttcgtaatcagccgtacggatacgtcccattgcatcaacttcagccttcaatcccttttcagcaaaacggtccaaccagtattgcgttgatccttcaggaattgagtagtgaattcctgagaagaacatcttaccgtcagtacggtcacgcaagtcgtcaattgggaagaacgtgataaccgttcctggtgttcccataaagtcaccatagtaaacgtgacggttctttgggttggcttggttaactgagttcttgataaaacgcattcccaatacgccaacatagtaatctgcattcaacttggcatcgccagtcaacaatgaaatgtggtgagtcttcataactaacaaccctcttttatctgtttcaatattttttgtttattactttatgtgagtataatacccaacctgctaaaactttgcacgtaaaaagggtcgaattcgaacacaaattaaaaagtcctactctcgcaatctgcattgagtaggacttctatactattaacatatttggggtatattgatagtttttaattcttgtcgtacttcatttctgaaataaagtaccatgaaagcaaaacaaaggcgatggttggcacaatgaacgagaattgcattgaaccagagaagtcagaaaccaacccttggaagaatggccagacggcaccaccaataatcgccataaccaagatcgcaccggcagtttccgtgtacttcttatctgtcacggtatcaagggtgtgcgcgtaaatcgttggccactgtggaccaaagaagaagctgaccaacacagcagcataaacagctaacataccgtgtccgaatgtcgtgaccaacaacgtaatcgttccaagcactgagtaaacactcaatactgaggccaccttgaacttgctcaagaaccaagttgccaccagcttaccgatgaaccacatggcgtatgagtaaaccatgaacgttgtcgcatcggcatcactaatgtggtggttcaaatcaagcgccaaacgaatggtgaatgaccaaaccgttgtttgcataccaacatagataaattgcgccaagattcccttcttgtagcggaaattaccagccaagtacttgatcgtttccatcaatgaaacgcttggcgtgttggttgctgccgtgtcatcaccagcagcaactgcaggctttccacttggcatcttcgtaaaggctaaaacaagcaagacaacaacaagcaccgcaatgatgtacttgtatggttgcaatgttaattgcaacatcttctcaccataagcaatgcgttctgcaccgtgcataccggccatcttcgttgccaagttgccaccagtactgaaaatcatgtacttaccgagcaaaataccagcgatgtctccaagcggcgtcagtgcggctgaaatattcagacgcacattcgccaacttcttaggaccaagcattgaactgaatgtatcacatgacgtttccaagaatgacaaaccaatggcaatcgcaaaaatagcgaccaagaacattgaataagttgccacgcgtgaggctgggaagaacaaaccagctccgataatgtaggcaatcaagcccaacataatggcgaacttatatgacgtcttcttaatgacaattgaggctggaatggcaatcaagaaataaccaccatagaaagcagattgcacaaaggccgttgacgcatcattcaattggaagaccgtcttgaattgtgtgatcaaaatgtcatttagacttgcggcagctccccacattgggaagatcaaagaaataacaatgaattgaaagagcggtgtcttgctcaagtaaccgtcagacaattcgttaatgtgcttcgtaaaaggacgcacagcagttgcatttgtattatccattgttaccacctaaaaaataacgccactgcgtaaaataatattcgcgaaaggatgtgactcaccggtacggataaccgcacgtgtgttggccagctccttcttgaagtcttcgtgtgaaataaatgtcacctcaacatccggcaacaccttcttaatggcagccaattgttctggattagccgtcttaatttcttcggccagcgtaatgccttctacttccaattcagtcaagacagtctccaacaccgtttggaatgttgggtcttgcaatttaactgctaaatcaatcttttcagtgcccattgggactggcaaaccagcatccccaatagccaacgtgtccttgtgccccatttgagcaacaacggctgaaattcttgaattcaaaataccagtctttttcatatgatatcctttccgataaataatgttagtaaatcgttttacaagatgtaacaatacgcccatcgtgccacgggtggcgtaacacaccgcatacttgtgaaaaaacattcaaactttttaatcattttaattatcgaaaaagaaacgactcacaccgatattttcaattcataaacgacacgatttaatttgaaaataaaagttacatcatgtattttgtctaccattcagatatactgtcagtaattaaaaatatatcgaggtaaacaaaaatggattacaagatcgaatctaatatgcagttcccattggtgagctatgacttgttgccccatgaaactgtgcgcatccaaagtggtgccatggtttatcacactggcgacactgaacttaaaggtcgtttgaacgcaaacggcggttcaggtatcggtaagttgattcgtgcagccggtcgctcaatggttagtggtgaatcagtcttcattactgaagttacggctggttctcaaggtggtgagttggccctcgctcctaacgttcctggtacgattcaagccttggaagtcactggcaataagaactactacttgaacgactcagccttccttgcaatggacgggacggtgcaatactcaatggaacgccaatcattgggtcgtgccttcttcggtggtcaaggtggtttgttcgtcatgaagacgagcggtgaaggaacattgttggtggctgcatttggatcaattaaggaaattgatttgcaagacgcccacgacttcaccatcgataacgcccacgtggttgcctgggagacatcattgaactatgacattcaccttgaaggtggcggtgtcattgggtcaatcggcactggcgaaggtgtcgtgaatacctttaatggaaacggaaagattttgattcaatcattaaacatcgaaaactttgcgaatgtccttaagcctttcatgccacaaccatcatcaaattaatgacagcaaaaaagacgacgcacatgcgccgtcttttttcatagcgaatcatttaaacgtgactatcacttaattgcgttccagcattaatgtgctgaaaacgctagtcagttcgttgtcgcttttttatttgattattgattcgacggcgatcatcgcgttcccaccaccacatgccaatccatatgattaggtagataaacaacatgtacccaacctcgaagtgaacacccaatttgtttgcttcaaaataccaattcgctaacaaaacagtggatattgttaatacaaaatgcaataagaaaagttggtaaaaagcgatatccaggtatctgaatagcgccgagtacaagccgataaacccactcattataagaatagcgataatttctgaacgtttcaaagtgacttgaggaccgacgaagataatcgaaatcatcatgaccagtgatccaattaaatcgccgataacccaccggcgaatcatatcaattaatattttcatgttgccctcctataaccccaagtgtcgcttgagttctggcaaataacgtcgactgacatctatcttaatgcctcgtcgcataaccgccaccatgctaccgctgaaaccagcttctagcgatagcaagccgtctaaattaatgacattctgcttagaaacttgtacaaacaaactcgcatctaatttttggagaaccattttcagtgtgccatgggcaaccaaggtttcgtcatttgtataatatgttaacgtctcacctgtcaccgaaatagcaataatatcatcaaaattttttaacatcgtccgatcctcagttggaatcgcgattctgcgctgtgttgtgtcttgttcaaccaactgcacaatatgtgcaacatcagacgaaagtgtcgctgctttaataacaagctcatccgctgccattgtttgatccaactctacccgaatcttcatatcatatttgaatcccttctacgtaatacggcaacgcccaaaaatgcagcataaacaaacaaaaacgctgcaacgatgagcaccaacacgctgaatgattcgagcgtaacgcgattaattgtgaacgtcaatcccagtaggtcttttatgtcgctaggcaaacttgattgtggtattaaaacctgcctaaacaatgtcgacacataaggcgccggtgtaagaccaataatattctgggcaccacgactcaaagtccctactggaatatagacagtcgtaaagaatccagccgcggttccaataattgagcctatacgccctaaagtatcactattttttactggtaatgttaacaaagcatttagtatcacccataaaacactagtaaataaaatcaaaccaactgtgtgtcctatttgcgctgatgacaaagtgatttgatcaacactagcaaagtaactaaatatcacgataaacaccatcaattgcatcaaaacgccgataatgtacgtggaaatcaaataactcagccgaattttaacttttgacacgccactaactaagaaatcagcaatcgtacccgattctaagtccctgacaaacaaactcattcctgtaaaagttgttgtaattcctgcaactgcaatggttcctgatagcaaccaaaaatctaaaacggcctgtccgttgactacgtgcgtgaagttttgttctaaattgtgttgcaaaaataccaaatacaaaataaatgaaatcaacgctcctaataatgacatgaatacgttgctgggcgaaccgaaatataaggttaattccctacgaactagactaagcatgtgtatcctccttcaccaaactgacgaaaatatcgtccatcgtgacagggcgataatcgaaatcattccaagtgggttggttgcctaaaattcgcggcacctcatttggtaacacaccagaaaatgtttgcgcggtaccgtcagccaagttaacaaccagtcgacgctgtctaaaacgcgatttcagctcctggcgtgacaaagctctcgtgactcttcctgactgcatcatataaacaaaatctgcatcttcggcttcttcaagataatgtgtcgttaacaaaacagccattcccatctctgaacgtaaactgtgaatttgttgccagattaactgacgtgtctgaatatcaagcccagtggtcggctcatctaaaattaatagttctggctttcccaacaacgcgcgcacgatatccaccttgcgtttctcaccacccgacagtacaccatacttcttttgcaacaagctatcctctaactcaaatctgtctagcaaatcctgtcgccaaacgttatcaatatcagaatataaggcttgcctgaacgccaaatttttttcaaccgtcaaccgactatccaagatactttgttgaaataccacgccgattggcttttgcagacccgatttaacttcaccactagtcggtgacaacaaacctaaaatcattttaatcgtcgttgatttaccagcaccgttagttcctagcaatgagacaaattgacccgccacaatttctagatttactagttccacgatgtttttaccgtttattgtttttgttaagtccttcaattgaattaacatcttgctaactcctttttatttgatggactaatattacccaattattcaatggcaaaatcactattttggataacaggttaaaattcacgggtaacttgcttaaaaatatagataattgtacatatcatctaatgggtacaatgaagccatttagacgcaaaaagacggaaccagctacggttccgtcttttttaacgcttaatgcgactgaaaattgagacaccaattacttgtacaacaacaatcaacactgccattggcaaatacgtcgtttcaccaaacaacccgacgattggtgacatcaaaccaccaagggcataacgagccaaaccaagcaatgctgaggctgaacccgcgttttcttgttgtccttgcatacccaacgccgtcgtcaaggaaataatcccaccaaccgttgagacaacgatgaacaatggtggcaaaatcatccaaattgactttggcataaaggcagttgctaacaaccacaaaccgccaataaatgcgacgcggataaaccacttcaacgctgtgtactcaccaaacttggctgcccagcgacctgacatgctcgacatgaacgcgattcctgccccgttaatggcatacacaattccgaatgtcgtcaccgacaagccaaaaatcttttgcaagacgaatgatgatcctgaaatgtaggcaaataaggcagccgtcataaaggcttgcgtcaacgcaaatagtacgaattgacgttgcttaaacaacttaccgaaccctgccacaacagattgcttttcttgtggcgctgccttttcagctggcaacgtctccggcaatgagaacaaaaccccagcgaacaaaagcacacctagcacggccaaaacccagaatgtcatttgccaatcagcccaggcaatgatgataccaccgaatactggtgccaacactgggaacaccccattaatcgtttggttaatcgcgatttgttgcgtcaatgtcttacccgtaaacaaatcagtaattacggccaatgacaacacgattccggttgatccagccaagccttgtaccaaacggagaatgattagcacccaaatatttggtgcaaagacaattgctgccgaactcaacgcaaacgcgatggttccccacaacaatggcttacgacgtccgatacggtcagaccacggtccgacaatcacttgccctagcgccaaccccaatagtgacgcggtaatcgtcacttgcgctaatgaagttgatgtgtgcaaatcttgttgcaactctggcaaccctggcaagtacaaatccatggctagtggtgagaacgcgctcaaaacccctagtaggaatagctgtagctttccaatattctttttcatatctttcaccttcaactaaaaaacgacccgcaacgagccgttaaatttctattactaagtatagcctttcgcttactttcacgcactaacaaagtgactgataaataagccagcgatgttgaaatagataataactgacgtcaaatcagacagtgttgagataaatggtcccgatgcaactgccggatccacaccaatcttatccataatcaacggaataaatgaaccagccacattggccaccaaaatggcaacccccatggccaaaccaactgccacaccgagtagcaagtttgctttccaaacccagacaaccaagaaaatggttatcccagcagtcgtaccaatcatggcaccaatcaaaacttcagttaacaacattcgcagcaatgaactggtttcttgcaacgcgatacggcgcactgacacggccaatgactgcgtacccgcattaccagcggttccggtaatcaatgaaataaacaccgccaagattgacgcttgttgcaccagaccatcaaatgtattgatgacactagccgttcccatccccaagaaaatcaaaccaatcaaccatggcaaacgcttcgtcgccgacttaaaggggttctcctccagagtgacaacgtcaacaccggccaagcgtgagtagtcttcggcagcctcttcatcaataacgtccacgatatcgtcaaccgtgataataccgaccagtttgttctccaccacaacaggcattgacacaaagttataatcggccatcaaacgggcgacatcttcttggtcatcgctgggttcaacagtgatcaagtttgtgtccatgacatccgaaacgcgtgcttcgtccggccaaacaatcaacgaacgcagtgagataactccgaccaaggtttcttcgtcatcgaccacgtagatatatgtaatttgctcagcttcttgtgcagcacgcttcacggccgtcatggcttgtccaatcgtcaaattctgattgatggccacgaactcggttcccatcaaagaaccagccgtatcatcttcgtaattcaacaaacgacgaatttcataagcatccgtcttaggcattaacgccaagtacatcgccaattcgcgcggctccacttcttccagcaagtctaccgagttgtcggtgtacatctggttcagcatttgggccgcatagcgtggtgacatttcttccaacaagtcgttcaaatcaacgtcttctggctcgatttcgtcaaagaccgccgccaattccgttggcgtcaaccactcaatgatttggtgacgtaattgcgaaggcaatgtcacataaaaaacggcctgatcgtaaccgtgcagttcgtcaaagccgtctaagaatgcctcacgctcgccatgttccaaatattgaacaaggtggtgggcttggtcggacagttcatcacgcatctcctctgtgatgtcttccatcatgttatctgccatgaaactatcctccccaatctatttttaattttcgtcaggtgtcacttggaacccgtccaagacatcaacgatatcttgtggtagcgcactttgcactgtgcgttccatttgtgcgaatgggtcatagaagcgcaaccagtatgcatgcaatgcttgacgggtaatgcctcgatccataggaccaccataaatttcatcaccaatcaatgggtgaccaaggtacttgaagtgcacacgaatttggtgcgtacgtcccgtgtgcaattgcacgcgaaccaacgtttggttaccaaaacgcttaactacccagtattccgtttgtgatgggcgtccatcttcacggacctcgcgacgaataaagtcatcatccatacggccgattggcgcatcgatgaagccataatcatcttctaaatcaccatcaacaatcgcatagtaacgcttgtcgactgagtgcgtttgcaattgcttatccaacaagccgtgtgcaaaacggtgcttggcaagcaaagcaactcccgacgtgaatcggtccaaacgcgtaaccacgtgtggcaccaagtcttcagcacctgaacgcgccaaataccccttcacacggttaaccatggttgtctcacggtcagccttaccaggaactgacgtcacgccagcttctttctcaaccaccaaccagttttcgtcttcaaacaaaaccgtgattggtagatcagacattgccacaacgtcgtttgactcttctggtggcatcacaatcgtgactttatcaccaggcttcacttcatcaacggtacgcacttgcttgccgtctagcaaaactgagccaccaccgcgcttcacaattgaaaacatacggtgtgacacgccgcgttgtgccaaaaatgtcttaattttcaaggtctcatcgccttggtttgtccaactaaattgggccattagtttacctccgtgccgatgaaactcgattggacacgatgccagaaatgcatgtgtcggtactcagcaaattgaatttttgtttgggcgacacggaactcaatccagtcgatgtttgaggcaatcttgctcaagtggtcgaaactcaacgtcacagcagcgccatcgttctctagttgcacacgaataacttcgtgactaccgataatcaatggtgaaccaagtgttcggaagacacgactgttaattgaggcgatttcagccaattgaattgcttcaagacttgggtgcatcacagcaccaccgatggccttattgtaggccgttgatcctgttggtgttgaagcagttaggccatccccacggaagcgctcaaatagctcaccttgaatgtaaacatccgccaccaacgttcccaaaggacgcttaatggcggcttcattcaacgccaacacgcgttcttcgcgaccatccgtataacggacgcgcgcttccaacaatggatacttgaccgtacgtgactcttcatcggccaccagactatcgataagttcatcaatttcgaaatgttgccagtccgcataaaagcccaagtgacccgtgtgcacaccaataaagcgcacaaaagccaattgatcagcataatggtggaacgcacctagcaacgtgccatcaccaccgacagaaatcacaacatctgggtgctcatcgtcaaagacaatgcggtccgtgttgcgctctgctaatttctctttgaacaaggcaacaaccgctttcgattgtgcaccattgttactataaattgctagtttcatgctagtcgtcttctttcctgctacctggattaggcctcggtatgattgtctaacccattgtgtaactctgagaataattcgtcgacgcgaatgcttaattcagccacttcacgcaacttctcagtcatttcttcagtatattcaccgtcgtacttgtaattgatggcgtgttcaatggttgcccacacattcatttgcatcgtacgtacttgaatttcggccaaaatcttcttttcgccagtgattgtttgaactggatactcaatcacgatgtggtaagaacggtacccggatggcttggcattcgttacgtaatcacgttcttccaaaattaccatgtctttgcgttgacgcagcagatccacaatcttgtagatatcttctgtgaactgcgtcatgattcggacccccgccaaatcttccatgtcttgttccaaacgttccaggtcgatgtgacgacgaacggctttttcctcgatatttggaatggccttaacacgtccagtcacaaactcaaccggtgtcttcacacctgccaattcaaattccgtgcgcaaaccacgtaacttgaccttaagttcgtccacagcctgaacgtacggttgtagtaatttctcccactcaatctgtgtcatgtcgttatcccccgacttttttctcacttcctctattatagcaaaatgaccagcctttttcccgctaattctttgccctaaatacaagacattagaaacagattttcagcattttagcaccaaatgcgctatgcttattacggttaaaaattcacagaacttccgcatctcacgcaaaagttttgttacacttgttgcaatcgagttaagagttgatgttattgcgaattttggagcgtacaaattagacagcgctcggtggaacaggtaatataatcgaggatatgaaaaagacatgcattttttcatatccataagaaaagttttggaggtcgtggctcattatgttagaggtgtaccacttcgtgaacccactttccggtgactgcttagagaccgaaaagaaactagcgacatacgtagaacaatcaaataaaaaagttgccatgcaaatcattccagttgtgacgatgcaatctgctcgccaaactgcgatggcgtcatcaaactcattgcacccttctttgcacgatttgaacgtcgtatcacagacactttatcaagtcgctgttgataccaaggcggctcaattccaaggtaagaaagctgcgcgtgagtacttgatggccacccaacaggccctattacagggacacgcctattctgatgagttggtgatgcaaactgttaacgatttggcattggaccaggaaatgtttgtcgaggatcgcaatagcgaccttgccgtgcaagcattccgcgccgatcaaaacttggcagccgaaatgggcgttcgtaacttccctgcattggtggtttacgacactgatcgttctgaatatgccgtcagaaccgatgatttttctgatgagcacttgacccgacttttcttgtcggcaactcgtcagcggctaagagaatatgacggcttcctacacaacggtggcgtcacagaagtagaagaaggctaaaagagacctagcaaggcggtaacccgtcctgctaggtctctttgtttatattcgattaacgcttaaacgtaaaacgtaggccttctaccggcttcatatcgcgcgtgtagaattgtacgataaattgcgttggctcaaccgtcaaaatggcatacgtaccaccaaggtaagcgtattgtccctttggcaatgaaattgaaccagggttgatgaacaaacggccatcaatctcttcggcgcccaaaacgtgcgtgtgacctgacaagaccacatcaacacccttagctgacgcaacctcacgcaattggttcaatgatacctcagtgtgtaccaagtgaccgtgcgtttggtaagccgtaaagttatcatccttgtaatcacggtcatctgggaacattggatccgtatccatgtttccgataactggcaacaagtcgttgaacaactcatcagagcgtgacaactctgaatcaccgttgtagaacatggcctttaccttaccgcggtagtgattcacgacatcttccaaaatttggcgatcgccgtgtgcatcagaaataatcaagtaatccatgatttaatcctcccaccagtttttaaactcagtcataaactcacgtaaagcacccccacggtgtgaaatttcattcttctcggctggcgtcaattcggccaacgtcttatcgaatggttcgtagtaaaacaatgggtcatacccaaagccgccttcaccacgtgcttcgcgcaaaatgcgtccgtcaaccttaccagcggcaaccaagcgcttaccatctggcttaatcgctacaatcacagcgtggaatgaggctgtgcggtcgatatcaggcgtactttcaagttcgtgcaacaactttgcattgttagctgcatcatcgtgatcacctgcatagcgcgctgagtagacacctggcgcaccgttcaacgcatcaaccatcaaaccggcatcttcggcaacaactggcacaccaaatgcgtgcgcaatcgtttccgccttaatcgtggcattctcttggaacgtcgtgccgtcttcgataatggctggcacattgtccaattcgttcaatgacacaacttcaataccaagtggcgttagaaactcgcggaactcgcgcaccttaccttcgttctttgacgcaaaaatcaactttgccatgaggccccctttgtgactttagtctgtaacagattcattcaacactagtgtatcaccaacgatatccaagtgcttaactgtcatttccttatcatccaaccaacgaccaccaatcgtagcaaagcgctttacgctaccagtcgtaaagtattcgtcgttcgtgtgatcagctgggtttgctgcagcgtgacgcaaatcatacttgtccaagaactcgacaaccgttgaaatcgtctcggcaccagagttaaccaacgttacctttggtcccatcgcttcttgaataaagccttccatcaatgggaagtgcgtgcatccaagaatcaacgtatcaacttggtggttcttaaagtacgtcaacttttccttaaccacctggcgagcaaattctgaggtgtagtcgtgattttcggccacatcgacgaattctggcgcagcgagttgcacaacgttagctgcacggtttccttgcaacaaaccattgtagtaagccaatgacttaactgttccggccgttgcgataacaccaatttcaccatccgttgacttacgcaaagcggcatcgacaccaggttgaataacaccaacaactgggatgtctagcttagcttgaaggtcaggaagtgcggctgcagtcgcggtattgcaggctacgaccagcatcttgatatccttcttcagcaaataattaaccatttgccaagtgaagccgaggacttcatcctgtgggcgtggaccataaggcatacgcgccgtgtcccccacgtagtagacttgttcatcaggaatttgcagcaaggcttgcttgaccacggtcaacccaccgataccagaatcgatgtaaccaattgcacgattatccattatcttcacttctttcgttttttctaagtcttcattataacattgccaggcctattccggaaatctacggtgaaaaagtaaaagacctggtaaaggaccaggtctaatcgcttacttttcagccaactttaaaatgtcagcaggtgtttcaaagataatatccgcttcatcgttaaagacagcacggtcacggacaccccatgacgccataccaaacttaataccagcgttgtgcgcagcgtgcatgtcgtgcaccgaatcaccgatgtaaattgactctgaaggatccgcatcaaggtcagccattgacttcaaaattggatcagcggctggcttcatctttggcgtttgacccgcaaagacgaaatcatcgaagaaaccattaatctcgaagttatcggcatgatccgcaaattcttctggcgtgttagaagtcacaatccccatcttaaccccggttgccttcaaatcagccaacatgtcgtgaataccgtcaaacaacttcacttcgttccagaaatcgtgatagtgactttgccactctttttgcatctcttctgggttttcgatattgaacttaatcaacgcgtccaatgaaggcaacccgaaaatggcataaagatcttcgtattccttgtgaataccattggcttccaaagtaaattgcaatgacttcatgtacatgctctctgtgctcaacagcgtgccatcaacgtcgaaaatgaatgtcttcataacttggtgaactcctcaatacttagtgccttcattatagcacgtggctagggtcgtgattagtgttgtacggaacgcatgcccacggtcattaacgttaacagaatcactgccaataattgaccaaacatgacgcgttgtaacgcaatccaataggcgtgttcaaccggaacggccaagatgaccccggcaattaaaatgataattgtggcaacccaacaactcgtgcgagtcgaaacgcgctttaaaaacatgtataacgtcaacgtggcaataatagctggcaaaataatcaaaagtggatgtacaccaaatagtggtgtgagtaaaatatcgcttatatatattagtaataacaggatttgaaccatatgtttatcctcctgtgtaaaccataccaaaggcgaaaagaaaaagccgaccctatccaggtcagctaaaaatttcttaatatattgccggcatatcttggccgatttcaaccatctctagtttattcgcagcatccgcaattaatgcgtacgcgtaacgatcgaactgaactgtttcaatcgctttaccccacttcagaacgttagcctttggcatcaaatcttgagcagctgcccaacgtgcaaactcaatcacgatatcatcaacaaattcaaaaccatctaaaccaaataaatcaaacgtttggaacttttggcgtagtacttggcctaacatatctggcgtgatagctggcaaactcgcgtgtgttttaactgctagttcatccaagaccatcgaaataatcacttgcgccgtttccaacccttctggtgttagctcgtcacggttaaccaagtctgtcataaagtcgtgaattgcatcatcgtagtccggcacatcaccgtcatcacctgaataagctagctcatcaggttcatgcgctagaatccctgtaattagcgcctgtagttccgctgtatagtgaatacgttcatcgttttcagacaccgtcaccacgtcttgtaggaacaacccatttaagccatcaaagaagtcgcgcaccgcatattgggtgtcagcccagtcgcccatttcaatctgggtttcaagccactcgcgcattggtgcaacataaaccaccgttaacaccaacaactcttggtgttcctttagatatgctatgtgcttcttaatcactggttgaatgctacggtgttgtttatatagtgctggtataccactatcgttcaacacttcaaagaagaacttcacacgcaagtcatcgtcatcagtcgttgtgtcttgggcgaaatcaacattcgtctcacgcaattcatcctcagtcacttcaagccctagctcagtcattaagttttgcatcaattccacttcttcatcatcaagtggttcatcaattgattcttctaagtcatttaaatactcaggcaccgtctccatcaaccaagcacgtacgtcaggcgtaaagaaactatcacgaattaggccacgttcaaccaagttctctacaattgcttccatcagttcaacaagcagccccgtatactggcaatccacttctaagtaccccaacgtcatgcccattgcttggaaaagattgtctggcgtccaattgttaggcacttcattcgtcaagataaaggcataatcaaccgtttgacgcacgaaaatattaacgaagtcatcatcgacctgtttgttatcatgatactttttgactaaatcatcgctgactgacaccgctaaggcacggttaatcatcaacgcagtctgatcaatcggtggtagtaccaagcccccttgcttagcatatgactgtcgaatcaattccgcataatctgctggaataaagttatccgcatcaaacggcatttctgattcatccataatctagaacctcctgtcagtctcttatcacagcagctgttggtctaaaacccctgactttagtcaggcgtaagaccaaagacgcacctgataagtgcgacttggtcacgtcggaggtctataacctccgacattcccagtctgctttatagatgattatacgttgttcaacgataattaaacagtgattacgtacagcccaaatgtacaaaaaaacagccttaccgaagtaagactgttcgtaaaccattgaagcggacgacgggaatcgaacccgcattcccagcttggaaggctggagcactagctagtgctccagccttccaagctgggaatgcgggttcgattcccgtcgtccgcttttttgttttatgggactgtagctcagctggttagagcgcacccctgataagggtgaggtcggaggttcgagtcctctcagtcccatggttgaaaggttcaacttttgacatggggacatactcaagaggctgaagaggcgcccctgctaagggtgtaggtcgggaaactggcgcgagggttcgaatccctctgtctccgctactgatggtagatgcttatctaccattttttatttgcaataaagaataatcattaggtgttatctgttcgtcaggtaacaccttttttgtttatcgcagtatctatcgggcttgccatgcaacggatgaatcagatgttaaaaaatgcaatttctgcataaacggtaattttcaatcatcggactgattgattgaataggttgaaaacggtaataaacgggtgattagtgttgttcactagcgacaaataagacacattgaaaatatgttcggctgttgaatgttaatagagtgagcttgttagtattttgataaccgcttatgctgaatgtatcttatgtaagcaaggggaatagattatgaagttagtatcggggagcttgaagcgtcgtcgtgagcagttggggatctcacaagctgaggttgcagaaggtatttgtcatcaatcactgttgtctcgtatcgaacgcacagatgaagtttctaatatgacggtgctacaaaagttgtgtgaacgtctacaactgaacgcagctgacatcgcgcgtattaatgaaaaggcgttaacaccgttaagcgttgtacgtcgcctaattgaaaagaatcaaattgaagaggcagaagaggcattgttaaatccagcgttaacaacgcgcattccaatctatgcgattccagagtttaatgtgctacgcgcgcgggtagctttgtaccatggccaggctgctgaggcgatggaattattacaagttgcattgggcgatgtagataagtaccaggtcgagctgacaatcgaaatttttacagaaatgggtgcaacgtggacggcacaagataaaaatgagttagctgcagaatgctttgagcgagcttgtggcttaattcgtcagtcttcagttgatacgcaggctgcaatggcgtcagttattacacatacatatcgccatcaagcagaaatgtacctggcaagtggctttgctgacaaagcaatggaacgggtcgtggaagcattagaaatgttgccaactaccactgattatcatgaaatggtggcgttacaaacgattcgaatgaagtgtgcagatgcgctggctttgtctactgaaaagaaagaagcgcagttactggcctatgctgcggctgagttttcaaaggacgtcaccctaaaagaggatgttaaagcatacagcgtgttagtgtaacaaaaaagacgctacaacatcgtgtagcgtcttctatagttagtaacctcgtgtgacatcgacgaagttagttgttaatggtttgcccgctaaaaagtcaggcaaatttttcataaataatgggaacagattaccagctcgacctgatgattcatgttctgcccaggttgtgtgttgcgtcagtagcaaattgtcatgatgccagagtggcgaatcgtcgggaattggttcgatttccgtcacatccaacgctgcgtagcgaatagattgcgtagctaaggcatcaagcaaggctgtttgatcaacagtagaaccgcgaccgacattcacgaacaagaagagattctggaattgtgctagcatttcagcgttaaagaaatgcttggtggcatcggtacctggcaggacgctgatgacgacagcaacctctggtagggatgacaagtcgttgatgctaaacgtggcgtcaaagccttctacgggacgtccagaagtattcacgccatatacaggtgtgttaaagactgataggtagcgagcaatttgctgaccaatgtgccccgtaccaaaaatgacggttggcaattctgagagcatgtattggtcagtgaactcttcccagtgattgcggttttgatagacattcaagccacgtgcaaagtgcatcatgtagccaatggctgattgggcaattggcacagactttaagccactggcatttgttaatagaataccttgttcagccagttcttttaggggcatatagtccacaccagcggacattgtttgaatccactttaattgattattaggcattgataggatttttggtcccaaggtggctgaccacccatagctaatggtgacgttggccaaagtatcgtcgctaatggcgtctggcgtcgtaacagtaacgccgagttcattcagttgtgtgatatcagcatcacgcaagggttgaacggcgagtagtagttgagacatagtctagccctcctatggttatttacgtttagtgtatgacaaatcattagtatcgtctattaatatacacgcaatacctttttggcgcactaaaagttagtgccttgttataataacctcacagaaacagaagaggatattattatgatgaattcacaaaacaagacgcgtcgtttggtgctaacagctttgtttattgcaattattttggttcaatcaatcgtcccttggctagggttgttgtctatcacgccagcggctggtgtcggtgtacaagttcaaattattagtgttacagtggccattggtgccatgattcttggaccacgggttggtgcattgcttggattcgtatggggtgcatattcactttggatggcatggtcaaacgtaccaagcattggtggcatgattttccgtaacccaattacagcattgctacctcgtattttggtaggactaatcgttggattgatttactggtatgttgtccgtaagcaatcacttgcccgccaaacgggttggattgtcttcttaggaggtttgtcagctttcttgaacaccttctttgtattgctatcaacttggattggcttctcagtgatgcatacaacgttcacgggtattccaacatcaggattggcaaactggttgatcttcggtgtcgccggtgtcaatgggctggttgaaattgttgtatcagcaatcttggtgccattaattggtatgccagtattgactgtattgaagcgcttaaattaacaactagtacgaaaaactggaactggcattttgccggttccagtttttttgttgatactatgaataaagtattaaggcctaatatatcagtagcataaaccggactataattgtacaatgaaagagtaagtgagcacttattaagagcttgggagagcaaataaattttgggatagtaggaggcaagttttatgaacttgatcgaaggactttccattttggacctggctcgaattcagttcgcaatgacaacgatttttcactttttcttcgtgccattgtcaattggtttgggactagttgtcgccatcatggaaacgatgtatgtggtcaaaaaagatgatcaatacaagcgtatggcaaagttctggggaaagattttcctattaagctttgcggtcggagttgtcacgggtattattcaagagttccaatttggaatgaactggtcccgttactcacgttatgttggagacatctttgggccggctttggctgtcgaggcgttggttgcgttctttatggaatcaacgttcttgggcctttggatgtttggttgggaacgattcaacaagaaactacacttggtcttcatttggttgacgacactaggatcagctttttcagctttgtggattctagcagccaactcatttatgcaaaacccagttggtttcaaggttgatcacaagtttgaccgtgcggttttggtcgactttccagcattgctacagaatcaccaattgtggttggaattcccgcacgttatctttgggacgttcctaacgggttcattcgtggtcattggtgtgtcagcttggtcattgttgcgtaagccaaacagtaaccttgatttctttaagaagtcaatcaaggttgccgcagtggtggcattgattggtacagcaggaattggtttgacgggtgatcgtcattcactttacttgcaagaagatcaaccaatgaagttcgcagcaactgaaggattggatgaaaatgtcggtggtaaggataagcaagagccttggtcggtagttgcttacacaaacccaaagacacacgaagttgaatggtcattggacattccgtacgtgttgtctatcttggctcaccactcattgactggtgaaaacaagggttggacagagattaacaaggaattgcatgaaaagtatgatgtgaagtttgggcatgatatgaactactacttgccaaacaacaccatttactatgcattccgtgtgatggctgtatcagctggtgcatttggtttgctagctgttgtggcattgtgggcggttcgtaagaagtcaaagctagatattacgaagtatcgctgggcactttggattttcggactatcaatgttcctaccatttttggcacaaacagcgggttggttgattaccgagctcggtcgtgcaccatgggttgtttatggtgtgctaacgattgcggatgcggtgtcaccaaatgtgtcatttgcgtcattgctaacgtctaacattttgtacttcgcaacgttcgctgcgctaggtggtttgatgttcatgttggcgcgtcgtgtcatgattgcaggtccagatagcgttgatgataagccagaagctcaggatgttgatccattctcagcagaagcatttgatgcaggaaaggaggcttaatcatgacaggatttcaaattctatggttcgtattgattgccatcttgtttgcaggatttttcttcctagaaggattcgacttcggagttggaatggccttgaagggcttggctaagaatgaacatgaagaagatgccctaattgaatcaatcggccctcactgggatggtaacgaagtgtggttgattacggctggtggtgccatgtttgcggccatgccattctggtatgcctcactattttcagggttctatttaatcctattcgcgattctgattggtttgatttaccgaggcgtatcattcgagttccgtgagcaaatgcgtacagcgaagttccgcaatttgtggacgacaatctcagcagtcgcagcgttgattgtgccattcctattcggtgtactattcacggacgttgtccaaggtatgcctttggataaggctggtgatatgtcagctacgttctttgactacttcaacattttctcaatcgttggtggtgttgccgttgcgttgttgtcatacatccacggattaaactacttacgtttgaagattgaagagggtgatctacatgatcgtatccaatcacaattgaaggtcttgtacccagtgttgttggttggtgaagttgctttcgcagtgacgttgttcattttcactgatttctttgctaagaagccgcttattacattggcattcctagcagtcatcgtgttgttgacggttatcgcttgggtaacaggcttgaagcgctcaaacgtatggtcatttattgctttgggactcacaattatttcagtcgtgttgttgctattcacggggttgttcccacgtgtcattgttggggataacccagccatgtcattgttgttgaagaatgcaacgtcaacgccatacacattgaagtggatgacgatgattgccttcacggctttgccaattgtgttggcctatcaaatttggagcttctacatcttccgcaagcgaattgttgtgaagaaggcagcttaacataaaacaaacagaggggatcaagtgtgtgcttggtcctctttatacatattagttagatggagagacggcagtatgctagataaaagattatttaaatttcctggtgcccgaaaagcgttgggaatcttgtcagtgctcactttgattcaggccttagccattattggtcaaggtcggttcttgagcattgcgattacagacttgtggcaaggacataaattaggtgcggtggtgacgccggttctgattttcgtggccgcttacttgatgcgtcaactaatgggggttgcaaagcagtacgccttgtcaccgtttgctgatgccacaacggcgtcactacaaacgcagttaacggaaaagtatgcagcactgggaccacgagttgtggctaaccaaggaactggtaagtcggttactttggcagtagaaggtatcgatcaagtgcatgattatttgacattggtgttggtgaagttattcgatatgagtattattccttggttgattttggcttatgttgccatgattaattgggaacaagccgtcttcctattctttatttatcctgttatcgtgctgtttatgattgtgttggggatggctgcgcaggcaaaagctgatcgtgaatacgccactttcaaccgactttcaaatcactttgttgactctttacgtggtctaacgactttgaagcaactaggtttgtcaaaacaatatgcgaataacatttatgaagtgtcagaagaccaccgtaaggcaacgatgagtacattgaagattgccatcctgtcaacatttgcgctggatttctttacgacgctttcaatagcggttgtggcgctatttttgggactaggactaatggatggcacaatgacgctattacccgctttaacgattttggttttagcaccggaatacttcttgccaatccgtaattttgctaatgattaccacgcaacgttgaatggtaaaaatgcattggccgacattatggcgttgttggatcaaccgacagcgactgatacagatgagtatcaaacaacgagtcaacgttggcgcgacaccgacgaattgcagttaactgacgtttcatatacttatccagaagcgaccgaaccggcgttgcaccacattaatgtggactttaagggatatgaacgtgtggcgttggtcggaacatctggttcaggaaaatcaacattgctgaatttgattggtggtttcttgaatggggctggcggtgtgtctttaaacggtcagcaattgcctcatctacaacagcgcgcttggcaggaacagattcaagttctaccgcaacaaccttatatttttcatgacacattgcgtcgcaacctggcattctatgcaccagaagcaacggacgaaaaaattcgtgaagcgattgaaacggttggcttgtcagagtggtttgaagcgctaccagaagggttggacacgctgattggtgaaggtgccatgcagacatctggtggccaagctcagcgtattgggttggcacgcattatgcttgatgataatcggcgcgtcttgctgttggatgaaccaacggcccacttggatattgaaactgaagtacgactaaaggaaaccatgttacctttgttcgacaaacgtttggttgttttcgccacacaccgtttgcactggttaactgaaatggatttgattatcgtgatgcgtgatggacgaattgttgaacagggaaccttgtcagaactgatggctaataacggctactttgttgaattgcaagcggctatgcgaggtgtaacacatgcgtaaattactgaatttaattaaaaacgatacctgggttttcccatatttgaaatcgtataaaaagctactagtgttgattattttcttgggattcatgaccactttttctggggcagctttgatgttcacatcaggctttttgatttcccgttcggcacaaatgccagaaaatattttgatggtttacgtgccaatcgtattaacacgtgcatttggtattggtcgaccatcgttcaagtacgcacagcgcttagtatcacacaattgggtattacgaattgtctcaactttccgccgtcgtttgtatgagttagttgaaacaggaacgaagtctgtttatgcaaagtcacaaaccggtgaagtcctgaatgtgttggcgaacgatttgttcaagattgaaaacttctatttgcgtacgttattcccaacaataattgggttagtcatttacgccctgattggcattggtgttggcgtgttcgattggggattcgccttagcgattttacttgtgttggcgatgacaacaattttggcgccgatggttacgttggcagtgaatggggcgcgagattttaagcaacaacaactagaaggtcaattgtatacggatttaacggatacggttatgggactacaagattgggtgttggctggtcgaacagcggaattggctgatcgccaacagcaagattttgcagcgataaatcgtattaaggtgcaacaagctcactttaattggtggcgtgattttggcggtgccatgattattggcgtggtcgcgattttattgatgatgtttgcgacatcacggtttggtggcgatagtttcggcgtgaattggattgctgcctttgtgttggcgatttttccggctgaagatgcattaacaacaatcagttctggtgttggtgaatggccacgttatcaagattcaatcgttcgattaaacgagatggatagagacgcgacgcaagaaaatcgcgagaccgttacacaacaaccagctcccaatcagtctgatatcatgtttgaccgagtatcatttgggtatacagatgacccagtcttgcaagagttatcactgcaggtgccggccggtgaacgattggccatattgggacagtctggggctggaaaaacaacattgctaaagttgttgctgggtgatgaaagcccaacagctggtacaattacaattggtggtgtaccagtcgctgccttagctgaaactcgtgcatccattatttctgtgttggatcaacaaccatacttatttgcaagcacggttgcgaacaatttacgtctgggtaatttgcatgcttctgacgagcagttgtgggaagtgctagaaaaggttaatttggcggaactggtacgtgggttacccaatcagctggagacgccgatgaccgagatgggaagccgcttttcaggtggtgagcgtcaacgatttgccttggcacgaattttgctgcaagatacgccaatcgtgattctggatgagccgacggtggccttagatccaattacagaattgcaagtcttgcagaccattttcgcaacgttgcaggacaaaacagttatctgggttacacaccacttgaccggaattgagctggttgataaggttatttttatagaaaataaagcgattagcatggctggtacgccaacgaatttgatgacaacggaacctcgttttcaacgattgttggcgctagaccacggtgatttaccaatcaactaatatgaccaattaagaaaggagaagtgtgatggctaggaagaaaaaacggcagtgggttaaaaagctacgtcagattcacccatcacagttcttcgttaaaaagggtcgtttacaacgtggtcgcgttattttagtagttgcccttgtcggtgtccttgcattgtggcaaactgatatacaacatcagcgtgtcgaagcaacgacaccagtcagcgagttgccacttaatgaactaacacatgaacagtttattgcccgtttagcgccagaagcacaaagcttgcaagcacaatatggtgtgaaagcatcaattagtattgcacaagctgctttggaatcggattggggacgttcagaactggcagcgaaatataataatttttttggcgtaaaagcctcagctggcatgccaagtgttacactatctactaaagagttcgttaacgatgaatgggttaccgttaatgctgcttttcggacgtatgctgattggcgtagttcgatgacagatcatgccttgttgttggttaatggcacttctgagaatccgcagcgatatcaggcagtgcttcaagcaactgactataaaaccgcagcatacgcattagttagtggcgggtatgcaactgatccagggtatgctgaaaaaatcattcgtatgattgaaacttataacttgaaccaatatgatgtaaattagtaagaaatgaagcgagaagaattatgagcctagaatttttaccaggatcgacattaggtatcctcggcgacggtgtgacaagccgtactttggcccaaagcgcccacaacatgggctataatgtggctgtgtacagtacaaatccggatgcaccggttttggccgaagcagactatcgatttgtcgaacaaggcaatcagctaacggaatttgaaagttttatggcattgtcttcgatggtgacatacacatcctcatggttaccagccaatatgattaccgaattacaatcagcccgtttaccacaaggcacggaattgttggagttaacagatgatcatgcattgggacgtgctttttcagaagcccagtcattcaacattttgccatatgcaactgttagttctttggacgaagtagctcatgcggcggctgaacttggttatccggttgtggtgaagccaatctttaagcacaagcatcatgatgatacagtcatcctccgtggtgactgggacttgggacttgttgcaccgatgattgatggtggtaccttgatcgttgaaacgtggcttgatgatgcgcaggagtttgccatgactgccgtgcgtggcgttaacggggagattaagacttacccactacgtcaaacaatggttgcacaacaacatttgcgtcgtgcatggacagttggtgatattgctgacgatctcatgacggtgatgcttggtgtgacggaacgtgtcggggatgtcttgcagtatattggggcatacaatgtggcgttcttctacagtgcgaccggtaacttgtacgttcgtgatatcgcagctggcatcccaccaacagcgactttgtatgatgcaacaacgaatgtgtcagttgctgagcaacacctgcgcgccattactgggcaagcgttgactgatgtgcttatgtcgcaagcagccgtttacatgccgtttacggctgatcaaatcgatgcactaagccgtcactggagtatccaatcaaattggaagttttcattctatcaaaacgacatgatgctaccacaggctggacacgttttggcatgtgggtcatcagcaaaccaattgtttaatcaattgcatgttgctggtgtctgggaattcgaagaataatgataaggaggagcgattacgtaacgtattcgctcttttatttggtgaaaaatttaaatttcaataaacgttgttttgatacgaagtgtaagatttgagtgtaggggggattgggaatgaaaaaattaattaaaggcacgctgacctttattggcattgtaattacgatgatgttgagcgggtctttctttcaatctgttatcgacgaatactatgataagcactagtagaattgatagttaatcagaaaaggagtgatttttagaaatcactcctttttattatttttttattcaaaaacaaaataacagatatgataaatgcattagcctatcattacttttttgttagtattaaattatagtgcagtgagttttaagggcttgaatgtccattcacatgccttagttttacaggggagtatggataatgaggggatttaagcaacataaaaaaatgtacaaaagcggtaagttttgggtggttgctggtctaaccgtagtatcgctgataacggctaatgatactagtaaggtttttgacttatttagcgatcgattggggagtgtttttgcagcccaaacaaactcttcggcgaccattgatacggtgactgatgctgacacggctacaggcggtagtcgtactgtttcatggaatggttctagtgcttggaattacagcgacgtgactggattggggagctacaatgggtcaacctggacaggcgaccgtgcgtacggaagcacactttataaggacccagcgggagcttattacacaaaactggtggccaatggtgccagcactgccggttatacgtatctgacacgtcaatttgatgcaacaaaaacgtttaccgttactgggtacctgcacccaaacgtccgtgatgctgatcaatttatgcctcgcgactattctgactggactggtttgctcttgacgccaactgacccgaataagattgcgactgcttacgatttttcatctaagggtggcggtggtctgggtatcgaaggcatgaagaacgcctatgcctttggtattgattttcacaaaaacacagataagaatgacccggctgaaggcccctttggtgccttgcgaacaaccaatagctcgggaacattgactgctacacagggaaagcaaagtggtgttgctggaacagcaacatataccgacgggtacaacctatctaactggagcagtacgattaagtatacgttgacatggaacccaactggtggaccaaacggtggcccatcaattgttgccacaatgacaacgaataaaacacagaacagcgagtcttcaagttggacggtagatacagcgaaggccaaggtaacgcttgcaccagcgacagccctgacagtcgggttgaatgccattaatggacagaataagaatgaccaatatgcatcatttgatagtatgtcgggtactttatcgactggtaccacaaccgttaagtatgttgacgccaacgggaacacaatcaaagatccaacgacatttgtggctgcggttggggatatcattggaatcagcggtctgtcttccggagccaaagctggtacagatgacatggcttttgccgcacccacgattcgtggttatacggcaagtagtgccaatgacgtgactgtatcgcaaacagctggtaataacgttattaccattaaatataagggaaccgtacaacaggaagccattgttaatacgaacaagcctgaactatggaacggctcttccgcgattacatcatattggaacatcgatcaaacaaagccacttggtggtagctcgctcgctagcagcattgtcgatgcttctttggtgcgttcaggatataactataccgtgacggatcccaatggtagttcatacgcgacaatgtcagctgcttatgcggcggcgaccaacgcttgggatagtacagctaatacagccggtgtggcatctgatgcaccaccacaaaattggacagttaactacacggcacagtcgcaaactgcctatttgtatacgcaaaattatacgtacgatggtagttcatacgtgacgtctggtacggcttcatatatgcaaggtatttacggtccaactgatgggtcaatttcgttcaatacaactgattcagccttggcaaagtcaggatacacctacacggttcaaggtccgggtggcgtaactgagtattcaacgctagcctcggctcaagccattgagcgatttgataatactaacaatagtggcagttccgacggtagttaccaaacctttacggtaaactaccgtccggtaacgcaaaccacgagtttggtggttgatgggttgtcaccaattaaggcgggttcaactgtggcttcttcagttggaacaaccagtgccgctttgacaataccatacactgatgcatcactttcaactgctggatacacgtatgttgttaagggcccaaacggctcaacgtatagcacgttgtcttcagcggttgcagcaaattcaatttatgatgcaactaataattctgcggctactgactcttcagctcaggtgttcacggtgagttatattgggcaaacgcaatcagcggttattaagtatgatccgaatggtccactaagtgctggtacaacatttgcatcaacgagtggggcaaccaacactagtatttcgtttgcaacgaacgacggggggctggtccgagcgggatacacttataccgttacctatgctggatcagacaagcctgactcagtggtttacacaaccttgtcatcggcattggctgcgcacccacgatatgacagtacggcatatgctggcacaactgatacttcttcacaagcatttattgtgacctataagaccaaccagtacgctaacttgattacaagtgcggttgatacgtcaggaaattcactattgaattgttcggcaatcagcgaaattgctaatggaccggcaagtagtacgatttccttctctaacaaggactcacaacttgcaaagagcggctacacgtatgttgtccacgtttatgatcaaatgggttcggcggcatcgctgttgggaacttatacaaccttggcatcagccgtggctgctcaaaagtatgacaatacccaaaatgcgacgaatgctcgtacggatgcctaccagcaacagtttaaggtggtttactcaccaaggacggcaacggtaacgtataactttgtggatcaaagtggcaagacaatcagtccggctacttctgcaactggcccggttggatcgaatattccagatggttcaaagctcattcaaggttacacgttaataagttcatcaggtgacaccgatggtaagtttgacgatgacttggtctcaaccattacttatacgtacaaagcacaataccaggcagcaaatgtcgtcgttgatagctcatcaccaattaagatgaattcagctgttgattcagctgctggcgtgacgagtgggtcaatttcattcgcaaagacggactcacaattggcagttagtggatacacgtacgttgtgtatgcaccgaatggctcaagttatgcgacgctttcagccgcaacggcagctaataacttgtatgacaatacggaaaatggctcggggtcatcagactcttcagcgcaaaacttccgcgtgtcatacaaggcgaactaccaatcagcctacattcgtgtacagcaaaattcaccgattaacacagggtcaatgattgagagtgtcacgggcgtaactgacggttcgatgactttttcaacaacggattctaatttggccgtatctgggtatacctaccaagttgggtatggcccagatgccacacacacaacttattattcaacgctggcagaagcgatgtcagccgctggtggtaagtttgactcaaccaataacacggcttcgaccgatgcggaagcccaacgttttgtcgtgaattacatcccaatgagccaggctgcggtgattaatgtatcagctgactcaccaatcagtgcaaattcacaagctgttatgtcagcaaatgggaagactggtagtaccattaactttttaccaaacggatcatttacgacagctgattcacaattggcggtatctggatacacgtacaccttaacttatggcagtgattcaactagctatgcaacactttctgcagcggtatcggctcacaacaagtacaatgcaaacaacacaacatcaggtatttctgatgctaatcctgatatgtttacaatcacatactcagctaacacccaatcagctgtaatcgcagtgacttcaacgtcaccaatttcagctggtagccttgccgactctgcgagtggttcaacgtcaggcaccattagttttgcaaaggacgaccaagctctaggtcaattaggatatacgtacacggtcactggaccggatggtacggtatacagcaatttggcctcagctctggctaataacggcctatatgataatacaaataatttgggcccaagtgatgtggctgtacagagcttcatggtgtcgtatagtgccgcttaccaagaggcgcgagtaatcttggactcgacaggaccatattcatctcaatctgtggctgacagcgcaagcggagttacctcaggcagtttggggttcagtatttcagatggagatttggccttgtctggttatcattacactgtgtggggtcgttacggttcacgacaatatgcaacattaagtgctgcggttggcgctgaaagttcctttgacaacactgataatggttcggccgttactgatagaagaatccaaggattttacgtcgtttacacagctgatagtcaatcagctgttgtgcaagtcgcaacggattcaccaattaacggagggcaaacgctagatagtgcagctggtgtaaccagtggtagcatctcttttgccgcgaatacagaaaatagcctatatagtccgggttaccactacacggtaacaggacctgatggttcaacgtacagcacgttatcatcagcggtcgctgcgaatagcttatttgacaacactaccaatacaggttcaatcgatggtagtgtgcaatcatttatggtgagttatacagctgactcacaaattgttgttttggcggtggattcgaaatcaccaatcgaccgtggcagtgtcattgattccgttcatggaaaaacagctggagaaatcccgttccgtgggactgacagcttggttaataagccaggttattcatatattgtttactatgaaactaacggtgagcgaagtgaaccttatgcaacgttgtcagccgcacaggctgaccatacgacgtttgataatacaagtaatgacggcactagtgatgcggatatgcaatcgtttatcatcagctacgtagcgttgaagcaacaagccacaattgttggggatgccaactcaccaatttatgctggttatcaaggaccaacgacatccggagtgacaaatggttcgatggctttgccactaagtgacggtgatttgtatgaacaaggatattcatacgttgttacggggccagatggttctgaatatgctacattgtcagcggcatcggtggctaataatgtttacgacagtactaacaatattggaaattctgatgccgatattcagacgttcacggtttcatatgtcgcgcagtatcaatcagctgcattgattgctggttcggcttcgaacttgccgtctaacgttacagctggattaacttttgcttcttctgctggtgttactagtggacgagtatcatttgctacaagtgacagtgacttggctcgttcaggttatcgttatacgatttctacaccggatgggacaacatttacaacgttgtcttcagcactcgctggttcaactggattgtatgataatacggctaatgccggagcatcagatgcctcggcacagcaatatactgtcaattatttaccagaaattcaaacggctcgtgtgataattagtgaaacaactggtgatgagcatgctggagaagtactttcagagtcaacgggtaatacgaatgaaaaaatttcatttacgctatctgatggttcagatttgaacgatacaaatttgcaaaaattggaaatgaccaaaggttatacctatacggttatagttgagcatccaaatggaagtacgtctggtccatacgcaacgttacaggctgcgtatgatgataatcctgtatacgacgatgataagaaaggaattacaactttcattattgttcctcaagcctcatatcaagaggcggttgttaatattggctctgctgggacacaatcagactacgcaacgagcgctagcggtgtaacaagtggggcaattaattttggcgacttggaatctagcttggcagtgtctggttacggctatacagtaacggtgatagacgatgatggtaatcgtattgaatatgcaacattgtcagcagctgtcgcagcagttggaaactacgacaacactgtgaatggctcaaaccaatctgatagttctgcacaagcatttgatgttaactacaccgccgattatcaatcagctaatgtaacgttctcaggtgcaccaatgtcatcagttgcctttgttggtgagacaagtgcaactttggagtctacgaagttcaccgctgattcaggttactactttgacgctcagcaaccatcatactcaggtgcaacaacaagcgtttcatccgatggtaaagagctttgggtatcgtttacgtacgacgacacaaataactcagcagcttctgatagtgatccacaaaactttgaatttacgttgcaaccggcaacgcaacaaggaaacattatgtactcgtattcaaatgcggttagcgtgccaagtgatgcatcagcagatgaatcattaagtggtaaaactggccaaccacaatcaggcactattaaggcgccatcaggttactacattgcagctatcaatggtgatcaatataatgtgacatacaatgatgccgccacagaagccgagtacaccttgctttgggatgacacacctaatggaaatgcggcgactgatagcaaaccacaaaatttggtggtcatttttgcccctggtaatcaaagagcaacagtcagtcagacaatgccaggtggaacaactacaacggttaacacccaaaatggtcgtactgataaggattattcatacgaatacactgctccatcaggatattatgtggctgatgatggcattacgacagacggcaagagtcttattagtggtgttattttatctgacggcacaacggtgacgtttaccggaaagtttgataataattacacgaactatgcggatgaaaacggggtaacggaccctgaacctcagaacacaacgattaaactaacggcttctacgcaaatcgcacagttccaaattaaagtccctgatggtgcaacatcagtttcacaaagtacctcgacagttcgcggggatacgggtaaaacgattgaagcgccagatggctacacggatgaggaattgaataaggtgaagggttacacgtacacagttactggcccagatggtgtcgtatataacacaatggctgacgcattagctgcgaaccctaacttcgatgaaactaataatgggtcatcagacactgatgctgaaatgcaacaatttgttgtcaattacaaggctgaccaacaaacagccacaattacacaacaatacgccgacggtgctgagaacactcctgcgttcccacaagcgaaccaaacattgacgaatggtactgatcaaatcacgactggcacgattaccgcgccaaagggatacaagatcgatactgtgccacaagttgcggggatggtttggaatatcgcaacagatggttcttcggcaacatataccatcacgttcgacgtggtagctgataatgacggggccagccaagcagctgttgtcacatatgtccctgttgaacaaaaagtgcgggttgatttgtacgacgaggttggtcgcccattgactgatagccaaggcaagcaacaatacattctgactggtcaaaccaacaataaggttgattacacacagattgcaccagaagtaccaggatatacgttaacttcaaacagtcgaaatactgcgttgacatatgataacgattctaatacgacgcaagttgtcaaatatatctatgccgatgtgacagagccagttgtagcaagcgataaggttaaaaataccatgacagcttcaacaaccggtgcgcctgccactgaggctgatttcctgaaggcgattaattatgttgctaatacgaggactgaaagtgatactgtaacggataatcaacaaaatgtaccgggtgacggtattacgatttcgtctgactatgagacggtacttagccgattaaaggctagtggcggggggactgcaactgtaacagtgacggcgatggatgcatcaggaaatacgacggattggaccgttaaacttacgttgattgaaacatcaccagtatcaaaagaagcgaatgtagctaatgcacaattagcgcttgataagctagcgagcgatccaacagctgctacggatgatgttgcgactgcccgaaagaatcttgaagatgcgattaacgaggctaaacaagatcgagcgactgcagaagatgcagctaaggcagcccaagatgtagctaatgctagtgttgagtctgctaatccacaagttgccaaggcacagaaagatttgcaagatgcattggatgcagctgcaaatgataagggtacgacccaggcaattgagaatgcgacaaatgcgttgaatcatgcagtagctcgggctgaggcttcttcagtagatactgcaccggtttcacaagaaccaggtgtgacagaggctcaacaaaaggtaaataacttgttagaccctaatagtactgcaaccactgaggaaattaagcaagcaacccaggcattggaagacgccgttcaaacagctaaggcagagcgagatgtagctaataccgatgcaaatgacgtgcaagaccaagtagcggatactagcagtcaagcggtgaaggatgctgttcaaaagttggaagacttgcaaactcaggcagcagcagatggagcaacaacgaatcagattaagcaagcaactcaagatgttgttgatgccgtcaagaatgccgctcaggcagcactggacgcaagtacaacaccagttacaaatgaaccaagtgttcaggatgcaaaatctgcgttggaagatgtgctaaatgatccaaatagcacaccaaaggaaattgttgatgcaacaaacgcctatgagaaggcggttgctgatgcaaagcttgatcgtgaggatgcaaacgacttggctcaacaagagcttgaggaagcggccacttctgatcaagcgactgatagcgccgtactagaggcgcaaaagaagcttgcagacttgctagagaaggcagctaacggtgatgccactgcgctaacccaagatattgctaatgccaccaaggaactgcaggatgctgtcaatgcagctggaactgcacagacaacagctagaacggaggcaaatgccacacttggtcaaacggcaccggtttctaatgaaaccgatgtaagtgacgccgtgaagaatttgcaaacagtcttaggtgacccaaagtcaacagctgatcaaattacaacggctactaagttactccaagatgctgtggacgatgcgaatacacaacgtaatgcggcaaacagcaatgcagtgtctgcgattaatgcagccagtgcatcaaaccaggctgatgagccagaagttcaagcagctgtacagaagttgcaagatttgattgatcaagctgccagtgattctgcagatgcgttgacgcaggatattattgatgcaacaaaggcattgcaagatgtggttaatgttgcagcaacttcacaagaagacgcgcgtcaagcagctgaaactgcgttgggtgatactgcgccagtttcaaacgaagtggctacgtcagcagcgggtacagagttgaacactgttttgaatgatcctgcggctacagtcacagcgattaaggaagcaacacaacaactccttaatgcaactgcagctgataagtcaaatcgtagtgatgccaataggcaagctaatacagcaattagagatgcgcagaactctaatcaagcaggggaacctgaggtgattatcgccttgcaaaagctaaaggatgctcaagcgcttgcagctaatgattcatctgcagcactgacacagactatcttggatgatatccaagccttaaagaatgctgagcagattgcatggcaaaaccaatcctctgcacgttctcgtgcagaggaggcaatggataacacaccagctgtcactaatgaggcgaccgtacagagcgcgttagataatctaaataacgttttgaacaatccaagttctacggttgctgaaattgataatgcaacgcaagcactcactgatgcaacaaacacggcgaaggcagatcgtgatgcagctaatcagaaggcggatacagcaatttcgaaggcgcagaactcaaatcaaggtgcggaacaaactgttcaagatgcaattcgcgctttgcaagaagttcaggaagaagcagcgaacgactctgcagatgcgttgaccgccgatatccaacaaaagatagcggaattgcaaacagcagtgacagcagcagctaagacccaagaagaagcacgtaactcggccgacgatgccaagcaacaaacagcgcctgtaaccaatgagccagctgtacaaacagcattggacgagttgaacgaggtattgaataatccggcatcaacggcagatgctattaagcaagccacacaacagttactgaatgccactgaagatactttggaagatcgtgatgcagctaagctggatgcacaaaatgcgattactaacgcgttaggatcagatcagtcagctgaacctgctatccaagcagccattaagaatttgcaagatgttatcaagaacgcaaatgctgattcaccggatgcgttgacagaagatattaaaactgcccaaaaggcgttggaagatgcgatatcgggtgctgacgccaagcaacaagaagctcgtgatgcggcgcaagacttaatcggcaagacggcgccagtttcaaacgaggtagcaacggctcaagcccgtaacgcattagagtctgtattagctaatacattggcgacagcaaacgatattgaagaagctacccagactttgcaggaagcattagcagctgataatgaaaagcgtgatagtgcaacaacgactggtaatcagttaattgaaacaactaatgcgggagcaacatctaatgagccactggtgcaaaaggcattggctgacttacaaaatgttgttaatgaagcagcaatggatacaccaaacgcgctgactaaggatattcaagccgcaattgatgccttaaacgccgctaacgatacagcgaaagttaatcaagcaaccgctcgagaggcagcagacagtgctatctcacaaacggcgccggtatcaaacgaatcagcagtgaaagacgcgcaagacaaactacagagcttgatcaatgatcctacgtcaacggctaagaatattgagggtgcaacaaagacgctgattacagcaactgcaacagctaagagcttgcgtgatgacgccaatgatacggctgaaacaacaattgacggtgtacaaaatgatgatgttgctaatgaacctagtgttcaagccgcaattgaccgtttgcgtgatgtcatgaatgaggcagctgctaataacgagaataatttgacagtcgatattcaacgagcaaccgatgacctgaagaatgccattactgcagctaatacaagccgtcaaacagcggttgatgcagccgaaacattacttcaacaaacagcaccattatcaaatgaatcggcagttagtcaatcggcagataagcttaatgatttgttggatgctctcaaggatgatgttgtttcaaatgatccaacaaccgccgaacttgaagtggctaccaagggcttacaggacgcactgcaagcagagggtcagaagcgtacaacagctaataacgcagctgaaacagcgattgaccaagctaagcagtcaaaggtcgcgggtgattcggccgtacaagatgcgctaaaccacttacaagatgtgatgaataatgcggcaaacaatgatccagatgccttgacggcggatatcgagtcagccacgaaggctgtacaagatgcgatgaacgcagctaagtctgaccgtgacgcagcgacaaccgatgcgaataacctaattggtaaggtggcaccaatttcaaatgaaccaggtgttgcagaggccttgcaaaacttgcaggatgcgttgaatgggacaacaactggcagcgatatccgagatgcaactacgaagctacaacaagccttggatgcggcaaacgcagctcgtaacacagccaatgatgctggcaagcgagcaatcactgatgcgaacgtttcagcggtcgccactgatccagcggttgtatcagcgatgcgacacttgcaagatgtgatgaataatgcagctaatgataatccagaggcattgacggcggacatcgaagtggctattgaagccttgcaatatgcgataactaatgcgaaaaaccaaggaagtggggagcacccaacggataacacaccaggtgaaactgaaccaggcacaaccttgccagattcagttacgactgtaccggcccctggacaaacgcctgagcttgtcgatgttatgccatcggtttccgattctgatgcgccgattcaactcattgaaaatagtcagccacagattgtagcaagtgcatttggaccaggttcggttcaattaccatatacagcggctgacggccaacgacagaactggcacatggtatcacttggaatctacttgttctcaacaatgttcttgcttggggctactaagcgccgaaagaatgaagataaaaactagcggatagtctaatagaaaaggagtgaacacactgtacgggatacagcgtgttcactcctttttggttgaaaaacggccagtacagaatgtgtactggccgactctcatctcaatatgcaattaacccatcatgacttggaacaatgtgataaagacaccaaggaatgacagaatcaacatcaaaatgacaaatccttggataaccttttgcatagtagacttttgcttcttctttgccatgaagtaatcctctttttcttaattacatctattgtaccaagatttcagttcaaatggcacagacgtttaaattcacggtataatataatgattgaagaacgaaaaggggaaacaacgatatgcttacaacgcttgactggcaattaacggttgccttagcatttgcgacatggattgggttgattttgtttcaccgcttgtttcgccgtttaacttggccaaagtggatgcgccccattgacttagcgactttggttgcttggtgggctatcgaggtcattagtttccaagtgtggcacctttctttattgccgccaatcttgtttatgtttgtattgtggggcattggcttggcattgtatcaaggatttgttcgacaaacatttacaacgaagacgttttggatgatgtggtggcgcattgttggattaggtagttttgtagcgttgattggtttggccatcttcgcgttcattttaacgaaatagagagaataataattatggaaaagattgatggatacgttaagacttggaatgctgacaaggggtttggtttcattgaattgaagggtgaagatgacgtttttgttcatttctcagcaattgaaacacctcacgttcgtgacttggaagtcggcgaaccagtaaagttggttgttgtacaaggcgtacgcggaccacaagcagcagcagttgaagtttggagctctgaggagaactaacatggcggatgaatttgaagcaaagtttcgtgaagaagttatttcagaagaagaagtatacaacggccacattattcgggtagttaatcaaacggttacgttgcctgatgggcgtgagtctaagcgcgaggtggtacatcacagtggtgctatcgcggtgcttgctttgacggatgacgataagatgattttggagcgtcaatggcgtgcaccagttcaaaaagtaacaactgaagtgccagctggtaaggtagacggtcgtgatcacaatcctttggatacagttaaccgtgagttgaatgaggaaacgcgtttgacagctggaaagattgaaaagattgccggtttctacacgtcaattggctttgctgatgaattcatgaccctatacttggcaacggatttgaagccagtgactgatgagttaccacaagatgacgatgaacaaattgatttgctttacgttgattttgatgaggcaacgcgattgtttgaggctggtgagctagatgatggtaaaacagcgatggcgtacctttactggaagacgcttcgcttggcgggtaaagcgtaatgtttggattcaagcgtagaagacaggatgaaaacctctcagatgaagattatagcttcgctggcgagtttgaaaaacccgaaaacacgcaggaacgactaagccgattgcgcggtgagtctgagccaacgaatacgccgctgacccgcgaagagcatcgtttaagtggtaaaggacgttacgaattggatccggtaactcgccgcttaacggaagctggtaagacggcccgtctaaagcgccggttaaatatcacaataattgtgttgattatcctaattgtggtaacttacctagtattgttcctactatagtaatagaagtattaagttgaaagtgagattttgagagatatgcgttacggtattattaatgcaatggccgaagagaaggcagccctagtggcagcaatgactgatgaaaagcaatcaaccattgctggtaagttgttccaccacggtaagattggcaacgttgatgttgttgttgttgagtctggaattggtaaggttgcgtcagcattgacgacgactttgttgattaccaattttgcggttgatgccgttattaactcaggttcagctggtgctttgggcgctgatttgcgcattggtgatgttgttgttgccagcgaattggcatactcagacgcagacgcacgtgcttttggttatgactatggtcaagtaccacaacaaccagcccgttttgtaactgatgcaacgctttcagctggtttggctgaagcctatggggatgttacggacgcacgcttggttcgcggtttgattgtgacgagtgattcatttatttcaggtgatgagcaaaagcaaaacatcttgaagcacttcccagaggcccaatcagctgaaatggaaggggcatcaatcgctcaagttgcacactactttgatgtaccatttgctgttgtccgcgctatttcagataacgccaacggtgaagctggtccaactttcgatgagtttatcatcgaagcaggtaagcaatcagcacaagtgttgatcgacttctttaacaagcaataatgatgaaggctgttattccatcttggggtaatggcctttttattttgcgtcctcccttatcgaatgagacgttaatcacggcaataaaacaagtttcctactataatatagtcagcaatagggaataataaaattaacttacaaaaagtacacctttttatttcccatttaaatttacttctggtattctaattacattcaataagagaatcacataaacgaaggagcatccgaatatgactatccgtggaattcaccacttgacgacgattacgtcagattcaccaaagatttttgatttcttctcaggtgttatgggtcttcacttgattaagaagactgttaaccaagacgacgtacgtacgtaccacttgtactttactgatgacatgggatcagctggaacggttttgacgttcttcgacttcccaggcatcaacaaggccatccacggtactgacgaaattacgcgtacggctttccgtattccatcagacgcatcatttgattactggatgaagcgttttgacgaatacggtgttaagcacgacgctgaaactcacgaagagttcggtgttaagtacttggacttcgaagacttcgacggacaattgtacgccttggagtcaaacgagaagaacacgggtacttgggctgaaggtacgccatggcaatactcatcagttgagccagagcacgctatcctaggtttgggtgcacaattgttgacgatcaacaacgagaacgcaatgcacatggttttgacatctgtattgggtgctaaggaagttgctcgcgacggcgatgacgttttgtacgaattcgacaacgctggtttcggtggtcaagttcacacgcgtttggtacgtttgttgccacgcggtttgcaaggttacggaaacgctcaccacttcgccttggcagttgatgatgaaacggctttgaacttctggatcaaccgtttgcgtcaattgggattccaagactcaggcttcgtggatcgattctacttcaagtcagagtacttccgtccaacaccaggaatcttgttcgaaatcgctacgaacggaccaggattcttgcaagacgagacatacgaagaggctggacaccacttggagttgccaccattcttggagaacatgcgtgacgaaatcgaagctggtttgattccatttaactcagctgaagatgatttgccatcaccagaagtgttcaagaagaacgtttctgataatgcagaaaactaattaacatgattgaagcaggacgtaagcagcgcttatgacctgcttcttttgtatccggacactatcgcttgttaaaagttagcgcttacaggtataatggaaacacaatttgaacggagaataggacgatggccaagaaaaagtataagaacaatattcgacacgcctatgtatcaggtgatcctgatctagcccctttgctattgctacacggtactggtggagatgaaacggatttgcttgaaattgccgaatttatggcacctgagaacccaaagatttcaattcgtggtcgtgttagtgaaaacggtatgaatcgttattttgaacgctacgaagaaggtgagttcaatctagagtcacttcacgcagaaacggattggctggttgatgcagttcacgagctttctaagcgttacgaattgcacgaagaatcaatgattatgatgggattctcaaatggggcgaacgtcggggcgcacgcgatgatggctcgagaagacacgccatggaagacggcattgttgttccacgcgatgtcagttgagcgcttgggtgatgatattcaagatttgacggattcacgtgtctttgcaacgttcggtgagtttgacccgattatttctgaaacaaactttgatatgttgactgaagacttgcgtaagggtggcgcgttgttgtctacatttgcgacgaagacgtcacacacgatgtcacaacctgaaatgcaagctgctaagctttggttggatgccaatgacttgttggatgttgatgacgagcctgaatggccagcgtcattgatgtacggtgcggatgaacacgaccatgaccacggacacgatcacggacatgatcatggtcacgacgaccaccaccacgaggaagatgaccatgaatggcattatcctgatggtcaaccagccgacgatgaagatgtagtggaaaagttgcccgaagactagtaaacttattcacataagaactagttaagaggagatgtcacgatggcatttgaaacaacggtaaaagtacctggggattcagtaacttaccattttaacccgcaattaaagaagtatgcattgggcgacactggttttgtaactaacaacgccggtgcgtacgttatgcaacgttcactagagccggctaagggtcttgcaaacgcaatcaagcttaaggtagtagtgaacaaggacttgacgggcatgaaaattaagacagttaacccaaatggggcagcaactgttaatattttcgcccgcaaagacaatgaagaaatggtcgagttgtaccatttctacttgaatgagttggttgatcgagaaattttgacggttgattaatatcaataaacagaaaagagcattccagcatcagttggaatgctcttttttatgcatgaaatgttaaggaatcctttagtttagggcttttctggcaattgtcttctttttaaaagttaatgaaaaattgaatcgttacttttatattgtaacaaacgtgacataaaaggggcgaataaactaaatttaaacctaattttgcgtaattagtcccgaaaaagcccggaatgtggcgattgttaactggttaatgatgttttttaaaacactattctaatcgacgtttgaacacttatttttagtaatgttacgtaaatgttacaagaaaagccggattaggcaattatgacgttacgtaatgactttattttgtaacaaaacgactgttctgattgataaactaatacatgttgttaagagatgcaggtgtcacacattagcgatgatcctagtggcgtgtacctgttagtaattgaaaagatagagttaattagaaggagagtttttccccatgaataagaagatgattactgcattgactgttgctggcttggctacgttcgctatggccgaaaacgcatctgcagatacgtacacagtacaatcaggtgacacgttgtcacaaattgcagctaaccacaacacgactgttgacactttggttgccaacaacaacattgctgacgctaacgtaatcttcgttggccaacaagttgaaatcgatggcgttgcttcaaacgcttcatacgacgcaacacaagctgatgttgctgctgttgttgcatcacaagcacctgttacgcaacaagtatcatacacggcacctgttacgacggttgactactcagcacaatcacaagcaccagttgcccaagaagtatcatacacggcacctgttgcaacgactacgacgactgcagccgcttcaggttctacttacgatcaatttatcgccgctggtggaactgacgctttgtggacggctattgttatgcctgaatcaggtggaaacccagacgcatcaaacggtcaatacaagggattgggtcaaacgaaccaatcatggggaacgggtagcgtttctgaccaaactgcaggtatgttgaactacgcaacgtcacgttacggttcagttgattcagcaattgccttccgtgctgctaacggttggtggtaagatactgctttaagtaattaaataaatcgataacacaaaaccgccacgcttctagtttgaagcgtggcggttatttgtttactctgctttgtgatttttagctgcttcggggaacgttagtacggaacctttaataggccacatccagtacttgtcgtttgcgagaagctgcatttgtgttgagtagacatcgtttggcgttgcaactgtggtgatgtctgttaggtgactaaaatcaaaacgattaggcactaatatttgtgagaccaagtgtcggtcatcgtcaattaaaatgccttcaccctgatcgtcgtttgcaagaataagtaaacgttccatgatatgctccgttctatgattagatgtcacggaataactcttgccaagcagctttattcaacttcggcttcttgcgtcgtggttggcgttcttttggtacgtaagttgcttttttgtactgacggacaatctcagcctgtacatccttttccaagggtaattcgttggaaacaaaatcaactgcgtcaatcgggaaatcaggatatgcggtgtggttatcaataaaccaggcgcgcatctctgaattgaggccagcgtgacgacgaatacgttgcaatagttcatcgagaccaaagtccaagtggtgaatttgggtctgcaattgacgcataacagcttctggaataccaatgtggtcagcaaagtgagtgatgccaagcttgatgagcttaccatcttcgttttgcaacacatattgatgcttcaaacggcgaccacagtcacaatacagctgtggtccagaattgctatcgtaattgtcattatagttgtaggcaacgaattcccaatttttaccatggccaaccaaattctggtcaacaaacaatgaagtgtgttgatagcgaatgtgttgtttcaagacagcctgctgttcgggcgttaagttatgccatgtttcttgtcgtcgctcacgagttagagcgactttttttgtttttgcagttgccatttgacgctcctttcatggttaaatcgcatgacaactattatacgcttgcttagtacccggcctcaactagacgttggcgcatggccttgtagacgcgttctacatcgcgggttgtgccacgtagctcgtagttagcaatgacaggtgcatcgaaggcctgagcgtaacgtcgcgctgtcagaatatactgcgcattgaaattcttattaccagacccaataatgcccaataattgttttgcgttatcagcagcagctatctgatcgtagagtgcattagtcataatttcatgcacgccgttatcgataccattgccaccgtctaaataagttgggactaaagcaaagtagggtgcgacctcatcggtatcagcactcgcatccgagatttctacgggttcaaagtcaacgtcaccttgttcgtgagcgaaagtcaccaggtttttaacgaaggaccgcgtatttccggaaattgatatatacaaaagacgaactttcatgatgttttcctcatatgtttctttaccatttattccactatacactagcacaatcacaaaaaacacaccctttttgtacataacggaaagttatatttaatgattttgtaataaactattgggaagactgatatggcggtaaatagcgctgtcaagcctttttttcttcaaaagttacgccttgcattctgttatgtacctgactatactcagagacagatattagcaaatgtcagaaaatataaaaccgaaagataaaggtgaataatatgcaaaatgttacggtatatacgaagaacaactgcgtgcaatgcatgatgacgaagaagacgttggcgcaatacggtgtcagctacgttgaaaagaatgttgaagaagatgaggcagcattgactttcttgaaggaccaaggttaccaagctgtgcctgttgtatttacaaacgatgctgagccaatcaagggcttccgacctgacttgttggcacaacttgccaaggcaatgtaacaagacgaacaactagttgttggcaagactacctaaacgtcggtgcagccatgggggttccgctttacgttaggtaacacgggggaaaagatatgtcacttgctactttggacctagataaggtcacctactttgatttaaataatgaattaaatattcccaaggataacagtattcaattgggaaaagacaaggaagctttggaagctttcttggcagaaaatgttcgaccaaacacactccaatttgattctcttcgtgatcgcttcgattacctaattgaacatgattttgtggatcaaaagatgttggacagttattcatttgcgttcattgaacgtttgtacgactatctaaagagtcaagatttccaatttaagtctttcatggctgcgtacaagttttatgcgcaatatgctgttaagaccaacgacggggatttttatgtcgaaaactatattgatcgtgttgccatgaacgcgttgttctatggcgccggtaatgaagaattagccatgaacttggctgatgaaatgattcaccaacgttatcagccggccacaccatcgtttttgaacgccggccgttcacgacgcggtgagttggtgtcatgttttattttgcaaacaactgatgatatgaatgcgattggtcgtgtgattaactcagcattgcagttgtcaaagattggcggtggggttggtattaacctctcaaacttgcgtgaagcaggtgcaccaatcaagggtattgcgaatgctgcttcaggtgttgtgccagtgatgaagttgttggaagattcattctcatactcgaaccaaatgggacagcgaaatggggctggtgtggcttatttgtcagtattccacccagacattatgggctttttggcaactaagaaggaaaacgcggatgaaaaggttcgtgtgaagacgttgtcacttggtgtaacggtaccagataagttctacgacttgattcgttcaaatgctgatatgttcttgttctcaccttatgatgttgaacgtgaatatggtgagccgtttaattacgtggatatcacggctgagtacgacaacatggttcgtaacccacgcattaagaagactaagattcgtgcgcgtgacttggaaaacgaaatttcaaagatgcaacaagaatcaggttatccatatgtgattaacatcgatacagtgaatgcagctaatccaattcacggtaaggttgtgtcatcaaatctttgctcagaaattttgcaagtgcaaaaagcttctgaaattggtaatgatcaacaatactacaagatgggggcagatgtttcatgtaacttggggtcaactaacatcgtaaatatgatggaaacgactgattttgaacgttcagtggacacgatggtccgtgctttgacgttcgtttctgacaactcaaacttggatattgtgccttcagtgcaaaatggtaatcgcgaattacacgcggttggtttgggcgcaatggggttgcacgcattcttcgctaagaaccatatgcactatggggatgaagaggcgattgacttcaccaacgcctacttcttgatgttgaattattacacattgctagcttcaaacaagattgctaaagaacgtggtgaatcattctttgagtttgagaagtcaacttatgccgatggttcatactttaataagtatttgatggctgattggtcgccaaagactgataaggttaaggcgatttttgagaagcaccatttcccaaccaagcacgactgggcaatgctcaaggaatcaatccaaaagcacggtttgtacaatgcttatcgcatggcgattgcgccaacgggatcaatctcatacgtgaatgattcaacggcatctttgcacccaatcattaacaagattgaggaacgtcaagaaaagaagattggtaaaatttactacccagcaccttacttggggacggatacattgccgtactacgagtcagcttataacttggatatgcgtaaggtgattgatgtctatgcgacggcacaacaacacatcgaccaaggaatggcattgacgctgtttatgcgttcaacgattccggctggtttgtatgagtggaagaatggtcgtactgacaagatgacgactcgtgatttaaacatcttacgtatgtatgcttatcacaagggaatcaagtcgatttactacgttcgaacttacaccgatgatatggaagagtttggcgtgaacgagtgtgaaagctgctcaatctgattaattggaattggtcacattaaaaatgtagagctggtataatcaacaccagtagctcggaaaacggtcagtgagtgaataaattcctggccgttttcgtatgaaggggagaaccgcgaatgactgaaggatatgttgcaatcaactggaataatgttgaggacgcaatcgacaaggcaacttgggaaaagttgaccgaacaattttggctagacacacgtattccattgtcaaatgacttggatgactggcgtaaaatggctgaaaacgaacactacttggtcgggcacgtatttggtggcttgaccttgctggatacgctgcaatcacaagatggtatggcatcattgaagaagtctgttcgtacgcaacacgaagaagccgtattgaacaatatcgagttcatggaatctgttcacgcgaagtcatactcatcaattttcgaaacgttgaacacgccagcagaaattgaagaaattttcgattggacaaataccaacgaatttttgcaatacaaggcacaacgcattaaccagatttatcaaactggggatgacctacaaaagaaggtggcgtctgtatttttggaaacgttcctgttctactcagggttctacacgccactttggtacctaggccacaacaagttgaacaacgttgctgaaatcatcaagttgattcttcgcgatgaatcagttcacggaacttacattggttacaagttccaattaggcttcaatgagttgcctgaagataagcaagaagaaatgaagatgtggatgtatgacttgttgttggatttgtacaacaacgaagaaaactacacgaagcatctatacgatgagattggttggacggaatcggtactaacgttcttgcgttacaacgcgaacaaggcgttgatgaaccttggtcaagatccactgttccctgatggggctgaggatgttaacccaatcgtcatgaatggtatctcaacgacaacttctaaccacgacttcttctcacaagttggaaatggttaccgtttgggtcaagttgaagtgatggaagatgatgattacaacattggcctagattaggttgcattacaaaaattaaaatgttatcataattttcaagatgaaacgttaggtggaaacagttatgtttaagacgacagtacaattgaatggttggtggcgcagctaacgcgtccgaactgtggttgaagcagattcggtacgtgctcttttggagcgtaagtattgagtctgtgccgactgatttccgttaacgaaaggtctgcacgggttaccgcgcaggcctttctttttaccgcgaaaggggcacgcaaggtgactctttcgcggtttttattttgcaattatttacggggtaaaggttatgaacaagaaagtattgactgctgtcggcttactagctgcagtacttgttgcagcaggggtccaagaatcaatcgcggaacacaaagcagctaaagttccaacagtgggtgtgttgcaatttatgtcacacccggcgttggatgcgattaataagggtatcaaagagggcttagcagatagtggttacacagtggggaaggacgtcaaaattgatttccaaaatgcacagggtgatcaatctaatttgaagacgatgtcgacaaagtttgagaatgagggtgccgcggtttcagttggaattgcaacaccagcagctgttgcgttggcaaacacaattaatgacaagccagtagttttctcagcatcaacgaatccgttgagtgccaagttggtgaagagttataacaagccggggggtaacgtcactggggtttctgatcaggcgccactcgaggcacaattgaaaatgatgaccgcgtttttgccagagatgaagacgttgggtgttatctacacatcatcggatgattcagcaaccactgaagctcgcaaaatgattgcattggctgaagaagcaggactaaaggtgaaggcgtactctatcgcgtcatcaaatgacttgaaccaaacgtcattacaaatggttgaaaatcataatgtcgatgcggtctttgtgccaactgacaacacaattgctggtgctatgacgacattgattaagaatacagacgctgccaaggtgccagtgttcccaacggtcgatacgatggttaaggatggtggtgtcgctgccgagtcaatcaaccaaaaaaacattggggtcatgactggaaagatggtcgcgaagattttgaagggtgccaaccctaagacgttgccagttgattttacaaagactggtgaattggttgtgaacaaggcccaacttgagaagttagggttaacgatgccaaagggctacgatcacgcaaagttcgtgaagtaaggagaacggtatgaatattttagtttcagcgattgggcaagggcttttgtgggcaacacttggaattggactctttttgactttccgtatcttggactttcctgatatgacagttgaaggaacttttccgttaggggctgcgacggccgtgacattaatttcaaacggtatgaatcctggcttggcgagtttaatcgcagctggtgcaggtgcattggcaggtttggtgaccggtttgatttacaccaagggtaaggtgccgattttgttggctggtattttgacaatgacggcggtttactcaattaacctgcgtatcatgggtcaggccaaccgttctttgcttggaaaagggacgctattttcagcagatttccttgatttcttgcctaagaacttcccaacggtggttgttggattggtcattattgttgtcgtaacagcagcaacggctattttcttgcaaacggaacttggtcaagcgttcattgtgacgggtgacaaccgtgcgatggcgcgttcacttggtgttaacacagataacatgacgattatggggttgatgatttctaatggtttgattggcttgggtggtgcattggttgctcaaaataacggctttgcggacgttaacatgggaatcggtattatcgtcgtcgccttggcgtcaatcatcattggtgaggttgtgtttaccgaccaaatgtctttgacagatcgtttggtaacgattgtcattggctctgtactgtaccgctttgtattggttatcgtgctttacttgggcttcaacgcaaacgatttgaacttgttcagcgcggtggtacttggtattgctttgacattaccacagctacgtaaggtgttgaaactagatagcgttttgaagaagggggttgcctcacatgactaagacaagtttacgattagaaaatgccacggtggtggttaaccaaggcacgcctgaagaaaaaacaatcttgaataatgtttcgttgacgttgaacgaaggcgattttgtcacagtgctggggtctaacggtgctggtaagtcgacgttgttcaatgtgattgccgggtcacttgcattgacgagcgggcacatttacctaggtgatgaggacgtgacgcgcttgtctgaaacccagcgcacgaagtttttggcacgtgtgttccaggatccaaaattaggaacggcgcctcgtatgacggttgcagaaaatttgttgttcgcggaacgtcgtgggttgtcacgacgcttgaagggacgcggattgaccaaggaaaagatggctgactttgctaaggtcgctgcaacgatgggaaatggtttggattcacgtctgaatgttgcgacgggtgacttgtcaggtggacaacgtcaagcgctatcgtttttgatggccacgcgtttgcgtccagaattgttgttgctcgatgagcacacagcagctttggatccgaagactagtgagcaattgatggcggtcaccgacgaacgcattcgcgaagatcatttgacggccttgatgattacgcaccatttggaagatgcgattcaatatggtaatcgtttaattatcatgtcggccgggcaaatttcattggatgtgtccggtgaagaaaaacaacaattgacggtgcctgatttgttgggttactttaatcgttattaacataagcataagcgagggcagcatttcggtgttgccctcttttttgatcacagacatattcaccccatcgcggggacaaaagtggtaaattaaaaggtgagtttttttacggaggtgtgagatgaaaattgatcggacacgcttgctaacagttggtcgagccgtagtggtcggcattctggttggtatcgtcgtcagtacatttcgttggttggttgagctgattctagatcagtggcgtcatgtctatcatcaacttgttgtatcaccagataaggggttctggttggccggcacaataattgccatgattctatttacattcattgttggccaaatcattaagggtgaccctaacgttaacgggtctggtattccacaagttgaaggacagttagctggacagatgacggttaatccgttttctgtgttgtggcgtaaatttacagctggactattaacaattggttcaggtgccatgcttggtcgcgaaggcccatcaattcaactaggggccgcggtcgcccaattatatggtgagaagcgtggctttgattcccgtaataacaagttaatgattgcgatgggtgcggcggctggtttgtcagctgcatttggtgcaccggttgctggtacgttatttgtacttgaagaggtttatcgcacgttctcaatgctggtatggcttggtgcgttgacgagtgccgttgttgcggacatggtgtcagttaatgtttttggcttaacaccagtgctaagtatgacgaatttgcataacttgccgttagttgattatgcctggttaccagtattgggtattttgttgggcttgtttggttacgcttatcagcgtgcaaccttgtgggcaccaaacatgtttcgttggttaaagtggctaccacgccattaccactttattgttgtgttcctgttattgattccagttggtatctgggcaccgcaagcccttggtggtggggcgagcttgattttgcatgacgctaactttgtgccgacgattagtgtcttggttggtctaattattttgcgctttgtgtactcgactattgcgtttggttcaggggtgccgggtggtatcttcttaccaattctaacgttgggagcgttgtcaggtgctttgtttggtgctgtgcttgttcattttggattgcttgcaccaatcaatgtgatgaatatgatgattgtcgggatggctggttatttcgcaagcatttcaaaagccccatttacagccatcgtgttgattgctgagatggtggggtcgatgacccacctagttgccatggcaattgtagcgttgattgcttatctagtggtcgacttctttggtggtgaaccaatttatgagtcattgttggctcgcctgcgtttgccagatcaattatcagcattgcgtggtcgtttagaagaaatgacgttcgttgtggcgcccggtagtgcgttggaagatgcagaagtgcgtcaactgcaattgccacgcggtgttttgattcaacgcattcgtcgtggtagtgaagaacacttgcccaatggcgatttcatcttacaagttggggatgagttgtcattgctaactgacgaggcacagttcaaacaagtttggaccgttatgcaagatttgaataaggaaacggagcaacaaaatggataagttattttggcaacgtttggtagctgtaggagttggtggcttttttggtggcggactgcgtgagctagtcgccttacttattcaagtacctgcttttccattatcaacgttggtcatcaatttaacgggcactttcttatcagcgtttctggttgtgatatggtctaagaaaatcactttggcgcaaccggttgctgattttatcatggttggagtgctgggggcgtataccacgtattcaacggccatattagatatggttaaacatggttggctaattggctttgtctatattgtcttaagtattgtcggcggtgtattagttgtgtatgctggccgtgcactagctgaaaaggtggtggcttaaatgttaattcaagttggcttagcaggtttaggggccgttatcggatcgatgggacgcttttcattattggaaattgcaccgaaagttttcgggacagctagtgcttggatggtgatggttattaatttaacagcggccttcttaatcggtattttgttcggtatgcatttgccagttttgcagaatacattttgggcgacgggaatcatgggtggttattctactttttcaaccccaatcgttgaattagctaatggcttacctaatcaatcagaacgtacccgtgtcttgctgaaaaccgttttggcatttgcaggtggtgtaccagtattgttggttggtttttggttagggtcgctattctaaccgtttcgtgttaaattgatacacgacatatacaattttggagttggatattatgagtaagattgcagttttagttgatagttctagttacattgcgccagctgatttggcagcattgaacatctatcaaatcaatgatcctattatgatgggtgagcaagtttttcatgaaaatgagagctgggcatcacaagaggagttctacacatttcaacgaacagctgaaccggctttgacgacatcacaacccgaaatcggggcgttcatgacgaagtttgatgaattggctgaggcaggttacacggacgtaatcgttatcgtgttgtcatcaggaatttcaggtgcattctcatcacttgaatcattggctggtacggtcgagaacattaaggtgcatgtgtgggattcacaaattgcagctagtggggcaggcaatcaagctaagttggcggctgaaatggttgctgctggcaaggacgtccaaactatcttggctagcttggaagagctacgtgccacaacaaaggtgttgtttgccgttgatgaaattcgtcatttgcaacgcaccggtcgcatctctggtgggcaagcaacgttaggttcattgcttaacattaagccattgctaacgtttgaagacacaaagattattgctattggtaaagagcgggctatgaagcgtgcttggaagaagattgaagctgactttcaggcggttcacgacagtgttgactacaagattcgtgccacgattgtggatggtaacaatcctgttttagctgatcaatgggcagctgatttagctgaattattcccggatgttgttgttgaacgtagcatcatcggaccttatattggtgttcacactggtgaaaaggcaatgggtcttatctgggcacgagactacaaaacattggaaaattaagaaaaaggtctataccaactattgcgtggtatagacctttttagcattgtcaaaatagggcataagcgtaaaatagataacattggtatacaaaatatctttaggatttataagtaggggatttacaaatgaaggactatctacaacgaatgggtcgttcattgatgttgcctgtttcagttttgccagctgccgctttgttggttggtattggaaactggattatgcgcattgatggtacagtcgcccaatcgattggaaactttttggcgattgccggtaacggtgtcttgggccaattggcattgttgtttgctgtcggtcttgcgcttggtatggtgcaaaagaaggaagccggcgccgtggccttggctgcggttgtggcatatgagttgcccgtattcttgttggcacctgcacaaattgctacgttgacgaatgtgaaagtcgcccacgttaatccagcgtttgaagcgttggttaataacaacgtcttgcttggaatcgtggctggactagttgccgctgctttgtacaaccgctttagtgaagttcgcttgccaacagcgcttgcgttctttagtggaaagcgttcagtgcctatcatttctgcggtggcgatgttggtcatctcagttgcactgttgtttgtgtggccaccagtttacacaggtttggtaacatttgctaagttcatctcaggacttggttgggttggtgccggtttgtatggattcttcaaccgtatgttgattccaacgggattgcaccacgcattgaactctgttttctggtttaacattgctggtattaatgatatcggaaattactgggcatcaactggtacgaagggtatcacgggtatgtatcaagctggattcttcccagttatgatgttcggattgcctgccggtgcatttgcgatttaccgtcaagctcgcccagctcaaaagaagcgtgttggatcattgatgttggctgctggaattgctgccttcttcactggtgtaacggaaccattggaattctcattcatgttcgtagcatggcctttgtatgttatccacgctattttgatgggattgtcattggcaattgcagccttcttccactggacgtcaggatttacgttctcaggtggattggttgactacgttttgagtttctcaatgcctttggctaacaagccatacatgttgcttgttcaaggtcttgtatttgctgttttgtactatgcaatctttacgtttgcgattaagaagtttaacttgatgacgcctggtcgtgaccctaaggatgacgacgatgcggctaacaacgtgcaagtcggtaaggctgcgacggttggtggcgaagacaagtatcttcgcacagctcgtatggtttggtcagcacttggtggggatgcctcagctaaggaaaacttgacgtacctttacaactgcacgacccgtttgcgttacaagatgacggatacgtcattagctgacgttgacgctttgaagaagacacctggtgttatgggtgttaatgttttggatgatcaccaaattcacattgttatcggtccggatgtacaattcgtcgctgataacgttgaaaagatttacaacggtgaaatttcttctaagttggagaatccgttgtctgctgaagaagcaaagccggttgatgatacaccagctggtaaggaagaaaacttctttgcggttgctaacggatcattgcttcaccttgagcacgttcaagatgagacgtttgcttcaaagatgatgggtgatggtttcgctatcgaaccatctgataacaacattactgcgccattggatgctgaagtaacaatggttgcaccaacgaagcacgccatcggtttgcgtactgagagtggtttggaagtgttggttcacatggggatcaacaccgttgaaatgaacggagaaccatttgacgtgaaggtatcagttggcgataaggttaagcacggtgatttgcttgccacgatggatatcgaagcggttaaggcagcgggtaagcttgccacaacaatggttatcttcatgggcttggctgaaaatgctgaagttaaggtagatgacgaggatatctttgatggtatcggcggcaactatgttggacgcgttatcttttaatcacatataattaaggaagctcgaacgaactgttcgggcttttttactgaaagaaaagtaagcattttttgttgaacgtatgttccgtgggtggtacactcaaacatgagcgtacgggcacgattgtgcagagaaataattatatagagagatttgtttagaaggtaaaacgaatgagcttaattaatcgtgaacgaataaatgaaattcgacaggcaaatgacattcctgtccgggaattggcgaacatcggtattagccgaaaccgttactaccgttatttgaatgaagaaaacgatttgcctgctgaagggttcatttcgttgatgagtcatttgcttttgacgggtgccgagattaatacagaattggttaacgggcaagatacagttgaaggattgatgtatgagttgctagacgcaaaccgtaagcgtgatcctgagaccattaaggaagttagtcgacgtagctaccaactattccgtaacaccatggcacgtggcttcttgcgtgtggcgagtttggcggatgtgcttcacgcacgattgattcctgatgagcatgcacaaattgcccaacagattttgattgattcatttgaagccgttaagatttggcgcgaaatggacgtggcacttttgtatccagtgattgcggaagttgagaaaaaggatgctttcaactatttgtcagttatttggcaaaaggcttggcctcacggtacgatggaacgcttaaacgcgacgacggctcgttatttgattgaactgcttaaggcagacgaatttgatttagagacatttaaacaggtagctgattggatggctaaccaagctaagagtgcgatgagctttgcttggtgggcgactgtcgttagccagttggagaaccacgagtgggatgcagtgaagcaacaagttgcaaacgctgcggccattggcatgactgatatggctgatttagccgaagagttggtaaccgtttggtatcaacgcgctgaaaataggtaaaaagaaaaggagagttgaacggcatattcactctcctttttatgttacttgttggcaattacttcaatgtgattgccctcaaaatcgtcgagatggaagataatgtggcgaccatcttctgattcggttgctggcttagcttgtgtgacgtagtagttaatgaagtggttttcgaccgtttccttgtgatcacgaacggttacttgaactgtaattggatcagcgtcgggctcttcttcaaaaacaattgattgttggtcgaagtagagatgacgagattcgttttcgccgaattcagttggcaaatcaaacacttcacggtaaaagcgaaccgcacgagcaacatttttgcttggaatgcgaagtggggtaaacttacgaacgcgcatttaaaaaacttccttttttattttcattatacgcgttgaccacaaaaaatcacatttttggaaaaatcgacgcttattgcctctttattactggaggtgcgaagatatgttacaaacaattaagtcagttgctgatttaggtaattacttagcaagcaagtatggggatcgcccacaggaaagttgttggctaattgcggtgaacacacaactacgggtgcttgagatacagcaggttgcgcaaggcacattggatggcgtcgcaattcacccgcgggacatctttaggcgattagtggcgttgaatgcgtatgggtttattctggttcataaccatcctagtggcaatctaaaagcgtcgttagcggatcgtctttttatgcgtcaacttgcatattgcagcaccctgatgcaggtccatttttttgactttatgattattggttcgggtgggtttgtgagtctaagagcgacaggcgagctaccaaaaatcggcctcgaaaccctgtatgatttatggacggatgctaataagttgtgatacactaaataagaaattaatgtggcgtttttatatagtgccatacgatgaatgataataaaaattagtaaagaaaagggataaaagccgtgttttcatttggaactcgaaatgtcggaatcgacctaggaactgccaacacgttggtatacattgaaggtaagggaatcgtcttgcgcgagccatcagttgttgcgcgaaacacaaagactaacgaggttgttgctgttggtgcagcagctcgtgatatgttgggtcgtacgcctggttcaatcaaggctattcgcccaatgcgtgatggtgtaattgccgattacgaaacaactgttgcgatgttgaagtactacctaggtaaggccctaggtggtcgtggatcaaagccatacgttacaatcggtgtaccatctggtgtaacggctgttgagcgtcgtgccgttatcgatgctgcgcgtgtagctggtgcgcgtgacgcgtacgttattgaggagccattcgcagccgctgttggtgctggtttgccagttatggaaccaacgggatcaatggttgttgaccttggtggtggaacgactgatgttgccacaatttcattgggtggtatcgtatcatcacgttcaatccgtatggctggtgataagcttgatgaagcaatcatgtcatacatccgccaaaagtactcagtattgattggtgagcaaacagcagagcgtttgaagatggaagttggatcagctgatgttgaagctgctaaggacatggaaggtacaacggctcgcggtcgtgacttggtaactggtttgccaaagacaatcgacatcgaagcaactgacgtggctgaagctatcaaggatgtcattgctgaaatcatcgttgccatcaaggaaactttggaagagacgtcaccagaaattgctgctgatgttattgaccacggtatcgttttgactggtggtggtgctatgttgaagcaccttgatgaagttattgctgaagcaactaaggtgccagtattcgttgcgccagagccattggatgcagttgtcatcggtactggtgaagcattgaagtcaatcgatgttttgaagaacaactaatcaattttaacgataacgccgcaccattcggtgtggcgttatttgttagcaaaactgacgaaaggcatgtttgatatgaagaatatcttaacttcacgacgtttggttgtagcggttatcgttgcaatcgtgacaatcggtgttattgtcattagttcgcgagcacaaaactctcaaaaagaaccttctttgccaacgcgtgttgtgtccgacgtttcaggttgggtatcaagtgttgtcagttcaccggttaaagcagttagtggtggatatgaggcggtctctggattgctaaacacgtacaaagaaaatcaggcattgacggaaaaggttgacgacttggcacaagcgaaggtacaacttcaaacgttgcaagctgaaaatcgcgcattgaaggatcaattgcaaatcgaaaacacgttaacggactataaggtcgttaacgcggttgttatttcacgttcaccaagtaattggcaatcacagctaattgttaacaagggatcaaatgcaggcatcaaaaagggaatgtctgtcatgggttctggtggtttgattggtcgtgtgtctgaggtcaacacaacaaacgctaaggttgagttgttgtctgatgatagccaagtggcggatcgttttgcaatccgtgtggctaacaaggacggtgaggttgtcgatggtattgtcacgagtttcaatcaagaaaagaacttgattgtgatgggacaaattacatctgatgttgccttggaaaagggcgatcttgtaacgaccagcggtttgggtggtgtaacgccagccggactttacgttggtaaggtacaaaaaattagtcaagacgactatggtctatcaaagaagatttacatcaagccggcaacggactttaacaatattccagttgttagtgtggctattccacaacaatagcaaaaaaagacgtcacgctctgcagaaacgcagggtgtgacgtctttctatttgtcttggtaatacaggacgtggcgcccgtttaaaggctgtaaatgacgattattatggtcgtagtgcacgtggaattctgctaactgttccgctgaaattgtcatgggttgttctaaaacataccagtcaacgttttcagataacggtggcgtcgttagtgagccaatgtagtggtaatatgaccggttagttggtaatagatcagtgacctcacatgagaaaaccgactcatcattaatccggcttaaaatgttagcgaacgtttctgatggggcacccaattgtaaaaagacaccaataactgccaatctaccatcggcagcctcgtgcacgaaatgaatttcaccgtcatatgactccccgtcgagggtatgctcacttggggcgtggacgtgaaattgttgcaaccggaacggacgattagcgattatcgccgtaccggtaagcccgacctctaaaccttgaccggtgtcacggacatagttggcgttgagatcgtagtacaattctaatgacgcagggtagtcaatgctgtcagcggttttgcttgtaatggcaataggtgattgcattaaaccggctgtcattgaccaagactcctgcgcatcataattgagtttttgcatgaatctagtcccttctgaagtgtctctctctcctcagaacacttttagtttatcagcagtccgaaaagttggctagtgggtttttaagagtcgtgcaataaatgtgacattttgttgacgttcgacaaggggtagggataatatagtagaagctacaaacaatcgtagtgcttaatggagaagataaatgttgaaatacgtgcacacctcatggttacatttcgttctggtgtatatcgcaatcatgctagatggggggattgcgctgtactttgcaccagtgctatttaagatgccgatgttggccagcccatacttatcattgattgtcatgatgatgccggtactgactgccacggttacgcagatgaaggaacgtagtttatatatcgcggcgttcttgggcggcttactatttgatattttttattctggtctaattggtatttcaatgattggattcccgctgacggtttggttagcaagcaaactccaacgttacctaccaacatcatttatgtcatcagtggccgtctggttcgtatcgatgagcatgtatttggtgtttgattacgctgggtttggaatcatcaatctaacgaacttgaacattccggatttcattattttccacatgttcccaacattgattattaatttgatgttgttggtcttagtttatggtctactaaattattggtaccatgcaacacgtcagccggatatttcagcctacaatgttgatgatagtgacttgaatgggcgtttgccatcattgaattcgaagtcacgatcacgttcaattcgttagtctagtttgaaacggttgacttacgacactaattactttaaagtaatcccataaagatttgattggacgagtagtctaacgtcggtgctaagagagttgcgcagaagctgggaagcaaccatcggcctagatgaaccacacccatgattatcgatacatcacaaaatgtatccggatcgtctcgttataggcgcgcgcctggtttaatcaggggctagagtgttggttggtaacaactaacaaaattgaggtggaaccacgatttttatcgtcctcaagtaacctatttttgggttgcttgaggacttttttattgcaggaaatggagtacaaggtatggattacatgatgcaaattatgccaagtttgctggatgggcttaagatgaccatcggtgtcttcgcattaactttaattggatcagtgccgttgggaattttggtggctttggcattgaagtcagatatcttcttgttgcgctgggtaacgaacggttatatctgggtaatgcgaggcacgccattgttgcttcaaattgtgtttgtctactatggattgagtctggctcacattgtgacattcccacgttttgaagccgcggtcatcacatttattattaactatgctgcgtacttcgctgagattttccgtggtggattacaaagcattccacaaggacaatatgatggtgcgaaggtgcttggtctaactcgctggcaaacgatgcgtaagattgtgttgccacaagtggttaagattgtgatgccatcggttggaaacgaagtggtaacgttggttaaggatacgtctttggtgtatgttatcggtttgggtgacctgatgcgtgctggtaatattgcggcgtcacgtgacgttacgttggccccatatctactagtcggcttgctatatttgattttgacggcagtcgctacagtgttgctacgtcgcatcgaaacgaatatgaactactatcgttaaggagtaaggtaaatgctagaaattaaaaacttagctaagtcatatgacacgcgcacgatttttaagaacatgaatcttacggttaacgacggtgaggttttgagtattgttggtccttcaggtatcggtaagacaacgttcttgcgaattgttgctggtttgctaccggcggatcaaggtgagttgattctgaatggtgaatcacttgatttaactggtgaacgtactggtgcgcaagttggggttatttttcaagatttcaatttgtttccacaatacacggttaaggaaaatgtgatgttggcgccacaaatggtgcacaatgagtcaaaggatgaggcggctgaaaacgcagaccgtttgctagccgacttgggtttgacagctcaagcggatcaatatccattccaattgtctggtggacaaaagcaacgtgttgctatcgcacgcgcacttgctatgaagcctggtattttggcttatgatgaaccaacatctggtttggatgcggaatcaactgagcgtgttatcgctgtgattaagcaattgcaggcgcaaggcgtgacgcaattgattgttacccacgatttgccatttgctgaggctgtggctgataagacctttgattttgggacggatgttgaacgatagggggctgtcgcaatgaaaaagaagattaactggcgccgacagattttcggtaacggtattgtactagcagtgctagccttgctggttggatttgtttggtaccgcacgacgcacgcacaagacacttggcgccaaatgacggctgataaaaccgtggtggtgggcttggatgatacgtatgtgccaatgggcttccgtgacaagtctggtaagttggttggttatgatgttgatttagcgcgtgcaacgttcaaaaagctgggcctaaaggttaagttccaagcgattgactggtcaatgaaggaaactgaacttgatacgggtcacatcgacatgatttggaatggttatacaattacaccagcccgtgctaagaaggttgccttctcagtgccataccacaatgattcccaagtgttggtgacgatgcaacgtgatcacattaacacgattaaggatatggctgggaagacgttggctgcacaaactggttcagctggactaacgttgtttaacgataagccaaaggtgttgaagagcttccttgggtcggcaccggtacaatatgacacctttgataaggcgttgaacgacttgcaagttggccgagtgaatgcggtattgattgattcagactacgctcgttattatgtagcgcacgagtcaagcccagccgagttcaaggtcatcaagactggttacggacaagatgcttatggtatcggtttccgtaagggtgacgtgacgttgcgcgaaaaggtaaacggtgtgattaacgagttcaagaaggacggcacactggataagatttctgagcgctactttggcacgaagaatgcagattaattgatttaggagacaacctcatgatggggttgtcttttttgtttgcgcgttagtggtgacacaaattacgaacaataattgcttaacaccatcaaccaaataattccaaccgggttcgaaacgattcaacaacttttggagagcgcagttaacgtttgaaaaacgaatgttcggccgaatgaaagtttaaccagctgaaagtgggttgtatcaaaacagtttgtccgtaagcttagttgtgtaaccaaatcacttcggatggctaaaaggagaagttttaatcatgaagacgacgtttgacacagttgctgatgcattgaccgtattgcgccaagggggcgttatcatcttggcagatgatgaaagccgtgagaatgaaggtgatcttgtcgcccttgcccaagatattacgccagaaacggttcacatgatgttgcgtgaggcggccggtttgatgtgcacgccagttgggcctgaaattgcagaacgtttgggatttacggatatggtggctgagtcaacagacccacatcaaacgccattcacatacacggttgatggtacatttgaagccactggtgtaacaacgggtgtgtcagcgatggatcgtgcggcaacgattcgacaaatcgccaacccaactgccacgcgtgccgatttcaatgcacctggtcacacacaaccgttgacggccaaggaaggcggtttggcaacgcgtattggtcacacggaagccgccgttgatttggcacgcttggttggatcagaaccggccgccgttattattgaagtcttgaaggaagatggtacgatggctcgtcgtgatgatttgtttgagatgtctgaacgattggatatcccattcattacaatcgaacaaattagtgcttacatgacggtgccagctgtctaattaaaatgatgagaggttcggattcacatccggacctctttttttgtcaaaagcatcaggttaaacgagaatgtttgtttaattttatgaagaaaacgattaaacacgaatatttatttttcatttgtattactttgtgaataaaaactgtacatttagaatgaatggtggttaaatcatcttgtaaatacgaacgaaaagaatggggagaagataatgaatcgtgtttcagtaataatgggatcgatatcagattggccaacgatgaaagaagcggtggcgattttggagcaatttgaggtaacagtcgaaacacatatcatttcagcccatcggatgccaactgagatggcgacgtatgcggcgaatgctcgcgaagccggggtggacgtaatcattgctggcgctggtggggcggcgcatttacctgggatggtcgctgcgcaaactaccttgcctgttatcggtgtaccgatgaagacgaaagcgctcaatggtgttgattcattattgagtatcgtccaaatgccagcgggtgtgccggttggaacggtcgctattggggaagctggggctaaaaatgctgcgtattacgcccttcaaatgctgtcaatcacgaaccaaacgttggcgacacaactggagacattccgtgagcaacaagcacaaaaagcacgtgagagtgaggagcagttacatgactaaacccattttgccaccggccacacttggaattgttggtggcggacaacttggccaaatgatggccttagcggctaagccaatgggatatcgcgtggtggtgctggacccacagattaacgcaccagctgcccagattgcggaccaacagttggttgcaaattacgatgacgaatctgcgctacgcaatttggcggatatcgccgatgtcattacgtatgaatttgaaaatgttagtcaagaagcgttggccaatgcagtgccagctaagcagttgccgcaaggtacgcaactgctacatatcacggctaaccgcttgcgtgaaaaaacatttatcgcggatttgggattgccagttgcgccatttgcggccgtcgataatgtcgttgcgttggatgcgagttgccataaggtatcattaccagcaatcctgaaaacggttgaaggcggttatgacggtcacggtcagtgggatattccgaatcaggaagctttagcaaacttactggctcattgggatgtcccagttaatacaccaatgattttggaaaaacagataacgtttgatcgcgagctcagcgtgatggttgcacgagatatctcaggtgacattaggacttggccggtgacggttaatgagcatcaaaatcacattttgcatgtgtcagctgcaccagcgtcactatcagacaagattgctgacgagattgcgcacatcgccaaaacattagcgaatgcgttgaacctcgttggcgtgcttggcattgagatgtttgtggctggtgatcaggtatatgtaaacgaattagcaccgcgcccgcacaattcaggtcacttcacaattgaagcaaccaatgtttcacaatttgaaggacatgtgcgtagcgtgttgggattgccgattccggaaattaagcagtgggcaccagcaatgatgttgaatttattaggggatgacataaatcgtgctcgcagggagttggtagaccatcctgagtggcatatacatgattacggcaaggatgaggttaagccgggacgtaagatggggcatatcaccgtgacaggattacgagaaatgaaggcattacgtgcatgggggcatcaaaagggatgattacacaagaagcattgctaacaacgggtaaagcgaaggccgtatacgaaactagcgatcctaaaattctttggttgcatagtctggatcaagcgactgcgttgaacggtaagcaaaaagaacatattccggataaaggacgtttgacgacacaaattagtggcttactattcgaaatgctgaatcaagctggtattaagacccattatttgtcgccagttaatgagacggatattttggtttcacgtctgacgatgttgccaattgaggtggttgttcgaaattttgcggcgggccattttgcgtcacgttttgatgttgaaccgatgacaccactggttccagtggttaatgaatattactacaagcgtgatgatttggatgatccagcgctgaacgcgtcacaagcagtggcattaaagttagcaacaccggcgcagttggcagagatttctgacataacggcgcgtgtcaaccaattgctgaccgagaagtttaaaacaatcggaattacgctactcgatttcaaaattgaatttggtttagacgaccaaggtgcattggtcttgggagatgaactatcaccagataacatgcgcttgattgacgacgcaactggcgcttcgcttgataaggatgttttccgacgtggcgaaggcgatttgcgtgatggatatgaaattgtattgcaccgtttgaatgaaacaaaaggagaataacccatgtttttagctaagatttacgttacatacaagccctcaattcttgatccacaaggcgaggttatcaaatcagcgttgcatcgcatgaattttgaaacggtcgaaactgtgacgcaaggtaagtattttgaagttacaatgagcaatgctgatgaggcagcagcctacgatgaagcggtggcctatacggaagcacttctgattaacccaaatactgaaacgtatcgaattgacctatttaagtcagtggaggcgtaaacatgaaagcagcagtggttcgttttccaggctctaattgtgattttgatatgtattatgccttacaagacttcggtgtcgacgtcgcatttgtcgatgaaaaagcgacgtcactagcgggttttgatgcagtctttctgccgggtggcttttcatatggcgactatcttcgaactggggcggttgcgcgctttgcacctgtgatggacgccgttcgagcagcagctgatgaccacaaattagtggttggtatctgcaacggcttccaaattttgactgaagccggtttattgccaggacaactcatgatgaatgagcatccaggtttcatttgcgatgaagtaccacttgaaattgtgaatcagacatcacgcttctcaaaggcatatgaaacgcaaacagtgaccttgccagttgcccacggtgaaggtcgttatgttgctgatgaagcaacattagaagcgttacgcgacaataaccaaattatctttaagtatcgaacaaatgttaacggttcgatggatcaaattgccggcatttcaaaccgaaatggtaatgtattcggcatgatgccacacccagagcgagcagtcgatgcattgcttggtaacacggatggtcaggcatttttcaaaagtttgttaaccccaattatgacggaggcgttggtaaccgaatgacaacagcaacaaccacatatgaaccaaccgcagaaatggttcgtgatgaaaaaatgtatcttgcgtggggtctaacggaggcagagtacgacttgattgtcgccaagttggatcgactaccaaattacacagaagcgggcttgttttccgccatgtggtcagaacacgtttcgtataaaaagtctaagccggttctacgcacgttttggtcacgtaatgaacgtgtgttacaagggccaggtgaaggtgccggtatcttagatattggtgatggccaagcagttgttttcaaggcagaatctcacaatcacccatcagccgtcgaaccttatgaaggggctgccacgggggttggcggtattctacgtgatattttctcaatgggcgcgcaaccgattgctgtcttggatagtttgcgtttcggtgagctgaacaacgccacaactaagcatctattagatggtgtaattgacggcattgccggctatggaaatgccattggtattccaacggttggtggtgaaatcgggtttgatgctgtttatcaaggtaatccactagttaacgtgatggccgttggtgtgattgatcaagccgccatgcaagttgggcgtgctgaaggagttggtaatacggtcatgtacgtcggagctaaaactggtcgtgatgggattcatggtgcgacttttgcgtcagccgaattttcttctgatgaagatcaaaatcgctcagcggtccaagttggtgatccattcatggaaaagttggtcatggatgccacattaaaggccattcgtgaacacggtgacgttattgtcggggtgcaagacatgggtgcagccggtcttgtatcatcttcagctgagatggccggtaaggctggtatggggatgcaattgaatttggatcttgtgccacaacgtgaagctggcatgacgccatatgaactcatgttgtcagaatctcaagaacgtatgctgttggtggtggctgctggtcacgaagccgaagtgcaagcggtctttgaggacgctggcctcgatgcggttgccgttgggacggtcacagatactggccgttacgaattgctttggcatggtgacgtggcagcaaatgtgcctgttgattttctgacgacggcaccgaaacaagagatgccacaagcaacgccaactcgtctaaacgaaccaagcgctgattttgtacccggcactcttgatggtgcagcaacactaactgagttgttgcaacaaccaacaatcgcgtctaaagcatcgttgttccgtcattttgacagcatggtgcgggctgatacggttgtgaagcctggtggtgacgctgctgtggttcgcttgcgcggtaccaagaaagcgttggcgatgacaactgacgtgaatagtcgtttcacatatcttgatccttatattggtggtcaactagcggtggttgaagctgcaggtaatgtggttgcaactggtgcacaaccaatcggcattacagattgcttgaattttggtaatccagacgacccagaaatttactatgagcttgcgcagtcggtggccggcatcaatcaaatggccaaacagttgaacacgccagttatttccgggaacgtgtcactttataacgaaactgatggacaggcgatttacccaacgccaatgattggcatggttggtttgcatgaggacgtgaagatgattacgaccatcagttttaaaaatgcgggtgatgttatttacgtccttggtgaaacagctgccgactttaatggatcagaattacaaaagatggtcactggcgatgtttctggtcgtttacgtggttttgacatgacgaaaattcaaacaacacaagcaaagttgttggacgcgattgcggctgatttagttgctagtgcccacgacattgctgaaggtggcttgggagttgcattagcagaaagtacgtttaagacgccatttggagcatcgatgcagtggcaagtgccgacagcttggttgtttagtgaaacacctggccgttttgtggtatcggtgcctgaagcaaacgtcgcagtatttgaacaattgatgggtgacaccgccacaaagcttggtgtggttactgcaggtgacacgattcaaatgaacaccgaagcagatgaattaaacctatcaaaaacaacattgcaagagaactatgaggaggccatcacatggcaacgcaaccagtgagtgagagtcgatcactgaatgaagaatgtggcatttttggtgtctgggggcatcagtcagctgctgatttgacctactatgggttgcacgctttgcaacaccgtgggcaagaaggcgctgggattgttgctaataagcaagggcatctgtggcaagaacgtggactggggttgttgagcgatgtgttcagtgacccaagtcgcttgcaacatttgcaaggacaatcagcgattggtcacgtgcgatacgcaacggctggttcagctggaattgaaaatattcaaccgttgatggtgaatttttcggatatgcaattatcacttgcacacaacggtaacatcacaaatgccttgtcattacgtcgatcattggagcaaaacggcgcgattttccaatcgtcatcagatacggaagtgctattacatttgattcgccgttcaacggcgtcaacgttctatgacaaattgaaggatgctttgcgtacagtgcgcggtggctttgcttttttgctactaacaccaactgctatgtatgcagcgctagacccgcacggcttccgtccgtttgtggtcggacaattaccagatggtcaatatattgtgaccagtgaaacggcggctttgaatgcggttggtgcgacgtttatccgtgatgtacaaccgggtgagttgatcacgattgatcaacacggtttgaagattgatcactacacgactaacactgatttgcatattgatgcgatggaatacatttactttgcacgaccagattcagatatctacggggtgaatgtccatacggctcgtaagcggatggggcgtttgttggccgctgaacaaccggtcgatgctgatttggtggtaggcgtcccaaactcttcattgtcagctgccatgggttttgcagaagcagctggtttacctaacgaaatgggattggttaagaatcaatacattgctcgaacgtttatcgaaccaacccaagaacgtcgcgaacgcgcggtgcgtatgaagttgagcgccgtgccgtcagttgtggcaggtaagcgcgtggtcttggttgatgattcgattgtccgagggacgacatctaagtttatcgtgcggatgctacgtgaagctggcgcgagtgaggttcatattcgaattgcttcgccagctttcaagtatccatcattctatggtgtcgatatgcagacaacagaagagttgttggccgctaattacacgatgagtgaaatgcaagagatgttgggcgttgattcattagcctttctgtcagttgacgggttggttgaagcgattgacctgccatacgaaggaaacggcaccggattgacgacggcctattttgacggccattatccatcgccgatttatgattatgagccaactttggcagatgcgaaggcagcgggccaggttgattttcaacctgaacccacgacgacttaccatccgaatcaggtggcgtcgattcaaaaacaacaattacaagatgcacagacagttggttaattcattgggggagttatgacgaatcaaaatgcatatgcgaatgcaggcgttgatgttgccgctggtgaacaagccgtcgatttgatgggcaacgccgtagcagcaacttatacaccgcaagtccttggtggcattggtggctttggggcagcgtttgccttgggaaatacgtatcgtgatccggttttgatttcaggaacggacggcgttggcacaaagttattgctcgcgattgcggccgacaagcacgatacgattggccaagatttggtggcaatggtgatgaacgatattctggcacaaggtgctaagccactctttctcctcgattatctggcgattgctaagatgacgccggagaaagttgcgacaatcgtgacgggaattgccaaggcaacgcaagccgtcggtgcagctttgattggtggtgaatcagctgagttgccagggatgtatgcccctaaccactatgatttggcagcgttcggtgtcggggttgttgaacgggacgagatgttgaacccggccgatgtggtcgcgggggatgtgttgattggtttgccatctagtggcattcattccaatggctacacgttagtacgcgaagtctttggtatcaacgaagaatcagattttgtgaaattgccaacgcgcttacaagaggcattgctaaagccgaccactttgtacgcaccagctatcctgcctttgctggctgaaaagatgattgtcagcatggcacatattacgggtggcggtatcgttggcaatctgcctcgtgcgtacggtgagcaggtagcggcaaacttacattggggctcatggccaatgttaccgattttcacggaaattcagatgcgtgggagtttgacgcaagctgacatgcttgagacgtttaatcttggcttaggtatgattttgattgtgaaagcgaaccaggtcgacgcaaccatgacaatgttccaagatgccgaacaaccggcgtttattattggtgaaatggtcgcgcgagaatcagaaccaatcatctggcaaggagcgcaaccatggtaaaaaagccgaaacttgccgtctttgcgtcaggtactggctcgaatttagcagcgttgctgaaagcagcccaagccgatacactcggcggtgacatcgtgcgggttgtgattgatcgcaaaagcgctggggcaattgccattgctgaggcggctaatattccggtattgcaaattcgctacccggctttcgagacacgagaggcggcagagcaagagattgttaaaacgctagtggcggatggtgtgactggcattctattagctggttatatgcgtattttgacgccgtatattgtccaagcgtttgaacaacgcatcttaaatattcatccggcactactacctagttttcctggcaataacgcgattgaagatgcctggaatgctggtgttaaagtgactggcgtgacgattcattatgtcgatacgggggttgactcagggcaaattattgcgcagacgccagtccttatttcagaagacgaaacaattgatgaactgactgaacgtattcacgatgcggaacatcatttgtatccagaaactgttgcaaagttaattaaagaaggagtttttcaagcatgacacgagcactactaagcgtttcagataagaccggtttggcggattttgccaagggactagttgcattgggctttgagttggtttcgactggtgggacattggcaacattgcaggaagctgatttgccagtgacaccaattgatgaggtaacgcaattccctgaaatgctcgatggacgggtgaagacattgcacccacgtgtccatgctggcttgctagccaagcgtgacgatccagaccatatggcaacgttggcagaacatgatattacgccaattgatttggtggtggtgaatttgtatccgttcaaggaaacaatccaaaagccaggcgttacattggccgatgccatcgagaacattgatattggtggcccatcaatgctacgttcagcggcgaaaaactatgcagcggttttgccggtcgttgatccagctgactatgatgctgtgcttgaaaacctacaaaataacacaatcgatgacgcattccgtcgtcaacttggtgccaaggttttccgtcacacagctgcttatgatgcgttgattgctgactacttaacggatgaagaattcccagcacaaaagacggtgacgtatgagttatttgagccattgcgttacggtgaaaatagtcaccaacaagcagcagcgtaccgcgacgcattgccaacggattattcagttctttctgctgatattttgcacggcaagcaattgtcatataacaatattcgtgacgccgatgctgccttgcgcatcattgccgagtttgatgagccaaccgttgtgacggttaagcacatgaatccagctggtattggacaaggaacgacgattgaggccgcttgggatgctgcctttgctgctgatgatatctctatttttggtggcattgtcgcattgaaccgtgaagtcgatttggcaactgcagaaaagatgcaccaaattttcttggaaattattattgcgccaagctttacaccggaagcatacgacgtattggctaagaagaagaatttgcgtttgttgacagtgccgttcacaacggatgtgccacaagcggttgaattgaccgcggttcttggtggcgtcgtgatgcaagaacgtgacttggtatctgaaacgttagctgatttcgaagtggttggtgatgtgcaaccaacggcagcgcaacttgaagcgatgatctttgcacaaaaggctgtcaagcacgtgaagtcaaacgcaattgtcgtggcccaaaaaggacagacacttggtgtgggtgccgggcaacctaatcgcattgattcagtcaagatggcgattgcgaaggctagtgaaaagccaggctttggcaatgcggtactggcatcagatgcctttttcccaatggatgattcagtaacgtacgcggctgaacatggcattacggctatcgttgaacccggtggatcaattaaggatcaggcatcaatcgataaggcaaatgaattgggtattgcgttggtattttctggcacacgccactttaagcactaggagagaaacatggcgaaggtgatggtaattgggtccggggcccgtgagcatgcattagcagaaacgtttttgcgaagcgctgcagttgaagaggtggttgtggtgcccggtaatgctgggatgcagtcagtaggaattcgaaccattaatcacgatatgatggatgtcgccggattacgtgacctagcagaacaagaagcgattgatttgacctttgttgggtcagaggcaccgttgattgcaggcgtggttgatagctttcaagaagctggtttaaagattttcggtcccacgaaacaagcggctcagttggaaggctcaaagcagtttgccaaggatgttatggcccaagcaggcgtgccaacggcgacatcggtaatggttactgatgaagttcgtgcacgacaagcgttaaaaagcttcgacttgccacttgtgattaagcaagatgggttggctgcgggtaagggtgtggtgatttgccgtgaccgtgaagatgctgaaacgatgattcagctcgcgtatgaacgtcaagttgatgcaccgttggtcattgagtcctacatggctggggttgaattttcaatttttagcctggtgggttctaatggggtggttcacgcaccaattgcacaagatcacaagcgccggtttgataatgaccaagggcttaacaccggtggaatgggtgcttattcacctgttcgttgggtatcagataatcttgttcaagaggctattgaaaccctagttttgccaacattgacgacaatggctgataatgacatgccgtttacaggtgtcttatacactggcgtcatgttgactgatgacgggcccaaagttgttgaatataacgtccgctttggcgatccagaagcccaagttgttttgccacagctacaaagtgatttttatgaacttattttggcattattggctggtgaacaaccagaggcaacctggcaacaagacgatgtttatgctggcgtggtgttggtgaacccgagttatcctgcgccaacaactgagcatatcgttctaccatcattttcaatggccgacatcaacacattttatgcgggcgtgacgcgaaatgatgataaactaataagtaatggtggtcgtatcgccacggttgttggtcatgcagcgacggcgtcacaagcgcaagagacagtgtatgaggcaattgatgcgacacaaacaacattagcttatcgccatgatattggttatcaggcggttcgagaagaaaataaggtggtatctggggatgcaaactgatattgagattgcacaagcggcagaagtttggccaattgaaaaaattgctgagaaggctggtttaacagcagccgagtgggagccatatgggcgtgataaggccaagatttccgtcgatgaatcagcgcgccaagatggacttggcaagttgattttggtgacgtcaatcaatccaacgcctgctggtgaaggtaagtcaacggtgacggttggtttggccgatgcgctgagcttggccggtaagaagacgatggttgcgttgcgtgaaccatcgcttggaccggtcatgggcttgaagggtggcgccactggcggtgggtatgcccaggttgtcccaatggctgacattaacttgcactttacgggtgatttccacgctttgacgagtgcccacaacacgttggcagctgttattgataacagcatttatcaggggaaccccttgaacattgacccacgtcgcttgctttggaagcgtgctttggatgttaatgatcgcgctttgcgtcacattacaattggtttgggtggtccaacttctggggtgccacgtgaagacggctttgatatcacggttgcttctgaattgatggcgattttgacattatcacatgatttgatggatatgaaggcgcgtattgaacgcatcgttatcggttacacgtacgacaaggaacccgtgactgttaaggatttgggcgttgccggcgcattaacgacattattgaaggatgcgattaagccaaatttggtgcaaacgcttgcccacacgccaaccttgattcacggtggtccgtttgccaatattgcacaagggactaactcaattcgtgcaactaagacagccttgcaattggctgactatgttgtcactgaagctggtttcggggccgacttgggtggtgagaagttcttggacttcaaggtgccattgttgggcaagacaccagatgcaattgtcatcgtggcaacggtacgtgcattgaagatgcacggtggtttgcctaagacggaattgacagaacctaatttggacgcgttgtcagccggtttggctaacttgggacaacacttgaagagcatgtcacgttacggcgtgccggttgttgttgcggtgaaccgctttgtgagcgatacacctgaagaaattgaaatggttgaaaactatgttcgtgagcgtggtgctgaagcctacatggctgatgtttgggcgcaaggcggtgctggtgcaccagagttggcccaagctgtcattgccgctaccgagcaagaaagtcaattcacgccattgtatgcgcctgaagatgatgccgtaacgaagatcgagaagattgtacaaacgatttacggtggtgccggggttgaattgtcagataaggctgccaagcagttgcgtgagttcgcaaagcgtggctgggacaagatgccagttatcatggcgaagacgcagtactcattgagtgacgatgcaaagaagttgggcgcaccaacgaactttaagattcatgtgcgcgaatttgtgcctaagttgggggctggtttcttggttgcgttgacgggttcaattttgacgatgccaggcttgccaagccatccagcggcatacgacattgatattgatgagaacggtcaaattactggcttgttctaaacagttataaatgaaaaaagccgatcttaattgatcggctttttgtatgcaatgatgttgttgtaggtaccagttttaatgaagccaagtttttctaagatgcgttgtgacgcaacattatcagcgaatgtttcggccaataatgttgttggtgttggtaacgctgcgatgaaacttcgtaaggcttgggtcatgatgccgtgacctgcaaaacggttatctaagaaataggcgaggtcatactcattgggaataaaatcgccggtttcagagacgcgtgcgtaggtgatgatactaccaattatctgttctttataaacaatggccgcttggaacggttgatataaatctgtttcaaacatcatccgccgttgctgtgtgtccacatcgggtagtccggcaccttgcataatttcaggttgtacgattaattgttcataagcatcgaaatctgtcgattgccaggagcgtaatgtgattttagccatattttagaaccatgaattactgaatccgttcatccggtatgcacgtggggcgcttttaccgtaaaactgggcagcaagttgtagccaggcgagggccagtagccagccggcaattgcaccggataacgtgtaattgtttaataggatagtcccggtaaaggttaataaccatccagcgacaatcacgacctgaccaactatccgatagaagattgtttttagttcaggaatgacgattttcgccagaaaaaaatagagtaaggttgcgaaaaaaatcgtatgagctggatactctgttttttgaccggcaacctggtggttaaatattaaagaaaagacattaacaattagccagccaagtaaggtcgttaacaaaatccaggccgctgggattttaaactttaacccccacaatacaaacatgaagatgaaaattaatagtgcaaataatatgccgtggctaaacatgacgaacggcgttgtcaggtgcaacaaagcggcaggtgtgaaattagctagtaaattttgttcagcggcgtcaatcagtgcgataaatgatgatttaataaacacactaattgtaaaaattagaaaagccaagctactaataatgaagatcattagccggcttttagagggattgattatcataataatcgacactcctttaacaaccaatctggttaacgaatttgtatatatcgtatcattacataatcaaaaacgggtatgatttgatttgttgtttaagcagtcattaagatgattttggtactaaaagatatggttgacgagagatgggaacttccctataatgaaaatcataaattaaatatgacatagaggtcgcaaccaacatgagtgattaaccaagtcggcagacaaggcggttgatttaaaggggcggttgccgaaatgtgttttcacggcggtgaaacatgttggtccttacgtgaacaacgggaggactgtcgcagcaaaatttgtcggctgcggagcgctatcgacaacactaatgatttcaaatgaggtccctagtttatgcgatggtatagactggggacttttttcgttctcacgagtgcgattaggcctctctatataggaggaattatgtcagataatcaacagaatcaagggacgctgaagcgcacgatgaagacgcgtcacctttcaatgattgccctcggtgggacaatcggaactggtttgttcgttgcctcaggtgcaacggttgcacaagctggaccatttggagcgctgactgcttatgcggttatcggtttgatggtttacttcttgatgaccagtttgggtgaaatggcaacgtacatgccagtttcgggttcattctcaacattcgcagaccgtttcgttgatcctgcttttggatttgccatgggttggaattattggtttaattgggcaattacggttgcggtagaagcagcgacggttggggtggtcatgggctactggttgccaaacgtgccaagttggatttggtcagcgctagtcttgattttgattacggtcatcaacttgatgtcagcaaagtcatacgctgagactgaattctggatggcgacgattaaggttgttgctgttgttgcgttcttggtaattggtgtggcaacgatcttcggtatcatggcttatcacccggatgtaccacgtaacttgtcagctggtggtaaccacggattcgtcggtggtgttggtggtatgttggccgtcttcatggtggctggtttctcattccaaggaactgaaatggttggtattacggctggtgagtcagaaacaccagaaacgtcagtaccaacggctatcaagcaagtgttctggcgtatccttttgttctacatccttgccatcttcattattggggcattgatttactacaaggatccaaacttgctacgttcaagcgaaacgaacattgcagtttcaccatttacattggtctttaagcaagccggtttggctgcagcggcatcaattatgaatgctgttatcttgacgtcagttatttcttcagctaactcaggtgtttacgcctcaacgcgtatgttgtacgccatggctgttgaaggaaaggcacctaagctattcgcacgcgttaacatcaacacaggtattccagtgccagctttgttggcaacggttgccgtcggattgttgacgtttgtcacatctgttttcggacctggtatctactactacttggtggctgcttcaggtttgactggattcatcgcttggattggtatcgcaatttcacactatcgtttccgtcgtgcctttgtcgcacaaggccgtgatgtgaagaagcttcgctaccatgctaagtggttcccagttggtccgattttggcattggttttgtcaatcgtcgttgtcgttggacaagacttggcatcattccaaggaccgatttcacactggaactggtcaggaattatcacaacgtacatgtcactaccattgtttattggcttgtaccttggatacaagattaagcacaagacaaagttacgtaagttgacggaagttgatttggatacggacgcacgacaataataaattgttcaaaaacacacaagcaataagcttgtgtgttttttgtttgaatattggaacagataacaaacaaaaattgtgtacaaaaaaagtgaaaaatagtacaattaatgtcagttagatagatacactatcaacacaaaacgaaggagatttttcagatcatgaagaagaccaagattgtttcaacgcttggaccagctagttctgacgtcgagactattactaagttgatcgagtcaggtgcaaacgttgtacgtttcaacttctcacacggagaccacgaagagcacttgggtcgtatgaacgctgtgcgtgaagccgagaagatttcaggtaagactgtaggattcttgttggacactaagggtgccgaaatccgtacgactgttcaagagccaggtaagattgagttcaacatcggtgatgttgttcgcatctcaatggatgcttctcttgaaggtactaaggaaaaggttgccgtaacttaccctggtttgttcgacgacgttaaggttggcggacacgttttgttcgacgacggtaagatcgacatgttgatcactgaaaaggacgaagctaaccgcgaattggttactgaagttcaaaaccacggtttgttgggatcacgtaagggtgttaacgcacctggtgtttcaatcaacttgccaggtatcactgaaaaggatgccgatgacatccgcttcggtttggaacaaggtatccaatacatcgccgcttcattcgtacgtaagccttcagacgttgaagacatccgtgctttgttggtagaagctggtaaggaagatgttatgatcttccctaagatcgaatcacaagaaggtatcgacaactttgccgaaatcttgaaggtttctgatggtttgatgattgctcgtggagacatgggtgttgaaattccagcagaaaacgttcctttggtacaaaaggacttgatccgcatgatgaacgctgccggtaagccagttatcactgctactgacatgttggactcaatgcaagagaacccacgcccaacgcgtgccgaagcttccgacgttgccaacgccgtatttgacggaactgacgctactatgttgtcaggtgagtcagctaacggtgcttacccagttgctgctgttgctactatggcacgcatcgacgagaaagctgaaactgctttggcagcaaacggccgtcacgtaaacgacttcgacgcatcagacgttactgaatcagttgctgctgctgttgctacggctgcagaaaacttgaacgttaaggctatcgttgccgcaacgacttcaggttacacggcaaagatgatctcaaagtaccgtcctaacgctgacatcttggcattgacgttcgacgagcgtgtacaacgttcattgacgatttactggggtgttcaaccaatgatctcagaagcagtggacaacactgatgctttgattgaattggctaagaaggaagttgttgctgcaggtttggcagaaaagggtgatactatcatcgttactgcaggtattcctgttacgacttcaggtacgactaacttgatgacgatcgttacggtcgactaattattagttgttaattaagaacgagagatacaactgtatctctcgtttttttgtgcaactttatgttattctgttgttaagactataacgaagtgatgaggaagtgctgatgagttggcaagaaataattgttgagacacaaactgaggctgttgaagctgtcagcaacattttgatggaagccggagcagaaggtatccaaatcgatgacgcggctgatgtgaacagctacgagcctgccgatgccactgtgtgggttgactgggatgtggttgaacaccgtgagtcaggtgcgacggttgctggatattttgcagaagatgttaatttgcccgaagttatcaatgatgtgcaaatgcgcgtgaaccaattggcgtcatttgggcttgatgcaacgccaggtaaggtgacgaccagtgctgttaaggacgaagattgggcaacggagtggcaaaagtattaccacccagttcgcgtgacacgtcatttgacggttgtgcctaagtgggaagagtaccaaccggcccaagaaggtgaaaaggtaatcgtactggacccaggaatggcctttggaactggaacgcacccaacgacgcgtttgatgatgcaagcgcttgaaattgttgtacgtggtggtgagcgtttgcttgacgttggaactggttcaggtgttctggggattgcagcgaagttgttgggtgctgataaggtacttggtactgatatcgatgaggtggctgtacgctcagcacaaggtaatctggacttgaacccagttgcctcagatatccaggtaatggcaagtgacttgctaagtgacgtgccagcgcaagaatttgatattgttgtggctaacatgttggctgaagtgcttgtgccattgattccacaagttgatagcgttttgcgtcctggtggtaagttcttgttgtcaggtatttatgaagacaaggcgcaaacgattattgcaaagttggaagaaaacggctatgcacttgatgagacgatgaagcttggtgaatggtatggtttgattgctcaccgtaaaagcgaggacgaataatgcaacgttattttttgactgaagcgccaaccggtcaagaatttgcgctaccagaagatgttcagcatcatttgatgacggttcttcgtggtaaagagggcacgcaggcagaatttgtgtatcccgatcaacaaacgatggtagtggctgaagtgattcgtgttgacgatgaaacgacaacaatgcgcgtagttgaagaagtgacaaccgatgttgaattgccggtggagacaacaatcatccttggcctagctaagggtgataagcctgaattggtagttcaaaaggcaactgagttaggggttcaccacgtgattatcgtggagacagattggtcagtcgtccattgggggatgaaagccgataaaaagctggcacgtttgcaaaagattgcccaaggcgcagctgaacaatctcaccgtttgcgtgtgccggatgtaacgtacgttgaaaaactacgtgatttggtgctacctgatgatatggttaaaattgttgcctgcgaagagagcgctaagcagggcgaaacagcacaactggtggctcagtttagtcgcttgaatccaggtgataaaatcgcctttttggtcggacctgaaggtggtttaaaggaaagtgagttagacttgttaacgaagacgtttggctttgtgccagcgggacttggtccacgtattttgcgagccgagacagcaccgctttatgcgttgagcgcactgagttacgcactggagttagcacgttagaatttttaaggttaacatcgttgcagggatgttaaaaggggaattgatatgaaacgtttgaaagaagcgtgggattggcggttctggatttggatgccaatcttggggtggttagtaccgtttgcaattaacgaatcaccgttgacagcgaatgttaagattattttttcattgtttgtggcaaacatgattttcagtgccatcgcgggagctttcttgcgtaagcgtggtgctttctggtacttgatgtttgtgtggccactggtattcttagtatcagtctggctacaattaaactcagcgatgtatggctactatttggcagctctttatttcgtcattgagttgttcgcctttacacgcggacaagaagaagaagtcgacatcgaggatcaaattccagttgatggcggtttccgcgaaatttaaatcaaaaaacgcgaccttgttttcgaggtcgcgtttttttgtgttctgaagcccgagtggggattgtgcccaattacaacgaaagtgatggcggctgttaggacgtgttgctggggtcggtggagatgtcgcccatttttgaacaaattcccaccactttccaccacctaatcttcccacccactgtcccccacctcccaccatcttcataagtaaggtgttaaccgttggtatatcaaggatttgaccttataaccttaaaaaattcttcattttctaaagttattcgaaaacttgtaaagtgactgttaaaaaggagcgttaagcccggtgtaataggcttttgaaccctaaaatacaccatatatcccagtggtagaacgtgggggtaggtggtggaaggtgggagattgtggtaaattaaatgtattgaaatgtcgactattctcaatacgccacagcacctaaaattgctgaataaattgaaagggggtatcgccgatgttcatgggaacttaccaacacacgttggatactaagaaccggttgattatccccgcaaaattccgtaatcagttgggtgaatcctttgtgattacacgttggatggatcattcactacgtgcttacacaatgcaaggctgggaagatttttcaactaagattaacgcattgccagaaacgaatgccaaggcgcgccaatttaagcgttttgtcttcggtggtgcgacagaagttgaattcgacaagcagggtcgtgtgaacctatcaccaaccttgcgtgaatacgcaaatatcgataaggatgtcacggtctttggtttgggtgatgatacattcgaactttggagtgccgagaagtggcaagcttatgaagaagaaactgcagagaattttgatgacattgctgatgggttggaagatttaggcttctaacggcaatggtttgagacaaactagaaaggtcgaacaggcaattacatatgacggagttcaatcacgtaaccgtattgcttaacgaagcaattgataatttaaatgttaagccagacggaacatatgttgatgcaacgttgggtggcggtggtcattcacagttgttagcgagtcgtttgacgaccggaaagctttggtcatttgatcaagacattacggcaattaactataataaagaacatttggctactgagttggctgaaggcaaggtcgctttcattcaaaacaatttccgcaatttgcgcgatgcacttgctgaagttggcgtaacggaaattgatggtatcgtttacgatttgggtgtttcatcaccacaattcgatgatggacaacgtggcttttcatataactatgatgccccacttgatatgcgcatgaatcaatcacaagaattgacggcgcgtacagtagtgaatgagtgggatttccacgacttactacgtatcttgtcacgttacggtgaagaaaaattcgctaagcaaattgctcgtgcgattgaacgccaacgtgaaattcaaccaatcgaaacaacgtttgaattggttgaagtcatcaagtcagcaattcctgcagcggctcgccgaacgggtggtcatccggccaagcgttcattccaagccattcgaattgccgtgaatgatgaattgggtgtggttgaagaatcactcgcacaagctttggatatgttgaaggttggtggtcgcatttcggtcatcactttccattcacttgaagatcgcctagttaagacgatgtttaaggaaaagacggcagttcctgaattgccagctggcttgccaatcattccggatgagatgcaacctgattataaactcgtgacgcgtaagccaatcttaccttcagaagaagaaatggctaacaatcaccgcgctcattcagcaaagttgcgcgtcatcgaacgactacgatagcataggccgcccatgatggacggtgaagaaaggatctgaacatcatggatgcaatgccaaattacacgcacacaacgtcacctcgcaaagttgatcaaccacaacaacgcccacgcgttcgtgtcgttaagcataagctagaaaagccgggctttaacgctatcgatatcgccttttgcgtggcgactgctttcgtagttgtctttatggcgatggttgtcgtacacacgtcaaaccgagcagcaacagcaaactcacaattggcgacaacgtcagcttcccttgaaaaggtacgtaatcaaaacaatgatttgaagcaagaagtaagtgatttgacgagcccaagtcgtttgaacgatattgcggctaagaacggattgacacttcaaaaccaaaacataaggaacgtgaagtagcatggtgaagaaacagcggatgccaaaacgtaaccaatcggataaaaacagtcgtattacaggccttgtgctagtaagtactatgttactgattttggttgtgttgggggtccgtttttcttatgttgccatcacaaaagatgtgaaggggcataagttaaacgaagccgctcaactcatttatcgaagtcagaacacggtccaacccaaacgtggggaaatatttgattctgttggaaatccgttagcggaaaatgcaaccacgtacacactggttgctattattgacgatacacaaaagacgagttcaggaaagccggcctacgttaagccaagtcaggatgaaacggttgctaaacaattgtcaggtattttgggtggcgaaccaaagcattatgtcgatacactaaaaaaggggcgtgcaaacaaattaaagcaagtccagtttggtgctcgcggattgaaaatcgactcgcaaacctataagaagattatggctttgaaaatacctggcattacctttacgaatagtgcgtctcgcttctatccaaatggcgtgtttgcatctaatgtcattggttatacgactgaaaagaacgatgagaaaaccggcacacgtacaattgctggtttgatgggaatcgagcaaaagtataacaagcaattgacaggtaaggctggtgttaagtcgacttcgattgatagtgaagatacaagtgtctcaaaggaagaccaatctgctaaaaacgggtatgatatttatacaaccataaatacaaaactccagacgacgctcgaagataagatgcagaatttgtatgatgatatgaagccaaagtctgcattggcgattcttttggacacgcagactggtaatattgtggcgacgacgcaacgaccttcgtttaacgcaacgaccggtgatggtattggcgattattggacgaacgaaatttctgaatcggtgtatgaaccaggatctgtcatgaagggtatcacgttggcagcggccattgatactgataattggaatggcgatgcttattaccaatcaggaaccttgaaaattggtgacaaggcagttactgattggaataatggtcaaggctggggaacaatcacgtatgcacgtggaatcgctgaatcatctaacgttgcaatggctttgaccgagcaaaagatgggcgccgaaacctggcagaattacatcaagaaattccgctttttgaagtcaacaaaatctgatttgcctaacgaagaaacgggtatgatgcaatttaagtatccgattgagcaggctaacacatcatatgggcaagcaatttctgtgacgccgttgcaaatgattcaggcatatacagcgattgccggtaacggtgaggaaattcaaccacatttggtggaaaaggtggttgatcccaactccaagaaagttgtttatcaggccaagcgaaaggtagtttcaaagccgattaaaaagtcaacggcggaagctacccgtaagcagttggaagatgttatctattcagagtacggattgggtaaggcgtatgccattccagatgtacgaacaactggtaaatctggaactgctcaaattgcgacgtcaactggttattcaacaccaggagataataatcatgaaattcattcgtggatgggaatggcaccatctgatgatccaagatatttgatgtacattgtgacaaaggagccacaacaaaatacggagaatattgctaaagatatgtcagatatgttcattacggttatgcagcaagctttgcagagctcggatgaggataataaagtggttgttagtgcagaccaacaagtgactgttccgacagttgtaggtggctcaactgccgaggcggaaaaagaagttgctgcagcgaacttgacgccattagttatgggtgatggggacactattaagcaacaaacgccagcaggcggacagaagtcgttgactaaccaacgtgtattcttgaatacgggtaaaaatattgccgtaccagacatgcacggttggtcgaagagtgatgtcctcgcgtgggcaaagttagctgatatcaaaccaattattaagggggatggttttgtggcaacgcaatccattaaccctgatacacaattggctgatggctatcatgaaataacagttgagtttaaaaacgcgaaagcggaataaataagggtttataagagaggagaagtcaaatgtcgactttgttactcggactattggtggggttgattgcaacaatcatcgtagtaccgcgtttgaggaattggttcaagaaaattaaggtgcaacaattagtgatgcgctcaggtgaaaatggaccagatcacgctgctaaggctggaacacctactatgggtggtgcaggatttattccggtggttatcatcggctttattatcttggcctttgcaacgggtgctaatgcgtcaactggttgggcaacgttgattgcaatcgttgtgtttgctttggttggtgcctttgatgacagtatcaaggtctttaatcaccgtgatgagggactacgtttcttgccaaagctattttcacaaattgcggcagcattgctagcagtagctgtgctattcttgggtcactttgacttcacgttggatttgccatttaatttgggtagcatcaacagtatcatcgtttacacgttgttcacgattttctggcttgtgggttggtcaaatgccacgaacttgacggacggtttggacggtttggcatctggtacggcgattattgcgtatgtcgcatatttgattattgctttcgtacaaggtgatatgacaatggttttgttagatgcgttgatgattggtgcattgcttgggttcttggtctttaaccactatccagcctcaattttcatgggtgataccggatcattggcgttgggtgccggcttggcgatgaactcactggttttgcaccatgagtggtcattgttgttgattggctttgtcttcatggttgagacgttgacggttatgattcaagttacaagctatcacttctttaagaagcgtattttcttgatgacgccaattcaccacagctttgaaaagggtggattgactggtaacacagataagccatggaatgaatggcaagtggatacattcttctgggcagttggattgattgctgcggttttgtatcttgtgatttttaagtaaatcatcattcactaaaacacatatcaagtcgctaaacgactttttgcattatgcaaacgtgcggggaacgccccgcgtacataactttttaaaggggatctgatcatgagtaagcatgttttggtaattggctttgcacgttctggggcagccgttgcgtctttgttgttgaatgaaggtgcgcaagtgacagtttcagacccaaaattggatttgacggatgaacgcgttgttgctttgcaagcgcaaggtgttgtgttcacgacggagcaaactgacgcgttgttagctgacgttgacttaattgttaagaatccaggtattccataccgtattccagtattggttgccgcgcaggaggctggtattccgatctttgttgaagttgcgatggcacaacgctacatcaagggaacttggattgcgctaacgggttcaaatggtaagacgacgaccactgagatgattgcagctgtgctacgtacacaagcggatgacgaacatgctgttgtcgtcgcaggaaatatcggtacgccggttagtgaagttgcaccaacgttgcgtgcaaccgatacacttgtcacagagctctcatcattccaattgatggggatgccaacggccaagccaaacatcgcgattatcacaaacatttttgcatctcacttggattaccatggcacgcgcgagaactacgtcgcagctaagatgggcatcacgaagaatcaaacttccgatgatttcttggtgattaacgttgaccgtgaagagtgggttgaattgtcaaagcagactgcagcgacggttgtcccagtttcacgtcaaaacgtgagtcaagaaggtgcttacgaactagatggtacgttgtacttccgcggtgaagcgattatgcaagctaaccaactaggtgtacctggtgatcacaatgtggaaaatgcattggttgcaattgctgttggtaagttgatgaatgtgccaaacaatcaaattgcgatgacattgcgtcaattcggtggggttgaacaccgtttgcaatatgttggcacgtttgaaggacgccaagtttataacgattcaaaggcgactgatatcgaagcaaccgaaatggcattatcaggatttaaggcaccggttgtgttgttggctggtggcttagatcgtggagatgaccaaatgcgtttgcttgcagcgatgaagccacacgttaaggctttggttgtctttggacaaacggcagacaaggttgctgcagttggtgaggcgcttggtattgaagttgttcatgctgaggatgcgccacatgcggttgaaccagcttttgaattaagtgagccaggtgacattattttgctatcaccagccgcagcctcatgggatcaattccctaattttgaaacacgtggtgatttgttcgttgcagctgttaaggcacacagcgaaggaaagtagaggagatagatatgcgtattgttgtttcaggtggtggaactgggggacacatttacccagcgctagctacggttaagcaattgaagcaattggaacctgagaccgaggtactgtacatcggtggtgaacgtggcttggaaaagtcaatcgtgccagaagccgggttcgactttaaggctttggcagtgcaaggatttagtcgctcattgtcacttgataacgtgaagacggtttatcttttcttgacggctactcgcaaggccaagaagatgttggaagactttaaaccagatgttgtcgttggaactggtggatacgtctcaggtccagtcctatatgctgcacaacaacttaagattccaacggttattcacgaacaaaattctgttgtcggcgtgacaaataagttcttggcacgtcatgtgacaaaggtcggggttgcttttccagcagctctaccagcctttaaggatggcctggcaacggttgttgggaacccacgtgcccaagaagttgttaatggcgaaggttcatttgactgggacacattgcacttgtcagcagataagccaacggttttgattttcggtggttcacaaggggccttgaagttgaacaaggctatggttgccggcatgtcaaagtttgctaaccgcccataccaagtcatcttcgttacgggtggcaagcgttatgatgacgtgcaagcggatctacgtgctggtggggtcgtaccagctgagaacgttgctgtggtaccttacatcggcaacatgccacaattgatgccagttgttgatttggttgttggtcgtgccggagcgacaagtttggccgaacaaacggcattgggtaagccaatggttttgattccaagtccatatgtgacgaacgatcaccaaacgaaaaatgcacgtagcttggttgaagctggagcagcggaaatgattactgaagaatcactttcaggcacaacgttgttcggcacaatcgatcacttgatgacgcacgatgatcaacgtgcagctatggctaaggcagccaaggaattgggtgtgcctgatgcggcagaccaattcatcaagttgattaaaacagttattaaataagataagtaacgattggaaaggaggcatatgatggccaaagaaaatgaatcaaagccgaaaggaacaaaatctagtgatattcaggcacacttagatgcattgttgtcggaagatgactggtcatcattgccaacgcgccagtcgaaagaaaaaaaggctcgtcgtgaattaaaactaacgcgtcggttgcgtgaaacgtttgctgaagaaccggaaacaagtgacgaagaagagattgaagtagaaccagaaccagaaccagaacccgtaaatgctgaaccactgctgttcccgtatgaacgggcggcaattctttcagcacttggactaacggtcctggcaggaattctgatctacctcatgtcaccgcttagtcaggtcatgcattataaggtagttggttcagaaagccttagtgctgatacggttctagatgcagcccagctaaaagtggggcaaccgttgctaacgacgatgcaccaggctgattatttcagtcacacagctgaagagcgcaatccacaaattgcgggacttaaatttgaacttagagctgacaatacaatcgaagttaaggtgaatgagattgttaaagtcggctacgtgaaatcgaatgatcattattatccgattttggcgaatggtaagatgttgaaagatggtgaagtgaaccaaccaattggtgggttgccactttacgacaacttcaaatccgactcagatttaaagcctgttttagctcagtttggtaagttaccactggcgttgcgacgttcagtgtcagaaattgtgtggtcaccaacggatcaaaacaaacaacgacttgagttatttatgaatgatggtaatgaagtgttgatcagtgctgatgagttggctagcaagctgaagtactacccagcaatggcagcaactttggatgacaaaaagggaattgctgatttacaagttggtgcatattttactccatacggataataagaatttcgttatcatttttaaagacaaaaacaggataatcccgcatgaggtatggaagaaaccttataaagtatggtattatcttaaagaattgtttatttattaaacatcatctgattggcagttaaggaggtactcaaatggccaaccacgggttaatagttggtctcgatgtcgggacgaacacgataaaagtgctagcggcggatgttcgagaccagcaagctaacattgtggcggttggtcgttcgattgcccacggcgttaagcgcggtgttgttgtggatattgaagcaacagccaatgatattcgacaagcagttgcacaaattaatgagcaaacaagcacgccagttactgaggtagtggctagtttgccagcaagcaacattcaaattcaaaatgtcagcgggacggtaaccgttaaggatagtcagcatatttcatatgaggacgttgcggcagccgttaaggaagcgacaaaagttaacgttccaagtgatcgtgaaattatcgaactgttacctacggaatttattgtggatgattttgatggtattcaagatccaaacgatatggtggggatgcgtctagaaatgaaggcggtcgcatatacagctcctcgcaatgtgatggggaacttgcgtatggcgattgcaaaagccgggttgcaactacgtgactttgttttgacaccgcttgcttatagcaagacgattttggacgacggacaacaagaattcggtacgattattttggatatgggtgccggacacacgacggcgacggttgtgcacgatcatcagttgaagttcttgtcaacattcccagcaggtagtgacaatatctctcgtgatattagcgcagtgttggaagttggcttgcatgatgctgatatgttgaagcttgattcaggattagcgctttcaagcatggctcgcgaagataataagttagttatcaagaagattagctcagaaaacgctgagcaaatctctgaggttttgctggcacaaattatcgaagcacgcttgatgcagattttggacaagcttggtgagaagctacaacttgtcggggcatttgacttgccaggcggcattgttgtcgtcgggggtggtgcagcgcttcgaggtatgatcgaagccattcgcagtgtttataatgttcaagttaagtcgttttcaccaacggatatcggcttgcgacaccctggcttctctggggcgtgggcattggttcattacgctgcccaacaatcaccaattcaattgattgttaaagaagccttgtacggattgccattgacagttgttggtcaaccaacgattgcggtggcgacgccggtgcaaaagccagcgacgaatcgccgacctgctcgacctgaaagtcaagcggttgttgaaccatcagttaatgacacggacgatgtcaattacgatgatgaagacaagcctaagaagaagggggcattccttaacttcttcaaggaattcttcgactaaacaaaaaagaaaagataagtgagaaaaaaggagctcgttatggatttccaaatggatatgaaccaagagtacggcgcaacgattaaagtaattggtgtcggtggtggtggtggaaacgccgttaaccaaatggtgaatgacggtgttgaaggtgttgagtttattgtagccaacactgatgcccaagcattggagcgttcagctgcagaaaacaagattcaaatcggtgctaaggccactcgtggtttgggtgctggagctcgtccagaagttggagaagctgctgctaaggaaagcgagcaagaaattgcagatgctttggccggggcagacatggtcttcgtcactgctggaatgggtggtggtaccggtactggtgccgcaccagttatcgctaagattgccaaggattcaggtgctttgacgattggtgtcgtaacgcgtccattctcatttgagggtccaaagcgtggcaagtcagcagctgaaggtttggctaagttgaaggaaaacgttgatacgttgatcgttatcgctaacaacaacttgctacaaattgttgataagaaggccccaatcatggaagccttcaagatggttgacgatgtcttgttgcaaggtgtctcaggtatctcagacttgattactaagcctggtatcatcaacttggacttcgctgatgttaagacagccatggctggtcaaggaacagctttgatgggtattggttcagcttctggtgagaaccgtgccgctgaagcaacgcgtaaggctattgcctcaccattgttggaagctaagattgaaggcgctacgaacgtattgctttcagttaagggtggcgctgatatgtcattgtttgaagcacaagaagcttcagagacaattgcacaagctgctggtactgatattgacatcatcttcggtacaacgattgatatggaaatggaaggcgagttggttgtaactgttattgcaactggtatcgaccgtccagcaacgccacgtccagaaatcaaccttggcgcagctaacacggctagcccatttgaagcagttgctgagccggtagcacctgtgcaacaacaaactacaccagtgcaaccacaacaaccagttaacacggatcctttcgcagattggaacgtgacggctgagccagcacaacaagcaacgccagcacaacaagctgcaccagttgagcctgttcaacctctttcatcagaaaacacggctgctgacgaagaaattgagcgtccagcttactttaactggatgaagcgcggcgaaaagtaaggagacaaccgatggcttttgagacttttagaaacttcttcatgggatcagatagtgattattactatgaagaagaagaggcaccggaagaacaatacgtgcaagaacccgcacaacaagcaacgtcaaaggctaagcctgctaatgcgaatgcaacgcgtccaacggcaacacgccgtcctaacgttttgccaatggatggatcacgtccaggcgagacatcaaagattgcgttgtacgagccacgtacttacgctgatgcccaaacaatcgcaacgcaattgttggctggcgaagcggttatcgtaaatctaggttcaattgacgaaaacacgggaaagcgtgtgcttgactatctaggtggtacagcatttgcggttgacggtatcattgaacgtgtcggtgagcgtatcttccttgcaacgcctcacaattttgagatttcaggaacgatttctcaaaatttgggacaacaatttaattaataggtgaccaaatgttaacactcattttatcgttattgatgttggtcttgcgtgccatggagttcgtaatcttgatttgggtgctgatgtcatggttgcccggggcacaacaatcagccttgggacaattgctgggtcgtattgctggaatcgtggttgatccaattcgtcgtgtgatgcctcgcacgggaattatcgattttacgccattgattggtttgctactgttgcaagctgcccaagtcggcctacgcgcaattgcacaagcattctagagaaataaatttatggcagataatgtatcacaacatttccgcccgagcgaagctgcatttattgatgtagcgcaaggcttaattcgtcaggcattggatgagtatcgtccagtactgacgaattttttgaacccgcggcagagatatattttggagacgttggtcaaccaacatgatgagttaaagattgctcattccggtggctacactgacgccgaaagtgcacggtccttgattgcaccggattattacgatgtacaacaggacgattttgaaattgctgcaatccgtatcaactacccaaccaagtttgctgaactacatcacagtacggtacttggtacactaattaataatgggttatctcgagatagtttcggggacattattagtagcgaagagggtgattggcaaattgttgcaacggaacagatggcgcgatttatcacgtcatcattggatcacgtcggtaaaacaaaggttcgttttgaaccaatgaagctagctgatatcgtgaccccccaagaggagtgggatgatatcaatacaactgtctcgtcccttcgactagatactatagtggctaatgggtataatgtatctagaacgcatgctaaagaattagttgagcgtggtatggtccgggtgaactggactgagattgaccgaccagattttatgctggcggttaatgatttgatttcggtgcgtcgattcggtcgcatgaaattgctagctgaaaatggtataacaaaaaaagataaatggcgcgtcacattggccgtcattaagaaatagattggagaacgatcatggcattgaccccacaagagattcacgctaaggaatttaacacaaagagcaacaagtggtacgacaaggctgaagtaacggccttcttggaccaaatcgtaactgattacgatggcttgctacaagaaaaccaaactttgaagacgcaattggctgaagctgatgcaaacgctaagcaagttgaagagatgaagcaatctgttaactcatcaatcttgattgcccaagaagcagctgaccgtttgaagaagcaaactgaagctgaagccgaagcaacgttgcaacaagcacaagctgaagcacaaaagattgttatggaagccaacgctaaggcaaattcattgttgactgaatctcaatcaaagaacgaagcattggttgctgagcacgatgctttgaacaaggaaatgggcgcattcaaggctaagattgaaggcatgttgaacgcacaattggacttggttaagactgatgactgggctgcattccaacaacctgccgcattccaacaaccacaatcagctgcaccagttttgccagattcatctgcatcacaagctagttcagaggtagaaacggttgttatcttccctgaatcaaacgaaaacgaagaaaacttcttgaataaggactaatttttcgttatcatgtaatcatggtttcttgaccaaacggcaagatgtattccaaacagcgacctaggatttacccggtgagagcctaggatggttacgcagcttgtttatcagcaagaatgattttttaaatacacagaagaggcggctttttgccgtgaattcgggtggtaccacgttgacatgacgtcccgcattggctattttggccgatgcgggattttttagtttcagggtaagccgcatgtcaacgcggtagcacttggattgaacagaaaggattgcgcttttatgaagatgaagcaaaccttgaacctaggaaagacgaagttcccaatgcgtggtaacctaccacaaactgagctacaacgtgaaaacatctggttcgagaacaaggtctatgagcaacgtcaaaagattaacgaaggtaagccatcatttatgcttcacgatggccctccatatgctaacggaaacattcacatcggacacgcaatgaacaagatttctaaggatatcatcgttcgttacaagtcaatgaatggtttctacgcaccatttgtccctggttgggatacgcacggtttgccaattgaacaacaattgacaaaggctggtaaggatcgcaaggcggttggaccagttatctggcgtaagatggccgaagaatttgcgcgtaagcaagttaagacgcaaatggccgacttcaagcgtttgggaatttcagctgactgggataacccatacttgacgttgttgcctgaattcgaagctgcacaattgcgcgtcttcggtgagatggccaagaagaacttgatctaccgtggtaagaagcctgtcttctggtcatggtcatcagagtctgctttggcaatggctgaaatcgaataccacgacattgagtcagacacggcgttcttctcagagcgtgttaaggacggtaagggcttgttggataacgacacgtacttcatcgcctggacgacgacgccttggacggtaccagcttcacaagctttggctttgaacgctgatttcgaatactcacaaatccaaccaaagggttcagacaagaagtacatcgttgcttcagctttgttgggtgccgttgcacctaagttcggctgggacgagtacgaagttgtcgcaaccttcactggtaaggaacttgaaatggtgacaactgagcacccattcatggaccgtgagattttggttgttaacgctgattacgttacggcagatgccggtactggtgcggttcacacggccccaggatttggtgaagatgactttgctactggtcaacgttacaacatgccagttatcatgaacgttgatgaccaaggtaagatgacggctgaagctggtcctgactttgaaggtgtcttctaccaagatgctgacaaggttgctttgcaaaagcttgaagaagctgacgcgttgatcttgcacgagcctgttgtacacagctacccatttgactggcgtactaagaagccagttatcttccgtgctgtgccacaatggttcgcttcaatcgatagcttccgtcaagacattttggatgcattggacgatgtaacgttccaaccagaatggggtaagaagcgtttgtacaacatgatccgcgaccgtggcgactgggttatctcacgtcaacgtgtttggggtgtgccattgccaatcttctacgctgaagatggtacggcaattgttgaccctgaaatcattgaccacatcgctgacttggtagctgagcacggttcaaacgtttggttcgaacgtgaggccaaggacttgttgccagagggttactcaaacgagcactcaccaaatggcgaatttaccaaggaaacggacatcatggacgtttggttcgattcaggaacttcacaccaaggtgttatggccactcgtccaaacctaagcttcccagaagatttggttttggaaggttctgaccaataccgtggttggttcaactcatcattgatcactggtgttgccgtaactggtaaggccccatacaagtcagtcttgtcacaaggattcgtcttggatggaaacggtgagaagatgtctaagtcattgggtaacatcatttcacctaacgaagtggtgaaggagatgggtgctgaaattatccgtttgtgggtaacgtcagttgattcatcagccgatgttcgtgtatcaatggacttgttgtcacaaacgtctgagacataccgtaagatccgtaacacgatgcgtttcttgttggctaacacgtcagactttgatccaaaggctgacaccgttgcctttgatgatttggtcgcagctgatcaatacttctatgcccgctttaacaagttggttgctgacatcaaggctgcctacgatgtatacgacttccaagcagtaaacaagttggttatcaactttattaacgttgacttgtcagcgttctacttggactttgctaaggacatcttgtatgttgaagcacctaagggtcacgctcgtttgtcattgcaaacggtcttgtacaaggtcttggtagacttggacaagttgttgttgccaatcttgccacacacggctgaagaaatcttcgagtaccttgagcacgaagaaggcgactttgcttacttgactgagatgccagttgttgaagacattgctaacgctgacgaattgatgtctaagtggtcacaattcatgacgttgcgtgatgccgtaaacaaggcgcttgaagttgcccgtgatgccaagttgattggtaagccagctgaagcagcggtaacgttgttcttgactgacgaccaaaaggcatggttggattcattgggacaagatgtgcgcgtcttgttgcttgtttctcaattgcacgtggcatcagctgatgaagctggtgatgcaactgactttgatggttacaagattgcggttgctcacgcagaaggtgaagagtcacctcgtgatcgtatgtaccacactgatttgggtgcagatcctgacttcccaatgttgtcagcacacgaagcacaaatcgtccgcgagaacttccctgaggctttgactgaaggcttggagtaatcacggttacacaattaaaatataatatcgataacaggaaaacgtcgggagatttttgtctctcggcgtttttacgtctataatggaggatatatagtttgtggtttgtgtcgacgcgttgcgtcgaggcatggaaatgtgggactatctccggcaaagttcaaatcagggcaaccgaatggcgcggacgccattcagcggggcaaataattccccctaatccttttagtcctgtatgggcttttctgaatagcgccggccatgcggcatgttgccctgatttgaacgctacgatagtcccacatttccacgccagcagccgagatgttctagtctgttttagatttacatccaccggacactaaccaccaccttaaatacataaccaatcaaagagaaggagaccagcgcatgacgaagctatacttcatccgccacggtaaaacagaatggaacgcagaaggccgttttcaaggagcgggtggtgattcaccattgttgcctgaatcatacgaccaaatcaagatgctcggtaaccacttgaaggatattgaattcgcacacgccttttcaagtccaatcaagcgagctcgcatcacggccgaagaaacgttggcaatgcttaacaagcgccctgaattgacgtttatggacggtttgaaggagttttcattcggcgtttgggaaggcatgagctttggtgaagttcaagaaggctggtatgacatgtacgatgcttctcgtaaccacccagagaagttcgatgcgagtcaggttgaaggatctgagtcattcgaaagtgttcaaaagcgtttccgtgaggcagttgaagaggctgttgccacgtacggtggtgaagatgtgaatttggtcttcttcagccacggcgctgctttgacgacgggaatgggtggcctaattggtattccattggcggatttgcgtgcacgaggtggcttgggtaacacaagtacgtctatcctagaaacgcatgatgggcacacatttacggaaattacacgaaatgatacaagttatttgggtgtcgcaagtgatgcctcaaatacaatttaaagagaagaaggatttttaagatgacgcaaccagaaaatgcagcacaagcagatatcgctcgcttggtaagtgagattaacgctaacccagacaactggcaagcctatgcagacttggtggctgttttggttgccacggaaaatcttgtggaagctgaagaattagctttgaagagcttgggcttgttccaagcgaacgatgaagcgttgcaaaatctactctacgcagcagggaacgtttattatgttgctggggattatgcgcgcgcaaatgagtttttcgccaaaatcactgatttggagattttgcatgatgcaacggttatgcaagcacaagcatggtatgcacaaaatcaattccaaaaggcattggtgtttgcgttgacggcagttgagcaacaaccagaagacgttgcagcccaagtgctactcggtaacatttggcttggtttgcaaaacatggataaggcaacaactgcgtttaatgacgctattcatgtggatccaatgaattttgacgcaaattttggtcgaggtattattgcaatcgttgacggtgaccgcgagaatcaatggtcagcaacggctgaaatgattgatatggaacgataccgtgctcaagcacaacgattggatgaaatcgtacaactactatcagggagtcgcgtagatgagtcagagtcaaactagtttgttcgatggcccagcggcatcggatgagacaccgacggttactggccaagtgaagaatattctgtttgctgcccaagattctttttataaggtcatgattatcgaagtggcggatcaaaatttcgattatgatgatactgagttaacggtgactggtagttttggtgatattcaaattggtgccagttatgagtttaagggacgtctaacaacgcacgcccgctacggggtccagtttgcagcgcaaaactatcagcgtcaggcggccagtacgacgtctggtttggtggcgtatttgtcaggtgaccaatttccaggggttggaaaagcgacggcaacgaagatcgtagacgacctggggattgaagcgattgataagattttggaatcaccagacgttttgattgaaacgggtatttcaacaaaattgcaagaagtcatcgtaaagcagttgcaacaatcggacggtatggaacgcgccatcattgcccttaatgattatgggttcggttcagcattggccaccgtgatttaccaaaagtatcagcagcaaactttacagattttaaaaacaaacccttaccaaatggttattgatattgagggcgtttcatttgcacgtatcgatcgactagcagctcagcagggaattgatgcgttggacgcgcgtcgtatccaagcgggggttatttcagcaatcaaccaggcgacatttgagtctggtgatacgtttatgcaagtggaagcgttgctacaaaccacgcaacaaattctagagcgttctcaaaacgcacgcattgatccagcgttgattaagcgcgcgttattgacattaacttctgacggtatcgtcattgctgacggacagaacttgtacattaaggcgttgtttgaagctgaacgtgaaattgcgcaacgtatggtgcgtctaagtaaaacgaagaacagtgaatacaaacgagctgatgttgtaaaacaattggctgaagtcgaggaagaaaatccgtttccatatgatgatgtgcagcgcgatgcgatgattgctgctttgatgagtaatctctttatcctcactggtggaccgggtacaggaaagacgaccattatcaacggtgtggtggcgacgctcaagaagctactacaagacgaaggtatgaagtgggatgaaattagtgagagcattcgtttagcagcgccaactggtcgtgcagcgaagcgactttctgaatcgactggcatgccggcttccacgattcaccgtctgttgggtattactgggcgtgaaaatacagacgatattgatattgaggcgttgagtggtcgtctgctggtcattgatgaaatgtcgatggttgatacgcagctattcgatttgttgttacgtgcgattccaaatgggatgcaagttattttggtcggcgataaggatcaattaccatctgttggcccaggccgtgtattctacgatttgttggccagtggattgttgaattatcgtgagttggagacgattcaccgtcagggtaaggggtcaacaatcattgaactagctagctcagtgaagagtggtgtcttgcctgcgaactttaccgagcgccagtctgaccgatcatttttcccggcacagacaaatcaagtgccccgtatggttgagcagattgcgacgagttggaaggaacgtggtaattcagtcgctgatatgcaaatcttagcaccgatgtatcgtacgccagccggtgttcacaatctgaatgccgtggcccaagaaatctttaatccgatgacggccaagaagcgtgaaattcacatgaaacttggtgagctggagttcaacttccgcgttggggataaggttatgcagacggccaatgatccagaacataacgtgtttaatggcgatattggctacatcacggcgattatgttggcgaaagataaaagcaacgaggataacacggataacattacagtggcttttgataccggcgaggttgagtatacgcgccagaactggaatcagttgacgctagcgtatgcgacgacgattcacaaggcacagggtgctgagtataagttggtcatcatgccactggttaatgcatttagccgtatgctacaacgtaacctgctgtataccgggttaacacgtgccagtgaatcattggtccttatcggtgatgtcagtgcctatcaacgtgcggctgaaacagagggtgttaatcgacacacgacgttgcaggaacgccttcaacaggcacaggatggacaactgccagatgtgccggacgatgataaatcattggcagcggtcaacgcaattaatcaaaagccagtggcggttgtaccagtggacgaggaaaatacaaccattgacgatacgccagtggttgatgaaattgtccaggctgttgccgaagatgatgacgatttgctcacaattgctaaaattatggatgaatcaattgacccaaatgtggggatggcagacatgacgccatacgacttcatgccttaataaggatgtaacggtagcgcgtgactaacattgtgctataatctactagtcaagcactagtgaattgtgctaaaattaagcgataaattttcgaatgaaaaggggtttctgaaatgtcaggacacagtaagtggcataacattcaaggacgtaagaacgcccaagacgcaaagcgtggtaagatcttccaaaagcttgcccgcgatttgtacacggcagctaaggctggcggtgtagatccagactcaaacgcttcattgcgtttggttatcgacaaggctaaggcagctaacatgcctaaggataacatccaacgtgccttggataaggcttctggtgccggtggcgctaactaccaagagttgacgtacgaaggttacggaccagccggtgtggctgttttggttcaagccttgactgataacatcaaccgtacggctgcttcagttcgttcaacgtttaagcacttcggtggtgaattgggaacgactggatcagtttcattccaattcgaccgtaagggttacattgaaatcgagcgtactgaagacaacgatatcgatgaagatcaattgtttgaagacatgttggaggctggtgccgaagacatgaagacttacgatgaccaattcgaaatctacacggaccctaagtcattcccagaagtacgtgatgctttggaagcaaagggttacactttggtcaacgacgaagttacgatggttgcacaaaacccaatggcagtgcctgaggataagcaagcatcattggctagcttggttgatgaacttgaagaaaacgatgacgtacaagctgtcttcacgactgctgagtaatcatcttatgaaaaaccgaccaaatttggtcggtttttttgtaggcgcaaaagttgacgatgtgaacaaaaagcgataaagtagtaaacaattattaataacttgagtcgttaacgtgtttcgccacagactcggaacaaaacgtgtttaggcatatctatatgctggacaccgttaacgacgccgagagtaattcttttggcgtcgttttcttttcctgtatcatttggcgaaccgtaatgatgcaggatttttttaggagagataagcatgttagaacgcttttttaagttgtcagagaacaacacgacggttcgaacagaagtggttgctggtatcacaacattcgttgcgatggcatacatcattttcttgaatccttcagtattgtcgatgacaggaatgccaagccagggagttttcttggcaacaattttgacggctgttgtgggaactcttatcacaggactttttgctaatttgccatatgccctagcaccgtcaattggtatgcaagccatgtttacgtacacgattgttttcggactagggtacacgtggaagcaagctttgggaatggttttcttggttggtttggttgatgtgattatcacattgacgaaggtccgatcaatgattgttaaggccatccccgaccaattgaagcacgccattgcggctggtatcggtttgtttatcgcttatattggtttgaagaacgctggtttcttgaacttcttggttgatccacaaaacatcatgacgttgaatggtaagccatttactgaaggtggtggtgccaaggttattgagagcatcacagcaaacggtgggacgacaccatcaatctcaacttttgcgcaaccagcagttttgttgggattgattggcttaatcattttggttttgttggtcgttgctaatgtgccaggtgcgttcttgctttctgttttgattacgaccgtgattggtattccaatgggtgtgacaaacacgcacatcgatgccatggcatcattctcatcaacgttccacgactttggctcaatctttgggcaagcccttggacctgatggtttgtggtcaatgtttacatcaccaaagcacgttttgattgttgttttgacggtcttctcaatgggattgtcagggttgtttgacgccattggaacgtttatcgggactggtatgacgactggtatcttctcagaagctgaccaaaaggagttctacgaaggtaagggcttcaagtcaaagatggatcgtggtttggttgctgacacgttcgcaacgatgtttgctggtatcttcggaacatcaaacacgacaacgtttatcgaagcgtcagcaggaatcaaggctggtggtcgtaccggtttgacatcagttgtcatttctattggcttcttgctagcgattattgccgcaccattggttaacgtgattccatctgccgccacggcaccaattttggtcgttgtcggtattatgatgatgaatgagtttaagttgattacatgggatgatattgaaattgcgattccagcattcttcacatcagcattcatggccttctcttactcaatctcatacggtatcgctgccggatttattttctatgttttgatcaagagtgtgaagcgcaagttcaaccaaatcagcccaattttgtgggttgtgaccattctgttcttgcttaacttcatttcgttggcaattaattaataaacgatatttaacgcgtgatgccttttgtatcacgcgttttttgttgtcataaatcctatgaaataaaacaagtcgaaaaataattggaaattatcgtggttttggcctctttcttttcgaaggaggtgaatgagatatgagcgttcaaaaacaatttgcgtcgttagtacaaactgctgcccaggtaagggcaagtgatttgtacgttatgccgggagaagcgggataccgcgttttttgttacacagcaaccggtattcaaccattagctgatctgacattagcgaatggtgaagcgttgattcgtcacattaagtttgaggcacaaatggatatcagtgaaacacggcgaccgcaactgggacgctggtgttatttgcttgataaggagcaactgtatttacgaatttccagcgtgggagattttttgaatcgggaatcaattgtggtgagattgatttttgctgttgatgatcagcatatccagttgacgtcacaaagcgatgttggagctatcggtgagacgatgatgaatggtgctgggttgattttgttggctggacaaatgggctcaggcaaaacaacgaccttgcattacttggcccatcgatatttagcagagaaaatggttctgactattgaagatccggtcgaagtggtacaaccaaattttctgcaattacaggtcaataaggcggcacaaatggattatccggatttgttaaagcttgcattacgtcatcatccagacgtgatgattattggcgaaattcgagatgcacaaacggcgcaaattgtggttgaagcagctttgagtgggcacttaatcatcagtacaattcatgcgatgtcgcatatgggtatctggcgtcggttacgtgactttggtattccagctggaacgttgcgtcaggtgatgggaggcatggtctatcagaagttagtcatacaggatggcaacacggcagctgacttagcagttctaacgggtgatgcactggcagaaaggatggctgattggcatgcagagtaaacgatggtcaaaaccagcgcaagttgatttttttgagacattagcccaattgattagcgttgggtatgacttagaaaaagcgttagtgtcgctccaatcattgctgccgaaattgcgaccagatttgcaagtgattgttgctgggttgcgagaagggcggcatttttatccactggttacaccgtatgttcggtcagaaatcagacgtgagttagcctttgcggtagtccatggcaatttaatggaaattctagctgaaattggcagtcgtgaacgacgccggatgcgacaaattcaaaaattgcgtcagttactgatgtatccgattgtgctgtttggtttgttagctgttatatttgcggttttcgtgcagttccttttacctgagttcacgaacatggggatggcattaccgacttttgtggggttgccagtggttttatcaatagtcgccgttacgctaataggcattgctgtgactgggatagtctggtggcgacggcattcttggttgcaaaaattggtggttctcagacgcttaccgttagttgggccggtcgtccgattaagtttggattatcaaatttcactacagttgggattgctgttaacgagcggcgtcagtttttcagtcatcgtcaaacgctttgcaggtttagaagaaggtggggtactaaaagaagttagtcaattagcagaaaggtcactaacagctggcgaaagtattgccgagtttgtcacgaaggtaccgttattaccgcgtgagagtgagttgctgttttcaaaaggcaaacagcaacaagaaattggtcaagagttccagctgctagctgagcggaagtttgacttattagaacgacagattggtcgttatttattgattattcaaccattatgctttggcgtaatcgggttagttgtcgtcggcttatatctattgatgttgatgccgatgtatcaaaatatgggggatttaatgacatggtaaagcaaaacaagctcaagggattcacattgattgaagttgtcacgactgtttttattattggactattggtattgctggtattaccaaacgttaaccacgttcgggcatttgcggaacgtaagcaacaaacggccttggtacaaaccgtgcaaacacaggtagatttgtaccgcaacgaaaatggcagtgcgcctgctactttgaaggacttggctgataagtcgtatttatcagaaggacaattggcccaaattgataaggcagcgattacgttgaagggagatcaagttgttgcgggtaagaagtagaccggcatttacgttagttgaaagtgtggttgtgttaggcgttatgggcgtgttaatcacgagttttacccttatcccacggtcagaaaaacagacttggtcgaaattcgagcgtgaatttaacgaagcctatatgattgcacgccaaaaacaggttggtcggaacgaagagttctatattgatgttcgcgaagaccatgtcaatgttgacggacaggttatccaggttccagcaaattggaccggtggtctaagagtgattcgttgccaagttttcacgatggcaccaattagttttgcgctttataacaaagaaacgatgcgaagacggaatgttgtctttcaactgggaggtggcacttttcatgttgatccgtaaaggcgcattattatcagaagcactcgtatcactattactcgtaacaatgacaacttggttaatcgtgacaacgatgcaatactttaaccgcatacaggttgctgaagaagcacgcatgaaagaggcacgtcgacaatattatgaggaacaaaaacgatggctaaacgacgaggcttcaccctagctgaaacgcttgtggcgttaatggtctttagtatggcgttaagtctattaggggtggctacaaccaacctaaaccaacattatcaaagcaaacgtaatcagcagcgtgaggcgcaagttgcccgatcgattatgtcattggaagcaccggaaacaggattgacgctcaaaacgtgctttaaacgccaattgattttgtacagcaaaataaccaataaaaaatattatttggatgtcagacataaggcatttggtttgtatacacgtcaaggtgggaacatgagatatctcaatcaggttagccaggtgacttatgtacaattgtcgaagcaacgggtgcaagccactattcaattcgaggaaggggtaaaagtgatacaggagataactttttatgaaaaatcggcagggtagtttgttggcgcagacgttaatgctgatgttactttgtttgagcgggttcactttttgggtagcaggacaaagtcgccaacaacaagctaggcatttagtgatagcaaattggacgaagcgacaagaagcgttgcgttttttgatggccaacccggaagcacctgttatgccacaaaacacaaccaaatatccagcagtcatcgaaagagatgagctcaaagaagtggtacttgttgccgaaaatcatcgggttgtgataccacgatatcgtcccgtaaaatcctagaattgttgagaaacagctgaaacctgctacactgttatttagtataaaaaagaggtgagcgcatgtttgagacaatcgaaaacgcagtaaagcatttacaggcagcacaaaaggaaattgctgacgctttggatatggcagcaattgaagctttggttgtgatgattgaagtgatgttgaaccaagaagatgaagaatgggcaacgctatctgaagagcaacgtacggcgattgttgcgatgattgacgatgcggcatttgatgggatgacggttgaattgaagcgccaagtgttgcaattgcttttggttgcaacgatgcgtgaagatggtctgcaagctaattatcaagtgacaccagatgctatcggtatgtgggtcggctttttagctgagcaattcacagcgcagaatgcaacggcgaacctacttgatttgacggtcggtacgggtaatttgttggcaacggtgcaacaagtgcttgcccaacaaggtaatacgttgaccatcaacggtgtcgaaaatgacgatacgatgctaacggttgccagtggcatggcggctttgcttggctttgactggcaattaactttagctgacgctgttgctagtgatcttccaactgatcaagatattgttgtggcggacttgccggtcggttattacccagctgaagtaccaagtcactttgtgacaacggctgaagatggtctgacctacgtgcaccatctgttgattgaacaagctgtcaacgcgttgcgaccaggtggattggcagccatcattgtgccagcaaatctatttgagacggaacaagcacaatcattgttgaagtacttgcaatcagaaaacgtgtacttccaagcgttgttgcaattcccagataagttgtttgcaaacaaagcggctgcaaaggcaatcttagtcttgcaacgcgcaggtggggatgctattcaagcgacgccagttatgctggcaaaaacaccagaattgactaacgttgcagaaaataaggatttcgtgacagaaatgacagcatggatgacggcgaaccacatgctacatgcgtagtcgtacgactgaaacacgtccgaaatagttgacaagatattcataagaaattgtgatatactaatctgcagatattgaacaattccgtttggaaaagaggagacaagtacacatggctaagactatggcgattaatgccggttcatcatcattgaagtttcaattgattgagatgccagcagaaaaggtaattgcaaagggacaagttgaacgaatcggtttgagcgattcaattttcacgttgaagtttaacggtgagaagtttgagttgattcaagacatcgacaaccacgaggctgccattaacttgctattggaacaattaaaggaacacgaagtcattgctgacttgaacgaaatcacaggtgttggacaccgtgtcgttgccggtggtgagtggttcaaccactcagttatcgttgacgacgaagtgttgaacaagattgatcgtttggctgcttatgcaccattgcacaacccagccaacgcaatgggaatccgtgtgttccaaaagttgttgccaaacgccacgtcagtagctgtatttgacactgcattccaccaaacgatgcctcgtaagaactacttgtacgcattgccatacgagtactacacgaagtatggtgcacgtaagtacggtgctcacggaacatcacaccgttacgttgcagctcgcactgccgaaatcttgggtaagccattggaagacttgaagattgtgacattgcacttgggtgccggtgcttcaattacggctatcaaggatggtaagtcattggatacgtcaatgggcttcacaccattggctggtgttatgatggcgacgcgttcaggtgatgttgatccttcattggtttactacatccaagagcgtgaaggtttgactaacgatgaaatgcttaacatcttgaacaagaagtcaggtttgttgggtgtatcaactttgtcagctgatatgcgtgatttgaaggctgttcgtgatacaaacgaacacgctgaattggctatccaaatgttcgttgaccgtgttgttcgctacattggtcaatactacatggagcttgaaggtcttgatgctatcgtctttacggctggtatcggtgaaaacgccgatgacttgcgttcagaaatcatcaagcgcctgaacttcatgggtatcaagatgaacgaagagcaaaacaagcaacgtgacgacgagatgattatttcaacggacgattcttcagttaaggttttgaaggtcgcaaccgacgaagaaatcatgattgctcgagacgttgaaacgttgaagaacgaaaagtaattcatttcttaatagcgattaaacaaccgcgaatctcatttatttgggattcgcggttgtttttttattacggtcagtcctgaaaataagaaagtcgttaaacgagttttcctaacatttttcttttatacaaaaaaataatcttcgatacacgtcagatacatacttttttaaggtagtgcttccgaacaatggtggctttgctaaacttctaagtgtaaggaagaggaggaaagagacatgatgagaaaactacaaattgcattagcgacagcattgacattcggcattagtcaagtagcaacgacggcatatgctgataatagtgcactcggcgttgatccaattttcccaaccacacaaattgatacaaaaactggttactacgatttaaacgttgaaccaggtcaagaacaaaaccttgaaatgacgttgatgaatgatggtgacaagccaatgcgtgttcacgttagcgctaatccagcttccaccaatgataatggcgtcatcgaatacggtaagaacaatatcacggtggacaaatcactaacagctaatgttggcaagatgatttcggtacctgatacggtttggattccagcacacggtacaacacaatttactgcgaagttgcgcgttcaaaaggaacaatttagtggcatcgcagtgggtggcatctcatttgtaacggatgctgataagggacgcacgcaaagtacaggcgtgcaaatcaacaaccgatacgcttacgacatgggggtcgtgctgcatgaatcacccgacaaggtggcaccgaacttgaacatacatcaagtacgcgcgacgtccgttaattatcacacagcgatccaagcgcgtttgcaaaatgacaagcctgcgttcatcactgatatgaaatcacatgcagtgatttacacagctaaggatcataagcgagttcttgctgaagataagaagaatcaaaaagtcgccccaaatagtcactttgactacacaatgatgatggctgatggtcagaagttagcgccaggcaagtatgttgcagacattgatttaactgcgaagcaaggacactggcatttcaagaaagaattcaccgtaacggccgaaaaggcgcgaacgttggatgaacaaaatgtcacaatcagtcactgggcttggtggcaaatcttattgttgattttgctaatcatcttattggccatcttgattatgtacctagttcgtcgcgaccgtaagcgaactgctgagttacgccgattaaagtataccgttagtgaggtaaccaaaaatgaaggtaatcaaaactaataatttcataaagccactgattgtcctgattggtgttgcagcgacgttaacgatgccatcccaaatggcgtttgcggatgaaacgttgcagccgggatcacatatgcctgcgaaggatgtctcgccagatcctaagacttttgacgatgagcactcggttgttcgaaccacaccaacgcaggggccatcttttccaacgccagcctatcggaagggtgttggcgactggcaaacgctaaatggtcaggcagacggtggtgcgtatggtttttcatcggcagcttttcaacgtcctttacgcactgatcatagcttttctttgaagagccatggttacatcacgtcagcaaataactacttgtacacgagcgactttcttggaattgtcctttcaactgcgagtgcggacaaattgtctagtgcgcaatctggtggtgtgaaaggaaaagctggatatgctaatcctgatgtggcatggcaaacaaccttcggtacgcaagcttttggtgagacacactacacgttcctagtgcccggtattactagcatggatcataaaaattttgtacgtcagacgatatatggcaagcaaacacccgtgacagaaagaccatttgattctacgcgttggaaagcaaagccaatttcagaagaatacaacgtgaattatgatgctgatacacgaaagatttcatacacggataataaaggtttaacggcaactaccgatattcctaaagaagtgccacgtgtttacatcggaattctaacgtcggtacaaggaaatggttattacgacaaaagctacattgggcttgacgacatcagcggtacgtacgacacgaccacaacaacagtgcgtttcgtagacaaagatggcaattcactcgctgatgatgcaaaaatcgacagtatcatcggagctaagatttctatttcaggtagtgctgaagaaaattggttagcgcccgatataccacatgcaacgttggctggatcagctgctgaccgtacgattacaacgacggaagatgagtcaaaaaatgtgattacggtccgctatgatgctgtgtcaggtaagttgccagtcaaaatttttgacgacacggacactgcgaacaagattccggatacctcattgccagtagttattggacaaacgtacaactattcggttaaggatttggccaaggtcattccggctaacacccacattgtgagcctagaaaagaatagcggtacggttgctgcagatgatcaaaacaatgtgactaatgaaccaatggttattcacgttgcacacgatactaagtcagaagacgtgacgtttagtcgaacggttcactacgaaggacccgcatcactcaacgtaccggatgacaatgttcaaaaaacgacggtcacccggacaaccgataactacactgggaagacaaccacaaataagccggctgcttggctagatgttaagacgccagatattaagggttatgaaccagatatcaagaaagttcactgggatagtattgatgcgaacccatctgagactttgagccaaacagttacttataagggcgtattcaaagtgtatgcacctgatgcgatggacttcggcacaattacaattggtgacaaatactatcaaggtaaggcgacgaagtcagctaaacaggttcacggtagcttgtatgttgcgcacaccgatgcagcgatggctaatcgtaactggcgcctaaccgctaaactcgatcagaactttatggtcggcaagccaacgctacaaattgcctatgggcaatacgaaattaatagtgattatgaaacagaaattgctaatcaatcagattcatcaaccgatggcatcacggatacggcaattaacgaaaatacacctggtatggtcggcctaaagcttgatcgttctgcacaacaatcgaacgtgcaggccgggaaagactaccacggcacaatcacttggacattagggacggtgccagcataatgaaaaaactaatggccgcgggttaccatgatccgccaacaaaaacatggtagcgattatttttgagattttttgataaaggaaagaggagatttatcatgaagaagactgtatttttggcaacgacggctatgttgggaactttgatggcagcatcaactggttttgcagcaacttacacggacaacacggcaacgactgatgcaaaggttgcatttgaggcaccaaaggaaaacccagacaagccagtaacgccaggaactgaccctgaaaacccagacacaccagaccaaccaggtaacaacggtaacgactcaaaggctttgttgaagttggtttgggcaactgattttgactttggttcacacacaatcagctcaaagcaagagtcatacgccgcacaacaattgaagactaagatgggtaactacattcctgcttatactgaagtttcagacaagcgtgccgttcaatcaggttggcacttggctgttaagcaagacactgactttactggttcaaataacaatgttctgaagggcgcttcattgaagctggttgacccaactgtttcagaattggccggtggtgcaacatcaacgattgcgcaccaagcaaacacggtatcaaagcaaaacagcacggttatggatgccaaggctggcacgatgcctggtaactacttcgcctcatttgctggttcagccgatgcatctgcacacactgataacggtgtgtcattggatgtgccagcaaacgctgcgttggcagatacttacaagacgactttgacttggacgttgactaacgcgcctgaagcctaatcaaaccactgaatagtacgaaagatctgacgtcatgtcaggtctttttttcgatatttcttcgctgagaattcctgggtggatgctactatttcaagacagtaataacttgagatggaggctacgtgatggaatggttgctaggaaaacgtgaatataagaagttacagctctttcgattcttatatcaaagtagcacgagttttaagacgttagaggaaatcgagacgcgctttggttggtcacggtatatggctgaaacattggttactgagctgattgcagatcaacaagccaaccaaattccgcaccatattcagttgtcatatgatgcgacgacgcacattgttaattggttgccaggctatagtgtgagcctggttcggatggagcgagcgtatacgctgtcatcacatgcgtttcaaatgttggttgccacgttaaaagatcgaccatactcattgaacgaactcgctaaaaaaacaggggttaatttgaaccacctaaatgacgataaacatgaattaaataagcgattgggcgcaagtggggtgcgcttaaattcagccaatcgcgttgaaggcaatgaaacagtcctacgcattatgtatgaacgattgatatttgcggcaactgatacaattgatgatattgcagattatttcacgccagatacgatgaaccgcgtgaaccaaattattgactattatgaatacacacagaataagaaattgcggcctcgtcggaaatatttgctagccattacgctagcggtttgggtcgctcgtatggatgtggcttgttttattccaagagataacgattttgatgtgttagtgatgaccgaggaattgaacccgcaaatggcaacggtctatgagaaagtcaaacaagctgccgaacgctttacgaacgtaacgtctgctcatatggatcgtgaaattcgttatggtatgacggcactcattagcaatggttttttgcaggcaagtttggtggctaatgcagaacgacattatttccggttctataatgccatcatgcagattattaaagaacagtattacttgcagttccgcgttccgatgcctgcagaaacagaagatgatttaaaggtgaatctggatcgtgcgatgattgccgtgtatttcttatacaagattgactaccgcggtcacgatgaacaaatgccgttacattcgttgttaccagagtacgaacgatttacacaacaggtgtttgatggcattaaaaaacattttagcgtcgaaaaccacgaaatccgaacgcggctgtttgcgatgttttacaatgtgtttttgcatgcgattagccgggatgtcatgataccaaaaatgacgattatgttggaatttgataatccaggcttgcaaggtgaaattgaattactattgcgtcgtcgatatgaattgaacattacatatattgatgacccgacggtggcggatgctattattgcagaccatttaatgccattggcaccgtacaagcgtctgttcgtttggcagatggctccgtcatttgctgaattggatgtgttcatgcatgaagcagtgaagttaacaatgacacgatttaaaaatcaacgtgaatcatgatgaaaattggtcagggtggcaacaccttggccttttttgttggcgtaaaaccaaaggaaatataaagcgtatcgggcgtcattagggggatttgcctaagtttggtaaaatagagtgagcaaattttagacttattgaatatatagaccagataaaaggaaaaaatacatgtatgcacaagtgattgtcgatgtaccggcaatgcagacaaaccaaccatatacctaccgtattccggctgagttaacagatattgtcgttgatggtatgcgcgttgttgtaccgtttggccgtgggaatcgcttgattcaggggtttgtcgttggtctcattgatgaggctgaagatgctgacaagttgaaagacattgatattgttgtggaactaacgccagtcttaaacgatgaattattgcaactgggtggttggctagcggaaacgaatttttcattccgtattagtgtgttgcaaacgatgctacctaatgtgatgcgcgccaagtattcgaagacgcttcagttggttaagccagaggcgattgcggatgatgctgccgttgccttgctattcgctgatcgttctgaaattccgtttgatgaacatgagattgaaccagcgctattgccaaagttgcaacgcttgcaacgacaaggtgttttgcaggttggctatgtcgtagataatcgcgcaacggctaaaacagttttggcaatgaagcctacacaagacgcagatttctatgacaatgagcgtcgtcagttacgcaagacggcggttaagcaagcacgtttgttgacgttcttgatgacggcaccgcgcgattttatgccaattaagactgttatagatgaacaatatcttgactatccaacgattaaaaaagctgaggaacagggctggattacgcgtgacgaaatcgaagaataccgtttgccacgtttgagcagcccagttgctgcaactgaagcattgacgttaaaccccgagcaagaggtggcttatgaggccattacggctagcttgaataaagctgagaatcacacctttttgctagaagggattaccgggtcaggtaagacggaggtctacttgcaaagcattgcgcatacattggccaacggtaagacggctttgatgttagtgcctgaaatcacgttgacgccacaaatggtacgtcgtgtgaagggacgcttcggtgataatgtcgcagtcatgcactcaggactatcggatggtgaacgctacgatgaatggcgtcgcattgagcgccacgaagtacaggtggttgtgggcgcacgttcagcaatatttgcaccgttggagaacatcggacttatcgtcatcgatgaagagcacgaagcgacttataagcaagaagagaacccacgttaccacgcccgcgatgtcgcactttggcgtgccgagtatcacaatgcaacagttgtcttgggttcagctacaccgtcgctagaaagtcgtgcccgtgcccaacgtggcgtttacacgttgctgacgttgacggaacgtgcgttgcacaatccgttgccaaaggcggaagttgtggacatgcgtgaagcaatgaaggcaggtggggatgatattttctcaccacaattgttaacacagctccgtgatcgcatggacaagcaagaacaaagtgtcttgatgttgaatcgacgcggttatgccaactttatgatgtgtcgtaattgtggttatacgccacgctgtgtgaactgtgatttggctttgacggtgcacaaggacacgggccgtttggaatgccactactgcggttatagcgaaccaatcccaacgacttgtgccaactgtggttctgaccgtatccgtccttatggtacgggaactcaaaaggttgaagaagaattgcaacgcattatgcctgacgcacgtatcatccgcatggacgttgatacaacgcgtcgcaagggtgcaacggacaagatgttgaatgattttggtgagaagaaggcggatatcctattgggtacccaaatgattgccaagggtctggattttccagatgttacattggttggcgtactaaatgctgacaccacactgggcttgccagattatcgtgcctcagagcgtactttccaactactgacgcaagtggctggtcgtgccggacgtgctgataaggagggtgaagtggtgattcaaacgtttaatcccgatcactatgccattcagttagccaagacacaggactatgaatcattctacaagcaagaaatgaatctacgtcatacttggcagtacgcgccgtacttctatacagtgcagattaagattgcccacgagcgtcaagatgaggcagccaaggttgcttatcagacggccaactggctaaagcgtcacttggcatcggattcagttttactcggtccttcgacaggtgcaatcgcacgtttgaagaataagtattattaccgaatggtgattaaatttaagcatgatgatgggttagaggaagcgctaacggaacttgtttcagccggtcaacgactacaaaagcaaggggttacgttaacgattgatcgtgacccagtaaacttcatttagaaaataaacgaggcgtttttatgcgcctcatacatataaaaaggagactggcaacatgacaactaagattgtatttatgggaaccccaaacttttctgtgccaattttgaatgcattgattgcaaatgatgattacgaggttgctgctgtaatgacgcaaccagatcgtccagttggccgcaagcgtgtattgacgccaacgccagtaaaggaagctgccgttgcggctggcattaaggtgttgcaacctgaaaagctctctggttcagatgaaatggctgaagtcattgccatgcaaccggatttgttgattacagcagcttatggtcaattcttgccaacgaagctattggaatcagcacaaattgcggccatcaacgtgcacgcatcattgctaccaaagtatcgtggtggggcacctattcactatgccgtacttaacggcgatgctgagactggggtctcaatcatgtacatggtgaagaagatggacgctggtgatgtgatttcacgtgccacgttgcctatcttggatgacgataacaccggtacgttgtttgataagttgagcctattgggacgtgacttgttgatggaaacgttgcctaagttgattgctggggatgtacaacctgagcctcaagctgaagaagatgtaaccttctcaccaaacatttcaccagaacaagaaattttggacttcagccgttcagcacgtgagattcacaaccatgtgcgtggcttgtacccattcccaatcgcgcacacgacgattaatggcgtccgcacaaagattcaacgcactcacttggttgatgaaacaacaacggcaccagccggaacggttgttaagaagggcaagcacgatttgtggctagctgccggtgatggcaacatcattgcaatcgatgaattgcaaccagctggtaagccaaaaatggacgtaacggcgtacctaaatggacacgctaagttcgaagaaggagacatggtgattactgatgagcaagggaagtagtaataaagtcgccgaatgggagttgcacaatgcacgtgccatggccattcgaacgcttgagaagattcgtaatggtgcctattcaaacttgcaactgaacaatacggttaagcaagctgaattggatgaacgtgatgttcacttgatgacaacgatggtttacggtgttattcaacgtcgcatgactttggagtactggttgaagccattcgtgaagaagccggaaaagttggacccatgggtgcgcgaattgttgtatgtctctcttttccaaatgaagttcttggataaggtgccaaatcacgctatcttcgacgaagccattaatattgcgaagcgtcgcggtcacgatggggtgcgtaagtttgtcacaggtgtcctccacgcgattgaccgtgaaggtgtgcgttcgtttgatgaaattacagacaaggttgaacgtttgtctgttgaagcgtcattgccaacttggttgattaaccaattgacggaagagttgggttgggaaaaggcatcacgtattgcgatggcaattaacgatgctccggcccaatcagctcgcgtgaacttggcagtcacaacggttgcggatgcaacgaagattttggaagaagagggctttacggtcacaccttcaaaggtgacgccagatgccttgctacttgccggtggtcacgttgccagttcacaagctttcaaggatggtttggttacgttgcaagacgagtctgccatgttgatggcacctagtttggacattcaaccagatgatcaagttttggatgcggctgctgcccctggtggtaagacgacacaaattgcaacgtacttgaacgctgcagaaggtggccatgtcgaagcacttgatatccacgatcataaggttggcttaattaatcaaaacgcggaacgtttgcacgtggctgaccgtatcaacgcgcgtacgctagacgctcgcaaggttgatgaagcatttgcggacggtcaatttgaccgtattttggttgacgcgccttgttctggctttggcctattgcgtcgtaagcctgaaattcgatacgataagagtattgaagatagcttgagcttgcaaaagattcaattgggtatcttggaagcagcagcacctaagctaaaggctggcggacgtatggtttacggtacttgcacgattttgcgttcagaaaacgaagatgtcgttgacatgttcttggctgatcacccagatttcgagttggtaccaacgtacacggcctacgatttagatgctcgtgacgatcgtggtatggtccacatgttcccagatgattttgaatctgatggtttcttcattgcaacgttgcaaaagaagcaagcctagttaacaagtaaccgctgaaaggaaggcgtatttttatgaaaattgcgtatgcgtccgatactggtcgtgttcgtgccgacaatcaggattacgtgggcgtctttattaacgaagctggtgcccaactagcaatcgttgctgatggcgttggaggcgagaacggtggggatgttgctgcaaccatggcagtttcacacattggtaatgagtggcagcaaaccgacattcatgatattgtcgcggctcgtaactggctcttaagtcaggcggcccaagaaaatgaaactattttaacgacgtcaaatcgttaccgaacgttgcgtggtatggcaacgacgctagtgattgccgtcattttggtagaccagctagtgattgctaatttaggtgactcacgcgcttatctcattcgagaagggcatttgcgtcaactgacagttgatcataacctggctagcgagctggttcgtcgtggcgcaattactgaagatgaagcagttaagcaccctggtcgccacgtgattactcgccaattgggcgtgactgaagaggcagaaccggatgtatttgaatttgcaacccgtcccggtgatatgttggttttgacaactgatggtatgccaaagcacgtgtcggatgaggaaatcttagctaagattaatgacgcaccgacaatcacagatgcagttgctgaattgattagtgcaacaaatgaagctggtggatcagacaatgtcacagtcttgatcggccgacaagaaagtgaggcacgctaacatggaaatgaatcaaatgattggcgggcgttaccgaattgtcgaaccattaggcgaaggtggcatggcgaatgtttatcgcgcccatgacattattcttgatcgtgatgtgtcaattaaattgatgcgtcttgatatgcgtgataaccaggcagtgcgtcgtcgctttgaaaatgaaatttcagcgacaactgctttggtgcatccaaatatcattcaagtgtatgattacggtgaagatggtggttcacaatatctggtaactgaatatgttgaaggcatggacttgaagcgatacattgctgaacgtcagccgattccagtgacgcgcgtcattgaaattatgagtgacatcttatcaggtgttgctgaagcgcataaaaacggcatcgtgcaccgtgacttgaagccacaaaacatcctgattgatttgaatggtcaagcaaagattactgactttggcattgctcgtgcgcagacgtcatttggcatgacgcagacgaatacggcaattggatcggttcactacatggcacccgaacaagtgaagggtgatattgcaactgttcgaagtgacatttattcacttggtatcatgttgtacgaaatgctaaccggtcatgtgccatttgacggtgaaacggcggtggcagtcgctgttaagcacacgcaggatccgatgccttcgattcgagactttgacccacgtatgccacaagcgcttgaaaatgtgattcttaaggcaacggccaagaatccattgagtcgttatacgtctgcaactgagatggcaggtgatttggcgacagcgctatcacctaatcgcgtagatgaagagcgctgggtcgatccaaatgaagatgcggctgatggtgcgacgaaggtagtgccgttagcgcaaattcaagatatggcagctaagcgtccaaagacgaattctgaaaccgaagaccagttggctgacaaggttgcaccgttgaacgatgctgcagtcacgccgaaaaagaagcgttcgccatggcgctttgtctggctagtgctcggctttgttgtggcgatggtcgttggtttggcgatttatggggcaatgcaaccaagtaaagtccacgtgccaaatctgcgtggcttaacgcaagctgctgccgagcaaacgcttaaggacaataatttgaaactcggcgacgtgacaacaaccaactcagcgacgattgcccgcggtaaagttgtgcgatcaacgcctgcagccgataagacagtagaggcaggcaagaaggttgatttggtcgtttccaagggtgtcgcgaaggtgcgctttggtgattatgtcaacgagaagtacacaacggttgctgaaaacctaaagaacaaaggctacacagttgaacagactgaggtcgccgatgatacgattccggcaggttacatcgtatcgcaaaatattgatgctgaagataaggttgtaccatcaaagacaaccgttaaattcaaggtatcaactggcgtaagccgttacacagtacctgacttcagtggtaagacacgtggaaccgttgatgcttgggcacatgaaaacggcatcagtgtcacgtataatgaaatttactcagatagtatgagtaaggatcaaatcgtggcccaatcgattacaccgggcacgaagattacgtctaacgagatgttgttgatttatatttcgaagggacagaaccctgatgctgtgtcatcaagttcgtcatcttcatcatcgtcttcatcaagttcgtcatcttcatcaagtagcaattcaagttcgtcgagcgcaaacagcgcggcaactgaatcttctactcatcaataagattagataaagcagagtggggatgtcggaggttttagaccaacacctgctgtgacaaaaataaataggagagtaaatggcaaattatcatggacaaattcaattagcgttggcaggcttttatgacgtgttaactgatgacggagaattattccgcacacgcgcacgtggtaatttccgcaagcgtgacatgaagcctttggttggcgactgggtaacctttagtgccgatagccaatctgaaggatatattttggatattgatgagcgtgataacagtttggtacgcccaccggttgctaacgttgatcaagcaattgttgtgacggcggttaagatgccagattggtcaagcaatttgcttgatcgtcaattggtcgcacttgaagaaaaagatattgaaccggttatttatttcacgaagacagacttgcttaatgagcaagaaatggttgaaatggtgacggttgccgatggttatcgccaagctggatatcaagttattttgccagaaaaggcctttgacgagccaagtttgacggctgttaaagacatgctgagcgataagttgtcagttgttatgggacaaactggtgcgggtaagagcacgttgcttaaccacatcgcaccggaattggacctggcaacaggtgaagtttcacaagcgttgagtcgtggacgtcacacgacccgtcaggttggcttgattaagctgtttggcggttttgtggccgataccccaggattctcagcgtttgaagtattcgacatggaagcacgtgatttgacacgttacttccgcgaatttaacgaattatcaccaaactgccgcttccgaggatgtgttcacttgaacgaacccggttgcgcagtgaaggaagcgttggccgccggtcaaatcatgcaatcacgttacgacaactacaagttgttttacgatttgattgagggtcgccgcccggtttataataaacacgataagaagcactagaaaaatacgaggttttttgagatgacgattaaggtagcaccatcaattttgtctgcagattacatcaatttgcaaaaggacatcgagttgattgaatctgcaggagcagaatttgttcacatcgatgttatggatggtatgtttgtaccatcaatttcttacggtccagcctgggttatggctttgcgcccagtaactgacatggtcttggacgttcacttgatggttgagcaaccagaacgctacattgacgtttttgctgaagctggttcagatattatcggtgtgcactacgaggcaacgccacacattcaccgtgctttgcaacaaatcaagaaccacggtatcaaggctgaagttgttatcaaccctggtacgtcagtggctgctatcgaacctgttttgcacatggttgaccaagtgttggtcatgacggttaaccctggtttcggtggacaaaagttcttgcctgaaacgttagagaagattgctcgtttggctgaaatcaagcgcgaaaagggctatgactacgacatcgagatcgatggtggtgcaaacgacgaaacgactaagttggcctacgaagctggggcaacggttgcggtcgctggttcatatgtcttcgataaggttgacccagcagctaagattgctcgtttgaaggaagtgacgtcagactaatggaacgcttgcgcctactagtcggtggtcctatctcggaatggccggaagaacttgcaaaggggacgctagccggtccatgggcggctgctgatcgtggcgcacatcgtttgttagccttaggtcacgtgccagtcctgaccgttggtgattttgactcgatgacaccaagcgaacgtgaacaaacgttggcccagttacctcgagtcgtgagtgccaagccggaaaaggatgagacggacacggaattgctgttagatatcgttgaacgcgagctacaacctgacctgattgaaatatatggggcaacaggtggtcgcatcgatcaattgctatctaatatttggatttttacgcaaccgcgttttcaacagttagcaacgaaagttatcctgattgatcgcacaaatcgtgtgtcgttctatttacctggcacacacgcgattacgcacacgccgggcatgaattatttaggattcatgccactaacaccggttacaggcttgactttgatcgatgaaaagtacaaactaactaactggcaaggtaatccattctcgttctcatcgaatgaatttgacggcgacgttaatcatttttcatttgagtcggggatggttgcggtcattgaaagtcgggatctaactggtcaaacaggcgattaattcgcaattccgacacagtttaatcgtgtaaagtaaaaatactttacacaaaacccttgcacatcgagttagggtttgatattattattcaagtaaataaaagcactgaattaaaagagcttaagattggagggtaaacatatggcagttgatgcagtcaacggaaagcgtactcgcttcggtaaccaacgttcacacgcccttaactcaagccgtcgtagctggaagccaaacttgcaaaaggtgacggttaagattaacggttcagcacctaagaaggtgtacttgtcagctcgtactttgaaggctggtttgaagaacggttcaattgagcgtgtttaatagataaagctaccgtttacggtggcttttttctttatacacggtatttgttcagggtataacgaaattggctataaggacctatttctacgctacgatatggtagaatagatatagttttatacggaggtcatacaagatggcagttaagattcaaacaacgcaaggtgcaattgaaatcgaaaacgaggtcattgcgacaatcgttgggggcgcagctactgacaactatggtgttgttggtatggccagccaaaacccactacgcgatggtgttaaccaaattttgaatggcgacaacttttcaaagggtgtcgttgttcgtcaacaagataatggcgttgttgtcgacgtccacatcattgttgggtacggtatgaaaatttctgaaatttcaaagagcgtccaagctcgtgtaaaaaacgatttgaatgtcatgcttggtattgttgctagcgaagttaatgtaacggtacaaggtgtgcgcatgctaggagactaaaaacctagttataaggagttgagaaaagtggaagttgtaacgactattaccaacgttgaatttggtaagatgatcaacgcggcagcggatgcgctgaagaataacgcggaaaagattaataaattgaatgtgttcccagtcccagatggtgacacgggaacgaacatgacgttgtcaatggcaagcggtgctgagtacgagcgtaacgaaacggatacgcacttgggcgctttggcacaagcaacgtcaaagggcttgctaatgggagctcgtggtaactcaggtgttatcttgtcacaaatcttccgtggatttgcggctaagattgccgacaaggagacgttgtcagcccgtgacttggctgatgccttgatgggtggtgctgagacggcttataaggctgttatgaagccaactgaaggaactatcctaacagttatccgcgaagccgccgcagccgctaaccgtacggcaaaggagtcagatgacgcagttgttgtaatgaaggaaactttggatgcggctgaaaaggctttggcatctacgcctgacttattgcctgttttgaaggaagtcggtgttgttgactcaggtggtcaaggacttgttatcgttttggaagctttctacgctgttttgtctggtgaagaaatcacgactgaaattgataacgctgctttggatgcgatggtgatgtctttgcacaacgccggtgttcaaggtgacttgaaccctgaagatatccaattcggatactgcacggaaatcatggttgatattgcaaagggaacgacttacgatcaagaatttgattacgacaagttctacgagcacttggcagccatgggtgactcattgttggttatcaacgatgatgaagtcgtaaaggtgcacgtgcacactgaagacccaggtgaagttatcaactggggaacgcacttcggttcattgcgtaaggttaaggttgataacatgcgtgatcaacaagctgaagctgctgccgcggctgaagcacaaaaggaagctgaagctaaggccgaagctgaaaagcctgcagttgatttggcagttatcacgacggctactggtgaaggaatcaaggaattgtttgcttcatcaggtgcaacggttgttattgatgccgagcaagcaccatctacccaagatttggtgaatgccgttaaggaaagtggcgctaaggaagcgttgattttgcctaacgacagcaacatctttatggccgctgaccaagcagttgaaattgctgatgtgccagttaaggttgtacgcacgcgtacagtccaacaaggtttgacagcgcttgttttgggttacaaccctgaaggaacgcttgaagataacgctgaagcaatgacagctgctttgggtgatgtgaagtctggtgctgtaacgacgtctgtccgtgacacgacgttgaacggcttggagattcactcaggtgacgcaattggtttgtttgacggtgaaatcgtcgtttcagtaccaaatgccgacatccaccaagctgcagtagaattgctaggcaagatgattgacgaagattcagaacttgtgacggtgtactacggtcaagagtcatctgaagacgatgctaacaagcttgaagaagctggtttggctatcgacgaagatttggaattcgagattcacgatggtggtcaaccattgtacccaatcttgatgtcagtcgaataatagagtaaatacgaaagcgccaacacgctcggaatttccgaatgtgttggcgctttttgattacagtagatgttgttccttcagcaactcttcaatccaagtgcccttaattttcttgttgagcgcaagtttaacgagctttggcatgtgcaaatccatctcatcgagcttctttttgtctgacatgtagtagaaggctttcagtagttcgcggatatcgaatactgaaccgtacacttcaggcaccgcacggtcgacgtccattaatgtataaacggcttccatcgcagtgcgaattgagtattcggtcgtaaagacggtgtcgcggctaggcgattcagcaaagttaccaatgaaagctagattttctgaatcgttaggtacaacggctgggcgatcgccagcctcacgtggcatgaagtatgacgtgatgaacggcatgtataccggtacggtgttcacgttttcttgcttagcgagttctttgatttttacttcgggaacgccaaggtggtagagcaactcttgcgtgatttcctcaccagttgcttccacgattgtcttatcaacatagttccccttagtgtcagagtacaaaccgtaaatccaaacgaccgtctcgttttctttttgcgttttaaaatgaggctgacgatgaatcgtgaaactcatcatccagtttgaatcagtgatggtgataatgccgccggtgttgaccttgtgatcatggagactgcggtttgtgagtcgttcaatgtacggttcgatttcaggcaccttgatagtggccgtcgccgagatgaaccaactgcggtcgggcagattctcacaaaagacttcaggatggccgaattcatcagactgggcagctaggttttgccacaagcgccagctaccaccaagctctttcgatacgggtgctgcttgatggtgtgaaccataagttgagctctcggtgattgaaccgtttgtgacaaagaccaaatcgtcagctgtcaaaggaatggcttgctccgtgccgtcaattgtcaccacaagttctgtagccgtctttttgtctgcttgcacatcgacaacgacattcgtcacttgggcgttgtagacgaagttcacatcgtgtgattccaagtacttgatgattggcaaaaccattgaatcatactggttatacttgttgaactttagtgcggtaaagtcaggcaacccatcaatgtgatgaatgaatcgcattgcataacgacgcatctcaaccgctgaatgccatttttcaaaggcaaacatggttgcccagtaactccaaaaattactctcgaaaaaatcaggtgtgaagaaatcttcaagtgtttgacgtcctaattttgattcaggtgtcatgacaagcttcacgagttccatcgccttgtcatcaagttcgtacttgccatcagttgggacgcgctgtccgagcttgtaaatgaggcgtgtgttagatgaatttggatcatcttggtccagccaataaaactcatccaagtaggaagcaccttcgatttccaaagatggaattgaacgatacatgtcccacatcgtttcgaagtgattttccatttcacgaccaccacgaatgacaaagcctacgttcggacggttgtcaccatcgagcgatccaccggggatggggagctcttcgtagatgtgaatttgacggccaggtacttgggcatcacggactaaaaagaccgctgtagctaaaccagccaggccaccgccgacaatatgagctgacttcttatcggcatcagccggcttacgtgggtgagcaaatgcttcatagttaccatttgaatatcgcatatgtatcctccataaatttcactttccatgcaatgtgttgtatgcagtcagtgtacggaaacgtcataacgtttccataacttatcggggaaagttgtatgaagcaagctatgctggcattcaatgctatataaaggccagttgagaacaatctgaccttgattttaaagttcgctatgttgcttgcgagcctggagcggtgttgtcccatacgctgctttgaagtattgcatggccagacgtttattagttagcccgtttttcgttaatagttccttgacgggttcgtcggtttgtaacaagtcttgatagaagtgggtgagacgaacctggtagatgtattgcaccggtgataaggcaatttcttgcttaaataatcggctcaaataatttggattatatgaaaacatgtctgcaagttcgctgattggtagctgttcggcgtagtggtcattaatataaccgaggacttccttgagatgatctgtttttgtttcaggtgtcgtgacaggggctgaaaacgttgtaaataacgcaaacaacatctgtaaaattgttgcctgaaaaataaaggggtaacctggaatctttgtgtcatagatatcacctaagactggaaagtagtcggcaattttttgataatcagaatcagttaaatcgagattgaaggttgtgctttccggatcgggccagtaattcttaataaagtcgataggaatctggagaacgtaagcttcgtttggcgtattactgacagcgtgaattgccccagatgggacaacgataaattgcccgtcagagatttgggtcatcgcatggttcaaagtaaacgttagctcaccgtgaatcacataaataatttctaaactgcggtgccagtgaaaaggcaccaagccaggttcatccatttttgaatagtaaaagcggaccccaacatcagggttgtgttggacagtctcgtgataagtcttttttgtcataaccctattatcaccgataaataacacaaaaacaggtcaaaaaggttacaattctcacttttgagaggtatctttttaaccaacgctcggaaatgtattgtcaatgtatccgcttacattgtactcttgttaagtaataacgaatgaagagatgacccaaaggggaatataaaaatgacaatgattcaaaatccagtaattccaggaatggcaccagatccatcaatcatccgcgtgggcgagacgttctacattgcaacgtcaactttccactggacacccggtgttcaaattttcgagtcaactgacttggcaaattggacgttgattgaccaagtgttgaaaaatggtgaaattaacttgcaaggaacaaacacaccagcaggtatttgggcaccgcacttgtcttatgatgaagcaactggccgttactggttggcatactcacacatgttgaacatggccggtcgtgagtttaactcagactcatacgcgatgtgggctactgatattcgcggtccttggtcagagccaatttacctaacgtcaattggctttgacccagctatcttccacgatgaagatgggaagcactacgtttcaattttggaatgggagtcacgtaccggttatcaagcgccaggtcacattgtgattgcagaagttgaccttgaaaatggtggtatcattggtgattggcaccgtgtgacgcaaggcttcacaacgcgcggcgctgctgaagcgccacaaatttacaagcgtgatgattactactacttgttgattgctgccggtggaacgggttacggtcacggtgttgaaattggtcgttcaaagaacgtcttcgggccatatgaagcacacccatctggtgagccaatcattacgtcttcaccacaacacttgttctcattgggtgatccagatgctggtcaattccaaatgtacaaccctaactcagtgatgcaaaaggctggtcacgggtcattggttcaaacgcaaaccggtgaatggtacatcgcacacttgatgtcacgtcctttgccagacacgacgttgaacccattgggacgtgagacgtcattgcaaaagatggcatggacggctgatggctggttgcaaatggctgacggttcaaacttggcgaaaatggaagtgccaggcatgactggtgttgaatttgagaacacggcatctgaagatattaatgaaacgtttgattcagaaacaatcgataatcacttcatgacgccttaccgtgatcaaacggcagcttgggtaaacacgacagaaaacccaggccacatgcgtatctacggtggcaactcattcttctcacaaatgcaaccaagcattatggcaacgcgcgcaacgtcatttgtttatgatgttgagacggccgtaacgttccaaccagatcactattcagaaacggctggtttgggattgtactatgatgccaacaactggttctacgcacgtttgtacaagtcagagtcacttggtacgacgacattgagcgtgttgcaagctaagttgggcgagcgcgtggaatacgtcttcaacaaggttccaatgccagagggccacgttgaattgcgtatgcattacgacttcggccgtgcaacaatttcataccgtcgcaacgctaacgaagagtggacggtattggtagctgacatcgacgttgcttacttgtctgacgaaggtgttaacggtgagccaggtgaaattggtggctttacaggattgttcaactttattggatcagtcgacgcccaccaacacgacagctttgctgattttgactactactcagtaaaaaataactaatacaaatcaaattcggggattcattaccacggggaaattattatgaacattaaagaaattccattgcgccgattggtgccgggactaattatcggaccagcgacttggcttggcccatacatcgtagcgtcaagtttgttcttgccagctatgttgcaacaacttgatagtgcgcacaaggtgcaattggttgcgatgttttcaacgcttgcgatgattgtcgcagcgatttcaaacatggttgccggtgccttgtcagacaagacgaagtcacgctttgggcgtcgtacaccatggcttgttggtggtgcctttgccttcatgctagccatgattggttcagcgctagcgccaaatgtttggctattattggccgcttggatgtttggacaatttgcattgaactttatcgttgcaccaatggtggcttggttggacatggcgcctgagtcaggtcgtgccacggcatcatcagcttacggtggtttgggaatggcgttgggtaacaacggattcacaatctttggagccatgatgttgggatcattccgtttgggatttgtcgtattcggaattatcacattcatcggaacgttgattgccgcagcaatcgttcgtgagccatctaatttggatgccgacgatgaagcggttacgccagaagttgaagaaaagaagtcattgaaggaagctttggctattttcccagcttggcgtgttggtcgtgactactacttggccttgatgggtaagttgttccaaggtgttggaaactttgccatcacagggtacttgttgtacatcatgacggacttcatgcacaagggaacaagtgcaacgcaatcatcaattcaattgattaacttgattatgttggtgttcggtattgcaatgggattcttggctggaccatttgctgacaagttcaagttgttgaagttgccagttggtttctcaacaatcttcttggcaattggtgcgttggcaatgttcatcttgcgtaacgacatgggtatcatgatttacgccttgatggctggtttgggaatgggactttggaactcattggacaacttgctaaacttggaagttgtgcctgatcgcaaccgtgttgccttcttcttgggtgtttacaacctaggaaacacagtaacgcaagcattggccccagttttggcagccgttgtgatttcattcttcggttactcagctatcttcatcatgtcattcatctttgccatgatcggtggtatcttgattctttcaatcaagtcagttaagcgttaataataattaagacagcaactcagatttgggttgctgtctttttgtgtttgcgcatgaatcaaacccgatattcagtaaaacctaattttgcggtataatggtacatcagaaaggaaggtgttaagcatggctagtttattagatttagttgatgagcttgatggtgttggccctaagcgtgtgcaagcgctgaataaattgggcatcttcacaatcgacgacttactcggctactatccaatgcgctataacgacttagcgatgaaaacgcctgccgaaacgcaagatggcgaaaaagtaacgttcaaaggcgttgtgacatcgccacccgtggttaatcgcttcgggtataagaaaacacgaacaagtttccgtttgacggtcgaacatgacacaatcatggtgtcgttttttaatcaaccgtggattggcaagaatcttgaaatcggccaagaagttgcggtgcatgggacgtatgacaaaacgcgtcaaagtctatccggcattaaattaatgtcacgcaatggcgatgatgaaatggaagctgtctacccatcatcgaaggaaattaaagcgaagacaatcaaggatttgattatccaagccttgggtaagtatggtgaattgctacgcacggatattgtgccaagcaatttgcgcacccgatataagctcatgaatcatcatgacacggtgtttggcatgcatgcgccaaccgatggtcaggtggcaactgaagcgcgtcgcagtgcgtcatttgaagaattcttcgtcttccaaatgcgtctgcaggtgattaagtcaatggaccgtgataaccgcgggcgggcgattgcgtttaataacgatgaactaaaggcctttattgcaacgctgccgtttgaattaacggatgcacaaaagcgagtggtgaatgaaattgtgcgtgatatgaaacgcccaattcacatgaatcgcttgcttcagggagatgttggttctggtaaaacggttgtggctgccttggcaatgtacgcggcgattaccgccgggatgcaagcaactttgatggcgccgaccgaaattttagcgcaacaacacgcgaaaacaattggcaacttctttgatccagaaaaggttcgcgttgaattgctaacaggctcaactaaagctgccgcccgtcgtcaaattttggaagatttggaaaatggtgatatcgatattttgattggaactcatgctttgattcaaccagacatcgcgtttagaaatcttggcttggcggttattgatgagcaacaccgtttcggggtacaacaacgtgcaacgctacgtgaaattgggatgaatcctgatattcttgcaatgacggccacgccaattccgcgtactttggcgattacagcgtatggtgaaatggatgtgtccatcatcgatcaattgccagctggtcgtaagcaaattaagacgtactggctccgtagtaatgagatggaaaagacgattgcatttattaagtcacagttgcaagaaggcgcacaggcctatgttgtcacaccgctgattgaagagtcagaaacgttggatgtgcaaaatgctgaggctgtttatgctgaattgtctgagtactttgcaccgacgtataaggttggtttgctacatggtcgtttatcaaatcaagaaaaagaagatgtgatggccgcattcaaggcaaatgagttccaagtgttggtttcaacgacggttatcgaagtcggggtcgatgtgccaaactcaacagtgatgctgattttggatgcggaccgatttggtttgtcacagttgcaccaattgcgcggtcgtgttggacgaggaagccggcaatcatatacgttcctgattagtgacccgaaaacgcaatacggaattgatcgcatggaagcgatggtgggaactaccgatggctttattcttgcgcaaaaggatctggaacttcgtggcgctggtgatattttgggtaaccgccaatctggggtgcctgaattccgcgttggcgatccggtagctgacttggcgatgatgaccgttgcccaagaagaagccattgaaattgtttcgaagcctgattgggataaagatccggaactggcaccattagcagatatgttgtcagaaacaatggcgcgatatcgtaattttgattaaaaaagatacgccttttacttttacccactcctaaaagtgtgttagatttgttctagcatttatttattaagttattattttttgtgaattcgagagggaattaatgatgtttaagattgccattgatgcaatgggtggtgacaacgcccctgaagcaatcgttgctggtgttgaactagcgcgtgaccaaatgcctgacacagagttcttgttgtttggtcaattggataaggtaaagcctttcgttaagaacgaagagcgtttgacgttggtccaagctgatgaagtgattgccatggctgatgagccggttaagtcaattcgtcgtaagaagcaaagctcattggtattggctgcgcaagcggttaagaatggtgacgctgatgcggtcttttcagctggtaacactggtgctttgttggcagccggtatctttatcgttggtcgtatcaagggaattgatcgtccagctttgatgacggctttgccagcctttgatggtcctcacgatgccttcgtgatgatggacatgggtgctaacgctgaaaaccgtccagctcacttgtaccaatatggtgtgttgggttcattctacgcccacgaaattttgggctatgaccaaccacgtgttggtttgttgaacaacggaactgaagaagacaagggtgaccaagtccacaaggaagcgcaccaattgttgcgttacggctcagacaagaacttgttgaacttcgttggaaacgttgaagcacgtgacgttttgcaaggacctgccgatgttgtgattgctgacggattctcaggaaacgcaacgttgaagtcaattgaaggtacggctttgtcaatgttgaagttgatcaaggataccatcatgaacggtagcttgaagacaaagatggccggtgccatgttgaagccagcgttgaagggcatccaatctcgtttggactactcacaacacggtggtgccgtagttatcggtgttaatgcgccagttgttaagacgcacggttcagctggaccagatgccgttgctaacacgatgaagcaaatccacacgatgttggaagctgatttggtgggtaaggtacaacaattcgttgctgaccataaggaagatttgtctgctcgtccagagaatgaagtggacggttcggccgaatagcgttacactaaataacgttaaatattcgaataggaaacggaataatggaacgacaagaaatcatgaataaggttatcgaattggttgcggaccactttgaattggacccagctaaggtaaccggtgaattgaactttttgactgatattgatgctgattcaattgactttgttgaattggttttggagatggaagacgaatttggtgctgaaatttctgacgaagacgctgaaaagttgatcacggtcaacgacactgttgattacatcgcagcacgcgtttaatatttgtaaattaaaggcaaggacactttgagtgctccttgccttttttcaatcttgtgacacaacaaaaaacgtcgttataccaacggtttctctggtataattgactagtatatctagaaaggacggcttatgtttaaacaacttcaagcagaattagcacttgcccataatatccattttaatgacgtgtcattattggaggaggcattaacacaagcaaactatattaacgaacatccaaattacactggtcgcgattaccaacgcctagaattccttggggatgcggttatgcaacaatcaacggcggtgtacttgttcaagcgttatccagattgggatgaaggtcgattgacagagttgcgaatttctatggtccaaactcgcgcttttgcagctttgtcacgtgagttgcatcttgatcaatatgtccaactgggacgtggtgaagaattgtccggcgcacgaaaccgtgattcattgctcgaagatttgtgggaagcctttattggcgccttgtacctggaccagggacaagaggtcgtcatgaacttccttagtgaaattatgtttacgaagattgacgaaggattctatgatcaattcgttgattacaagtctaagttgcaagaacacttgcaacgtcatggtagcgtaaagattgcttacacgaagctatctgaacgcccagttgagaataatgaacaaatctttacggttgaggtatcggtcaacgagcaagcgttggcgactggagagggaaagtcaacgaaggaagctgaaaaggcagccgctcgtgcagcttatcaaactttgacgaagaactagggaatcggtatgaaattaaaaacattggagattggtggatttaaatcatttgccgatcgtaccaagattgaatttatgccaggaatcacaggggttgttggaccgaatggttctggtaaatcaaacatcatcgaatcgattcgctgggttatgggtgaacaatccgccaaaggactgcgtggtgacaaaatgtcagacgtcatctttggtggaacggcacaacgcgcaccacttaatcgtgcagaagtgtcaattacgttcgacaacaccgaccattatttgaattcagaatattctgaaattcgaatcacccgtacactgtaccgtaatggcgattctcgttaccaaattaacggtacgacagtacgcttaaaggatatccatgagctattcatggattctggattgggacgtgaaagtttctcaatcatttcgcagggccgcgtggaaagcatttttagtgctaagcctgaagatcgacgaacgattatcgaagatgttgcaggtgtttataaatacaagcaaaacaaagataaggctgaaaaagagctaactggtgtgcaagaaaatttgaatcgtgttcaagacattttgtatgaattggaaggacgcgttgagccattggctgagcaatcagcgaaggcgcaagattatcttgaaaccaagaagcaatttgacaagcttgaccaatcacgtttggtattggaactaacagattggtacaacgagcaaactgaaattgcccgtgagttggccggcgctgagcaagctagtgatggacaagcgaaagttgtgaagcaacagacggactcgttgacggcgatgaaggatgagcgaacacaaacggaaacagcccgtcaagaagcgcaagataagttgttggccttgacgactgctgttgagcaattgagtggtgaacaaaagttgcaggccgagcgttcggccaatcgctcaaatgcaacgcgtgaattaaaggcgcaaattgcgcaagttgaatcacgtttggctgacttgcaggtgacggaagcgacgcgccaaaagaaggtggctagtcaaaaagcaactgcggacgaattgcgattgcagattactgaattgaccgcgtcacacccgcgccaacaagaagcagcggttagtgaggaaattgaacaagttcgtgcgaacttggttgacgcgatgcaagcgttgacgacggcgaagaatcaacagtcatatttggctcaagaacacgagcgcaatgatgctgagtctgcacgtttgcagcaacgtagcacgctgttagatgagcagattgcaacagcaacggcgaatgtgacggctgcgcaagctgaggttgacgaggcaacgaccgttttggcagatgaacaagcagaatttgtccgtttgcaaacggctggtaaggagcttgaagctaagagccaggcacaacgtcaagagtggttcagcaagatggaagaagaccaacgattgtcaacgcgtttgcagtcgttgagtcgcctatcagaaaactacgatggttatttccaaggcgttcgtaacttgatgaaggctaaggataacttccaaggcattcacggcgttttggctgagctgatttcagttgagacacctcatcaaacggcgattgaaacagcccttggtggtgcgttgcaaaacgtggttgtgactgatgaacaagttggtaagcaagccattcgctatttgacagaacaccgtttgggacgtgtgacattcttgccattgtcaacgattcgttcacgcgagttgcaaccgggtcagattcagactgcacaaagtcaacctggctttatcggaattgcggctgacttggtgaagactgatgttacgtacaacacagtagtgaaaaacttgttgggtacgacagtgattgctaagtcaatggacgaagcggtaccaatggctcgcgcgttgcaacaacgtgttcgcatcgtgacccttgatggtcaagtgatgaatgccggtggttcaatgaccggtggggcaaaccgtaaccaaggtaacggtttgctttcacaacaaaacgaagtggaaacattgacggcgcaagttgcgacgttgcatgatgaaacggcaattttggaacgccaagtacgtgaaattgatgctgaattgcaaaatgtgacggcatcatttaatgaacaacaagctaaggtgctagcagcgaatgagcgtgcccaacaagcaacggccaagttgcaggttgcggaagaacgtttgacccaagtgcaaaaagagaagacggcattaagctatgaatttaatgtttcaagctctggcacggctgatcatgaaacaatggttgccgagaatgcttctgaagtcactaatttgacggagaagcaagctaagttgcaagcacaattagctgaattgaccgacgagcgcacggaattgttgactcgcatttcagatgctgatactgagttgactgaattgcgtgctgaattggcaacggcgcaagcaaatgtgcaagctgcccaagtccgtcacgaagatattgttgaacaaattgaggctgagcaagctcgcttgaacaactatcaacaacaaatgacagatttgacgtctgatcaaagtgacgtgcagcaacgtctgtcagctgaattggcaacagcaaacgctgataaagaagcaactactgaattgttgtctgacttaacagaaaagttgactgacttgaatgaacgtattaacgtggcggaggggatgcttgtccaagcgcaagaagcccaaactgatgccatgtcgacgttaagcaagttaagtggtcgtcaaggagaattgcgtgcggccattcaaaacggcgaacgtgcgttggaagaaacgtatgacacatcatttgagtttgctaaggctgaaatgtctgacatgccaattgatagcatccgcacgcaattgaagttgttgaagcaaggtttggctgaaatcggtaatgttaatttgaacgctatcgaagagtatgctgaagttaaggagcgttatgacttcttgacgcaacaacaaactgatttgattgatgcacaagataatcttcgtcaaacgatgtcagagatggatgaagaagttgagacacgcttcaaggaaacctttgatgcgattgcaacccacttctcagaaatcttcgtgaagatgtttggcggtggtcaagctaagctcgaactcactgacccagaacacttgttaacaacaggggttgatattaaggcgcaaccgcctggcaagaagttccagcaaatgagcctgttatctggtggtgaaaaggcactgacagcgattagtttgctgtttgcgatccttgaagtacgtccggtaccgtttgcggttttggatgaaacggaagcagcgcttgatgaagccaatgttgaccgttttgcacgttatttgcatgaagttaatgatcgtacccaatttattgtgattactcaccgtaagggtacgatgacgaatgccgatgtgctatatggtgttactatgcaagaaccgggtgtctcaacgatggtatcggttaacttgcaagagctagataatacgctagcagaaaattaatggggaaatgaacaatgggattgtttgatttttttaagaaaaagcctgaaaccccaactgtcaaagttgaagtgttgtacccaaacacttgggaaaatggggaagcaccagctgagccaacatcactagcggctgaagtgttgcaaccaactgccggtcaagcggttgagattgtgttgccaacgcacgaggaggttgcgccagttgtgacggaaccggtagctgaaacggaaacggttgaaacggttgcagaacctgaagaagcggttgttgcagagtctgaagcaccagttgctgaagtaacttctgaaaccaacttggacgagggattgacgaagacgcgcaagacttggtcagaacgttggaacgcctttatggctaacttccgttcagttgacgaagatttcttcgaagacttggaagagacgctaatcggggccgacgttggtgctgccacagcattgcaattgacggatgaattgcgtgatgaagtgaagctacaaaatgcgaagagcaaggctgaaatttcacgtgtgattgtcgataagctagttgaacactatcgttcacaaggtgtgaatgaagatgcgtcaatgcactttgcgcctgaaggaccaacggttattttgttcgttggtgtgaatggtgttggtaagacgacgacgattggtaagatgtctgcccgctacaaggcagaaggtaagaaggtattgttggccgctgcggacacgttccgtgcgggtgcaacacaacaattgcaagcctggggtgagcgtaacgatattctagttgttgctggtgaaccaaatgctgatccggcctcagttgtgtatgacggtgtgaagactgctattgagacgaatgccgatgtgctattcgttgatacagctggtcgtttgcaaaacaacgtgaacttgatgcaagagttggctaagatgaagcgtattatcacacgtgagttgccaaacgagccccaagaagttttgttggctttggatgcgacaaccgggcaaaacgctttgcaacaagcccgcttgttcaaggattcaactgacgtgacgggaattgttttgactaagcttgatggtactgccaagggtggtattatcttgccaattcgaaacgaattgcacttgccagttaagtgggtcggacttggtgaacaggtcggtgacttgcaaccatttgacgccgatgattttgcgaagagtttgtttggtagtttgttggaggatgagaagtaatggagctagaaaaaaacacgcgcttgaatgccttgtttgatttctatcaaccattgctgacgtctaagcaaaacgactatttgcagttgtactacgctgacgattattcacttggtgagattgctgaagaatttgaggtctcacgccaagccgtgtatgataatctaaagcgcagcacacaattgctagaagattatgaagccaagttacacttgtttgctgattatcttcagcgccaagctgcggccgagcaattaaacgactatattcaagaaaagtatcccaatgacgctgagctaactcgtttagctgaacgtttggtgacattagaagaggagtaaaccatggcctttgaaggtttgacggagcgattgcaaaacgccttgagcggattgcgtcgcaagggaaaggtgacagatgcggacttgcgcgagacaatgcgcgagattcgtctagcattgttggaagccgacgttaacttcacggttgttaaggactttgttcgtaacgttcgtgaaaaggcggctggtgctaaggtgttggaaggattgaatcctgcccaacaaattgtttcgattgttaatgatgaattgactgccatgatgggtgagtcagatgtgcctttgaacgtatctgacaagattccaacggttatcatgatggttggtttgcaaggagctggtaagacgactacggccggaaagctagctttgaagttgaagaacgaaaagaacgcacgtccattgatgattgcggccgacgtttaccgtcctgctgccattgatcaattgaagacgttgggtgagcaaattgatgtccctgtttttgagatgggaacagacgctgatccacgtgacatcgtgcgccaaggtttggccaaggcggctgaattgaagtcagattatgtctttattgacgcggctggtcgtttgcaaatcgacgaagcgttgatgcaagagttggctgacgttaaggaaatcgccaacccagatgaaatcttgttggttgtcgatgccatgactggacaaaacgcggtggagacggctgaaggctttaacgagcgtttggacgttaccggtgttgttttgactaagttggatggtgacacacgtggtggagcggctttgtcaattcgtgccgttacgggtaagcccattaagttcgtcggacaaggtgagaagatggcagatttggatgtcttctatccagatcgtatggccagccgtatccttggtatgggtgacttgttgacgttgattgaaaaggcccaaaaggactttgacgaaaagcaagctgccgagacaatggaaaagatgaagtcaaacacgtttgactttaacgatttcattgcccaaatggatcaagtgcaaaacatgggaccaatcgaagacttgttgaagatgattccaggtatggctaacaatccagctttggccaacgtgaaggttgaccctaaggatatggcgcacattaaggccattgtgatgtcaatgacacctgctgagcgtgagaacccagatttgttgaacccatcacgtcgtcgtcgtttggcggctggtgctggacgtccagttgttgaagttaaccgtttgatcaagcaattcaacgaaatgaagaagatgatgagcggtatgatgaacggtaacatggccggcatggaacaaatgatgggtgccatgggtggcggcatgccaggaatgccaggtggaatgcctggtatgggcggtggcctaaagggcaagatggcaaacatggcgatgaagcaaatggcccgtcgtattcaaaagaataagaagaagcgtcgttaattatgggtcgttatttactagatgataagacgaaggctatgaacgttaagtaccaatctgaaaagaagggtgccgtttcaaaggctgataaggtagctatgttgcgtgagcaaatgctagctaagaagaataagaagtaatcaattaggtcagagattctttctctggccttttttgtcggtgttttgttcggagtttatttacagtttcatcctgaaaatatcgcacctgtcagcgatactataaacatcgatcacccgctagcgacgaagcaaactcatgcgcatgggtttgtttcacttattgtgatcacaatttgcaaaaggctcaattgtcgcgacggtgataatcgggtcttttgttttaaagagatttatcagcaatcaacgatacttttggtacggattgttggtaagtcttttattttttgaaaacgttttcaaaaattcataaattaagtgatttacattaacgctttagaaaagcaatcgtcgttatctagttgtaaactaactgtaacaaataaagttaggacatatctagggggaatacgattatggaaacacgtgtcacacacgcacgacgcacgcgaacgattgctgcgacgttggtcttgttgtttggtttgttgcttttcgctggtgttgtaacagcgttggaaacaactgcgattgctgcccaacaaagtaatgatttagttacatctgaagtattaacgactatgtcgacctcagaagtaacggctgaaccagttgttgcaaaataagaaagttaggtaagctcaggcgactgagtttatttttttgatatggtacgtgcgtatgaaacaaaagatgcaactgaaagaagcaagcaagtggtttagtatgggactgctgttggggatggtaggtgttgggctgaccattggtggaatagaaatgaaagaacgccgttcagaagcccaacgcgtaactatcgatcatgatgaaaaaaaggcattgccaattaaggtaggatcggcacaaccgcttaagctagctgatacgacggttaaagttgacccacatgtccaacatttaacaatggaacagcgtattgcgctgatgatgctatctgctggcgcaactgtcgccgatgagaccaagctatatgcttcaccacaaggaaacggtgagacgtggctgcttgatgctgatgggaataaattaattgtcttaaagtttattgacggcacaaagcgaacggtaacctttatggatggtcgaaccgttgatgtcgacctgaaccaagcgtatgcatcgttacatgcgacgcaagcatatcgtgatttgacggataacatcattgttgaataactgaaagtggctattttctatttaaattttgtacagattgcgctaaaatattaacttattgcaagtgaagtagcgccttgagaccgctaaaacgttgatttttgaagaaatttcaacgtgtaaaggaaaaacactttacaggcactcaagaaactgttattataattcttgtagaaaaacaactggaggaaaataaacatggctgttaagattcgtttgaagcgcatgggttcaaagaagcgcccattctaccgtgtggtagttgctgactcacgttcaccacgtgatggtcgattcatcgaaactgttggtacgtacaacccattggttgagcctgccgaagttaagttgaacgaagaattggtattgtcatggttgaacaacggtgctcaaccatcagatactgttaagaacttgttgtctaacgcaggcatcatgaagaagttccacgaagctaagttctcaaagtaatttgagggttcagttttgaacttcttaaaagagctgatccgtttgggtcagctcttttttcatatcttaaaaatgtttggcagcctctgttcaggctctgttatttccggtaaactatttagtgtaactaaaaaaatatctttttggagataatatcaggggagaagtatgggtaaacagattaaggttattgcttgggcagttgtggtagtattgctagccatcgttggcggattcaagttttttgaacgcgttgataatggtaacgttggtatccgttatgccatttcaggtggtgtacgtgataaggcgctctcacaaggaattcgctttgttggattggactatgtgacccagtatccaattaagacgcaatctattaagcaaaaggttgcggttgccacttctgatggtaagaagacggatgtgaagattagttattcttaccacgttgatccatctaaggcagtttcaatctacaagaagtttgggtcagctgacattcacaccattgaaactggctggttggcacaaaagttgcaaaaggcagcgcgtgaatcaatggcacaatttacattgttggaagtcgttggaactgattcaacgaaggcacaagcaggtatcttgaagggcttccaaaagtcggcagaaccttatggctttgtgattgaagatttgtcatttggaacgccatcaattgatgagcaaacgcaaaagtcaattgatgatattatcaaggctggccaagacaacaagaaggctgaattggaagctaagacaaaggaaacacaagctaaggctgatgctgacgctaagattacagcagcgaacgccgaagctgaagctaacaacaagattaatgcctcaatcaacgaccaaacgattgcttacatggaggcacaagcccgcttgaagcatggttgggtaacggtgcaaacaaacgatgccatggttgatgcaacaggtaactaacgatgggattctttatttttagaattattttagcgattgcgattattgcagcagtttacatgggatacaaagcctacgaagcgtacaagcgtgatcaaaaacaacaagataagcaccatcacgaagacgatatatagttaaagccctgatgattttgcggtcatcagggcttttgtttaccattcagttgtcgtgtcgttaaacgtatcgatgtgcaagccgtcttcgtcgagttgccacgtcgtaacggaaccgttttccggttcaacacctttgtagtcaggaccagcaaaacggttggttaggttaatcaacaagataccgtgaacaaccagcagaacattatcgccgtctttgtgggtttgtaacagggtgtcgagtccgttgttaatacgtgtccaaaacatattcgcatcctcggcgtcaccagccggatcagcctcgcggaatgcgtccatcagctcattgctgtccatgctttgaatcaagtcaccgtatgtcgtatcagccggtaaaccaagtacgttagctaactcatgaccagcttcaacaccagatagcccgtcgaaagaaccgaaaaattgttcgcggaaatcaggtagttcaaccaaatcttggctgtcgccagttagattggcatccatcacataacgagccgtttgtgccgcgcgggctaggtctgaagagtagacgccgtcaaagtggacgtgacgcagacgttcaccggctgcttgaccgtccgcaatccctttttccgttagcggtgcgttggtccagccttgcatacgacgatacttgtttagataagtttggccgtgtcgaaccatatagacatttatgctcataaaaatttatcccccgtgtatatgcctttagtttagcaaagatggtcgaataattcttgtttagttgggataaaaattaaggtatactagaagttagcaaattaaccgaaaactttactgtaatgggtaaagatgaaactagtattaagaggaagactgatattatggctttgtacaaagtaggaacaatcgttaatacacacggtatccgtggtgaagtccgtgtgattgcaacgactgactttcctgaagagcgtttccaaaagggcagcaagttaatcatcgatggcaagacgccagttgaagttgagattgcaacggttcgtaaccacaagcaattcgtgttgttgtcattcaaggatttgcaaaacattaacttggttgagcaatacaagacgcacgatttgatggtgcctgaagaagcactgcaagacttggcagatgatgaatactactaccacgaaatcgtcggtttggatgtcgtagacaatgcgactggtaagacgcttggtaaggtagcagaaatcatggaattgccagccaacgatgtttgggtcgtgaaggccaaggggcaagatgatattttcttgccatacattgaaaacgttgtaacggaaattgatcttgatgcaggtgttgctaaggtcaacatgcttgaggaaatttaatcatgcgcattgatgttttaagtttattcccaaatatgtttacaccaatgcgtgaatcaatcatcggtaagaccattgaacgtggcttggtagattttaaggtgacggacttccgtgactatactgataacaagcacaacaaggttgatgacgaaatttatggtggtggccaaggcatgttgttgatgccacaacctattttcgacgcaatggatgccattgagtcagaagcaggttcacgtggtcgtgttattttgatggacccagctggtaagacgttcaaccaagagatggctgaagaacttgctaaggaagatcacttgacgtttattgcaggtcactacgaagggtatgacgagcgtattcgcgatttggtaaccgacgaaatttcacttggtgactttgtactaactggtggtgaacttggtgcgatggtggtcatcgatgccacggttcgtttgttggatgaagctttgggtgatcaaatgtcagccgttgacgattcattctcaactggcttgcttgagtatccacaatacacgcgtcctgctgatttccgtgggatgaaggtacctgatgtgttgatgtcaggccaccacgctaacattgcgaagtggaagaagaaggaggccttgcgccgtacgtatcttcgtcgcccagatttgcttgaaaactatgacttcacaaaggaagagcgtcaattgctcaacgaagtgaaggatgaagaagcgaataagtaggattaatacttgttaaaggacaccagagatgatattattatttatggtgttttattcaccaaaaaataaacccgataatccgctggccaggtggtgaaatgattgtcgactaggagatttgattatgcgtcaaaacgctttgctagaaaagttggttgctgatcaattgcgtacggacattcctgagttccgtgccggtgattcagttcgtgtccacgctcgaatcgttgaaggttcacgtgagcgtgtgcaaatgttcgaaggtgttgttatcaagcgtaagggtactggcatccaagctacgtacactgttcgtaagatttctaacggtgttggtgtggagcgtacgttcccattgcactcaccacgtgttgacaagatcgaagtgactcgtcacggtcgtgtacgtcgcgctaagttgtattacttgcgtgcattgcacggtaaggctgctcgtatccgcgaagcacgccgtgcctaatgacattacgtcattaagcaataagaaagctgattccgtttggaatcagctttttttgttgcatttcacgtatatataattagtaaaacgtttaatgataaaaatataattttattagggttaatttcataatttgttatgaaaaaggcgtgaaatagtgtaaactataacgagtgatattttctataaggattgggttttcatataatgagcgagcaaaaaacaaagaagcaaaagcgaagcattgggcttggctggcgtattttgttagggctggttgtgggaattattttgggtgtgattttctaccaaaataagactgcgattacggccatgcaaaatatcggatcaatgtttattggattgattcaaatgattgtgttgccaattgtgttgtctagtttgacggcgggtattgccaagatgggtgatatgcacaaactaggccgtatcggtggtaagacgattatctacttcgaagtgttgtctacgttggcgattgtcattggtttgttggctggaaacattttccaaccaggtgcccatgttgatattcacaacttgcaagcatcaaacattagttcatacttgagctccgctaaggaagctggtgaacacggtgtttgggcaacgttgatggatattattccaacgaacttcttcggctcattggctgaagacaagatgttgcaagttatcttcttcgctgtattctttggtttgggtacagcagccatcggtcctaagggtcaaattattattgacttcttggacgctgttgccgaggtgatgtttaaggtaaccaactgggttatgcaagttgcgccaattggtgttggtgccttgatcggtgcaacggttgcccaaatgggtgttagctcattggggtcacttggcttctttatcttcatcgcctacgtcacgatgattttcttcatcttggttgtcttgggtggtgtcttacacttcttcggtgtcaacatttggacattgatcaaggtgttgaaggaagaaattattttggcctttacgacggcatcttcagaagcaactttgccacgtatcgtgtcaaagatggagaagtttggtgttagccaaggtgttgtgtcattcgttgtgccaactggctacacgtttaacttggatggatctgccatttaccaagcgctgggtgcgttgtttatggcccaagcttacggcattcacttgtctattgaacaccaattgacgttgttggttgtgttgatgattacctcaaagggaatggctggtgtgccaggagcatcattcgtagtgctgttggcaactgtttcaactattggtgtgccagtacaaggtttggcctttatcgctggtattgatcgtttggttgacatgggtcgtacagtggttaacgttgttggtaattcagctgcatcaatcgttatttcaaagtcagaaaaggactttgacgaagaaaagagcttgcgttatgtcgcagcaatgaacgactaaaagtgatgacggaatcttgctaatgcaaggttccgttttttggtagtttgaagtgtttcaatatgttgtcaaacctgacatctagtgtggtctaaccatgaaaactgtgtgataatatagggacgattaaaaaacgacgtaaggaggcggcacttgtgaacattgcacgtgtacgtgagtatggactaaaggcaattgtcttcgtaacagcatcggttttggttgctatttcgatgaataatttctttatcccaaataatatcttctccggcggatttaacggagttgcgcagctgcttagtttgttctttaaagcagtgtttggtatcaatgttgaagttggagccattatcatggctgttaatattccactagcaattgccggttggatttacgctggacgagaatttacgattctatcatttttgaataacttctttgcgtcgttcatgcaaattatgttgccgaagcaaacgctggttgcacatgagccaattttggctggtttgtttggggggctgctactaggggtggctattggtatcacgtttaagttgggattctcaacgggtggtatggatattgtggcgatgattgtccaaaagacgactggtaagtcaattgggttcatcaacttgtttattaacggatttgttgttgtcatcgctggttcatttattggttggcaaaacgcgatgtacacgattattggtatctatgcgacgtcggttgcggttgattcaattcacacgcgtcaccaaaagctgacggctttcattgttacgaagcgttctgatgaagttgttaaggcacttcaagaagatttgattcgcggtattacgattttgccttcagtgggtgcgtacacacgtgaaccaaacacgacgttgatgatggtattgtcacgttatgaactaactgagatggagcgtttgacgaagtcagttgatccagatgcgtttattaatattgttaatacagttaacgtctcaagcaatttctggaatgaagatttgcagagccaaattcgccgtgagcgactagcggcacaagcacaaattaccgaggcattgaatttggatgctgaggctgataagctaatgaataagtagaaaagaaagaggacataataatgccatttgtacacgtagaattggttgaaggtcgttcagacgaacaattgaagggaatgatggctgacatcactgcagctgttgaaaagaacactggggcaccacgtgaggccatcaaggttatcgttaatgaaatgcgcgctgaccgtttcatggacggcggtactttgcgttctgaaaagtaattgcgtacaataagagaggtggttttaaaaaccatctctctttttttacgcaatggggatgcgtaagtaataaacgaattattaggagcttttatggctgatcaatttatcatggcccttgaccaagggactacaagcacgcgtgccattttattcgatgaaacaggtacggccattgcaaccgcacaaaaagagttgccacaaatatttaagcaaccaggctgggttgaacataatgcaatgactatctgggatgatgcccgtcaagtgatggctgaagtcgtcattaaggctaatgtgccaccttataaggtcgctggtatcggtgtcacgaatcaacgtgaaacaacggtaatttgggatcgcctaactggtgaaccaattgccccagcagttgtttggcaatcaaagcagagtgacgcaattgcagaacaacttaagacggacggtttgacggactgggtttacgagaagacaggtctttggattgatgcctacttctcagcaacaaagattatgtggttgcttgataatgtgccaggcgctcgtgagcgtgcagaacgtggtgagttgttgttcggtacgattgatagctggctgctatataagctgactaatggtgcagtccacgcaactgattattcaaatgcgtcacgtacgatgctgttcaacatttacaccttgtcatgggatcaagaattgttggacaagtttaatattccagcaagtatgttgcctgacgtcaaggattcatctggtgtatttggttatacggcggattatgcattctttggcattcaagtgccaattgctggaattgccggtgatcaacaagctgctttgtttggccacaaggcctttgaagctggagacgtgaagaatacgtttggaacagggtcattcattgtgatgaataccggtgatgatatcgcaacgtcaaagaatggcttgttgacgacaattggctatggcttgaacggtaaggtgacctacgctttggaagggtcagtctttattgccggtgccgccattcaatggcttcgtgatggcttgcagcttatcaagagtgccaaggagacggctgatttggccgaggtggctcgtgaacaacaccctgaaccaatttaccttgtgccggcttttagtggcctaggagcaccttattgggaccagaatgttcgtggtgcgatgttcggcctgacgcgtgcaacgacaaagggtgacgtcgtgcgtgcgacattggaatcattggcttaccaaacacgtgatgtgttggatgctatgcaaactgataccggtttgacggttggtagtttggtgattgacggtggggcagcagcgaataactacttgcaacaattccaagcggacttgattaacgtgccagttcgccgtccaaagcaacttgaaacaacggcccttggtgccgcataccttgctggtttgggtgttggttattgggaatcaatggacgcgctaccagaacaagccgccactgaaatgaaagagccaatcgctgaacgccaaaatgaaatggctgaggcttattcagggtggcaacgcgcagtgaaagccgcacgtatgttccctttggactaggctgaatgcaatgtaaacttgataagtttgtaaataaataattgcaaagtatatgagcgttgcaatacaaatgaaataatgaaaatgacgattaagacgaactgcctgtgacacaggtgacgtttagatcgtcatttttgtttgatttcgtgcacatttgcctgtgacacttttttgattggcgtgatttttctaaattttaccaaaacatagattttgtatttgacatcgaaaattgtgaatatttctatcagaacgtttgttcccctaatttttaaagtaaaagtagggtattatagagtagtcgagatattatttaaaactttcttaacactttttctgtagacgagagtatataaatcctgagaggagtagttcatatgggacaagtatcaactaaagcaatcgttgctggtgttgctggtgcgctaggagttgtcgcaacaacgcaagtgccaatggtacaagcagcggttgatcaattggcaaacatcacaactgattcagaacatgttgcgacgacacatgaggcgtcagctgttttgaccaatgatgataagcaagtaacgacgaagtcagatgttgtgcgcgataaggtgttggcaacatcaccaaagatttctttgcgtgcagttactgatgttgcaccagtagcgtcagcaactgataaggtgggggatatcgagttgctagctaactcggaggctgtatcaccttcatcagcgacgaccgtatacacgccagcggcgtcttcagtagctgaaagcgcagcggtgacgccagctgagcaagctgtcgtatcagaagcgaaggcaacgccagagaagccagctgacacaatcacgtatacgattaaggatggtgacacgcttggtcaactagctgcgcaatacggggtttcagtggaggctattcaagccttgaacccaggtgttgatgtcacaatgttgcaaattggtcaaactgtctttattccagcagcaggggcaacgattgcaacgccagtttctgatgtggcatcagaagttgctagtgtggcgccatcagaaacgccagcagtggctgattcttctgttgcttcacaagtaccagttgcatcagaggcgccagttgtttcagaagcaccggccgtttcagagacgacaactgaatcatcagttgtggcatcagaagcgcctgttgaggcaccggcaacctctgcaacgccagcacaaccttcagaggcgccagtctcagaagcgtcagttgcgtcagaagcaccagcttctgattacgtgaatgcaccggcagctgttcaaggcagcttgacggcggcacaacgtacggcaattgttaacgcagcattgaagtacgctggtcaagatattccatacgtatggggtgggaagacaccggctggatttgattgctctggcttggctgcttgggtatttaatgatgcggggctaacgcttccttcatatacggttacggaagagtcatacgtctcaacgactgacgttaagacgccagctgacgtaatggcggttgcccaaccaggtgacttgttgttctggggtggtcacggtgcttcatggcacgttgcaatttatattggtaacggtcaatatgtggcagcaccagcaccaggttacaatgtccgtgtggaaaatgtgacaactggattcatgcctgactttgttggatcatataacgcataatattaaaaacacagatgattagtcgtctgtgtttttttatgcacaaaaaagccgttagcgcagtgctaacggctttttcaatcgttacttaacagttgcatcaagttcagccaaacgggcgtcaatcgtctctaggacggcttgacggttggcttcatcctcaaggtcaaattgttgcaagtcgattttaatctttggtgaagcatcatattcttcataccacttttggtatgcgctccacatcttgaagtagtagctacgcaattcgtcattatcttcgaattgttcgtagtcacgaccacgcttcttgatacggtacaagatcgtgtcaaagtcagcatcggcgaagaccatcaagtcaggacgtcccttttgcatcgtttgaatttcggccatcatgttgttcaacaaagtcatgtaaacatcaagttcggcgtctgaaatgttaccttcgcggtggttctcttgtgtgaagagggcatcttcataaattgaacgatcaaggacattgttgtcgtcggtcaaggccttcttaatcatcgcaaatcgcttgttcaagaagtaaatttgcaataggaaaccgtattgctttggatcagcgtagtataggggcaaaaccgggttttcgccaactggctcaaagaatgcttgcgtccccaaatgctttgcaatcaaatcagtcaatgtcgtcttaccaacaccaatcatacctgccgtgataatcaccatggtagtccttcttccttcagaattttgtttcaagaatcgtcaactacagcataagctgcgttgaataactgataactatcttagccaaaatatgaatttaattcaacgtcttgacaaataaaaaaagaatgccaagtagggataaaccccaccgtttaggcattcctcagaaagtgaataaaatatgtctattttatgtcgaagatatcgttcgggtttagtccttcttagcggccaaagcgtcacggatttcttgcaaaacgccaagctctgtttcgatcgttgcttcttcctcttcttcgacttcctttgacgtcaatgcttgtgccttacggatagccttcaaaatcaagaagaccgcaaaactagtcaacaagaatgtgattaacgttgagatgaaagcaccaatcttgatgtcggcagatcccacgtgccagacgatggctgaaaatgagattgaccccgtgacaataccaacaagtggcataatcaagtcatcaacaactgatttaacaacagtttggaaagcagcacccatgatgaaggcgacagctaggtccatgacgtttccacgcataataaagtcgcggaactcattaataaaattacgcatctgaatactctcctataatccttttgttactctgattataactgtttcagaaatgtgacagcaagcaaaagcatttgaaaaacaaagtaaaaatcaaataattattcatgaattggtaataagcggttgcctttatttgttacaatagggataaacacacgggggataatacaaatggtatataaaatgctagtttcagacttagatgaaacattgttaaatgatgatggaaccgtccacgaagccaatttggcggcaattaagcaagctgtggcggcgggatttaagtttgtgcccaacactggtcgttctttcaagtcagttcaagagctgttaaagactttggggctatatgatcaagctgggcaatatgttatctcatacaatggggcagccattgttgaaaataaagacaaccaagtcttgttgacgcgtggtatggatcttgcgcttgctgagaagatttttaaggccggtttggtgaacgagacggtcgatgtgcacgtttacacggtcgacacactattcatctacaacatctcgccaactgataagcaatacatggctgagcgtggtgtgccatatgaactaatggcgacggatgacttggcattcttggctaatgagcaaccggttatgaaggtaatctttgaacaccctgatgaggctgtgcgcgaacaaattcgtgatgcagttcttgcagcggttggtgccgaccaagttgaagccacattctcatcttcacgttatgttgaatttaacaagaagggtgttgataagggatcagcatcattgctgttgggtgagaagctcggtattgcacgtgatgaaattattgccgctggtgataataataatgatttgaagatgctgactgctgtgggactaggtgtcagtgttgcgaatggtattccagcaattaaggaagctgctgatgttgtgacgacgaagacaaacaacgaaggtgcgattgcggaaattcttgaaaaatacgtactgtaaggataggtaaataatgggattagcgttgcagattggcacgagtataattacggtgctactttttatcgggctggcagcagtcgcgaaaataatggcgtggccactctgggtgtcaatcccagtattcttgctcctattcgtcttgatgacagttgtcatgtcatggttgacggtaacgttgcgattaaaggcggaaaagaaggaggaagaggctaatcatgactaaagaacataactggattggcgatattatcacgggtttgatttggattatcgtaggtgttctgttggactttgcgattcaggtagcggggatgtacagcgcacgtagcatggctagcttgctacatgtttcgccaaatagtgccggtccgattataacgatgctattgtttttggcggtctttacgacaattgcagtattagttgtgggttacggtgttcgtcagcgatcacctaagatgggcttacacaaatttaacgggcataaagccaattggatttggcgtgggtacttgatgattattggtgctggcgtggtgagcgtgctcctgcaatatgttttcgcaggcggtgtacaaaccgcgacaaatcaacaggcgcttgaaaaaatggctagcgcgggtggtgcaaacttggtgtttgtcatcttgttagctgttgtcgtggcaccgctagtggaggaattgatcttccgtggcatcgttctgaactacttctttaaggatggaccatggtggctgaacgtcgtgatttcaggtgtgctgttcgggtatttccacgtcttccaagatttccaaattttcgcccttattcaatattcactgatgggtgtcgctttagctgtggtttataagaagacgaaacaaattcaatattcgatgatgacgcacatgcttaataatgccattgcgtcattgtcattaatctcaatggcgttgcattaatcgttacaccgtgtgtttcgaaaatgcaacataaaaggtgttatgcaagctccctttatcagtgcatattcgcttgtttttagataaactaatacttgtaattagtaagtatgcgaatataaataagcacggaaagaggatttggcacatggcattcatggttaacttgaaggaagtttacatcgacccagcagacgttgaggcttacttgacggaaatcgctaacctttggcaaggtgaagaagacaactacgagaacgaagctgtaacgtcacaaattatggactttgtttacaacaaggacacggatgacgcacactttacgtttgaaaaggccgacaacgagttggttatgcgtaagggtaaggacttttaccaattgatccgccaaattcgtacgaaggttgattcagaagtgcctgctgatgttacaccattggtcgcacaaacaatcaaccaaaacgttcaacaaaacttgcgtatgcgtatgcaaatgcaatcaggaccttttgcacaaacgacgtcacgcggttacatcgcccgtcaacaatcagaaggtaacaactaatagaagaggggccggcatattgccggtcctttttttgaccaataaagctgaaattattctaagattaaatcaaaagatgaggtgatgaagatgtatattgaacttgatgactacgcaacgaaccgtgtgatgaacaactttgatcccgagacccaagtgattttgttcgcggtggaagatggtattagcccatacaatgacccactagatgtcacgatggaaacaagctttacgattaacatcgttaacaaggatgtcccataccaacgctggtttgatatgccattggaaaccagcttgggtacttggtacatcaagagcacgtcaaagtctttgctagctgaaaacatgcaacttcgtaagaagaataactttggtggtttggcacttgattcaaatgaacaaggccgtttggtcgagagtgtggctgttaaggatgcgactggcgttgatattgccgcatacgatgctaatcaaaacggaccagaatataagtaaagcggatagttttgacgggtatttttgatataaattggttataatgtttttaatctaattggggaataatgtggaggaaaacataatgactgaatacttacatgtcgcctttggttcaaaggcagtgttgcaaaatgtgcgtaacgaacacttggatcacaagttgttgatgatggttgatgacgaagataagtctcgctatcagttgcttgaaaagacaacgaataagaagtcgatttttgcaatgccaacgacgtatgaaattcttgctagtcgtggggaaacgagtgatattcgtggctggatgaattttacgttcatcacattgaatgatgcagaacgtgataacttcattcgtcgttataacgcatatgaagaggggatggatgagcacggctttatcagctcattcttgttgcaacgtaacgataatcaacaccaaattgtgatgctatcaacgtggaacatgaagtctgactgggagctatggcatgccaagaatgacttcccactccgtcaatatgagagttcaaacagtttgtacggtttgatgcgtaagcaatacagctttgccgcgttctcaaagcaaaatatgtaaataatctattcaataacaggataatttgatatagttatactgttattgatatgccgccgtggcggaactggcagacgcgcaccgttcaggtcggtgtgagagcaatctcgtgcaggttcgattcctgtcggcggcataaagaaaaggatgatcctcataatcgagaatcatccttttttcgtaaattactttagcccttcagcatgcttactggttaacttgaagtcgcctgatgtggttttcgcaaaagtcagcgtcacagtttttgttttattcccattacgccaaattgccacgcgtgtcgttggggatgcggacgtgtcatcttcttgttcgtttggcttgccgagcatgtcacgaatgtcctgataggtgtcaccaccacggccggttttgctatcaccaacggtcagattatcaaagtcggcgcgaacccaatcaaatccatccgcctgcttatcgttaatgtgcacagacaaatgcttgctttcgtggctgattgaattgccatagtagttttggttaatacttactaagccaatgcctaataagctcaataatgccgtaataattggtaatgtcttatcgccatgtcgatctagccatagagcgaatagggcgaatgcaaaagccagaatatcgaccacgagcccaacgtgattgatcacgggaatccatgataacaagatgccaatgaacgcaatcgttaaggctgcaatttttgttttgaagtaaggttgttttcctgtcatataagttaagtctccttttttcaaaactttaccgtatttattagttgttgactgacgctaattttttaaaacatgaattggcgattggacaaagtttgtttcagactatttgtttgatatgatggagaaaagaatcgcgagggtgagttatgaatcgaaaaattattgaaaaaggttacgccatcatccttgatttggcgatgttggtgctgggtattgtgatgattgggttctttgtgaaagaactctgggaattagtgacaatgttgatgcatgttgatttagcaacggatttctttggtgtagcggaacgcatcttggaaacattcttgttcttcgagtttgtcgtgctaacacgtgagtactttatccaagatcgcatttctctgcagaactttatgtatattgggattactgcattgctccgtaatctattggtatatcacgccgacacgattggcattttgattcaagcagctgcgattgcaattttgattctagtgttggttgtttaccgttggtcacgtcgctatctagcagatttagcgcaccgtgaagagcgtgaagagttggtgtttgccgaagagcatcccgatgtaacgaagtaggtcaatgacctgctttttttctaccatgacaagagttgtcgattgcacgtataatagaaataggtgcattcgagaggataagaaaaatgctggatttagataaaattccaaaaaagacattaaggcgcagtaagtggctaaccgttctgatgctgttttttgcgattgggtttacgccagcctatctagatagtatttcaaatgtgttggtgttcgcattcctggttagtctggttactaagccaacctttgtatttcgttggctattaccattaatgctaatcggtgttgcctgggcgattccaggaattggctggccagtgcaacttttgctatcaggtgttgttctgggtgttcgtcaagtggtgtttacgccgatgaaacagaccaagcaacggattacgaccgcaaaacaaaaattaaccattaatactgataacctgtcaaagcgtgatgtcactgtgtttaaagcaacgttcaatcggacgctggccagtgttgatcatgtggaagaattgttgcagttgacaacgggattgcgtaaaattgcgattgagaccgatgtgatgcggtttgcgcgtggtattctgaaagaattagctgatgatccaacccaattaacagaagcagatgagtttgtttatacacatttgccgaacatggaacaaattctggtcacgtatcaagaaattgcaaaccatgaaatgattgatgagtcggacaaagcacacttgaaggcggcacgtgaagtgttgcgccaacttgctgaccaaattcaacaagactaccgtttaatcacgcgcgatgatttaaactcgcttcgcgatcaaattgatgtggcgaagcgaactatgggggataaaaaatgacagacgaagtaatgacaaaagagacggtgacgacacccgagttaacggatacgttgacgtctgaagagaaatcaaaggcgctgcaattggcccaaacattggatgttgcaacgagcgattcagtgttaacgtacggtgcagatgcacaaaagaacctctctgctttctcgcaaggtgtattggataaggttcaaaatcaagatgtaggcccaattggtgattcgttgactgagttgatgaatacattgaatcaagctagcccagatgatttgcgtccggaaaagcaaggattctttgcccgtatctttaatcgcgtccaaaagtcagtctatgaaatgacggctaagtaccaacaaattggtgcccaagttgataacgtggctgcgcgtttggatcgccacaaggattcattgttggctgataataagatgttggatggcttgttccaagaaaatctcgacttctttaaccaattgaacgtatatattggtggagcggagatgaagttgagcgatgtccgtcaacgcgaattgccagctgcccaagaaaaggctcgccaaacgaacaatcaacttgatgtgcaaaaggttcaagatttggtgcaatttgaacaacgtttggaaaagcgtaccaacgatttgaagttgactcgtcaaattgcgctacaacaagcaccacaaatccgattgatccaatcaacgaatcaagtgttggccgaaaagattcaagcatctgtttcaacggctattccattgtggaagaatcaagttgcgattgcgttgacgttgttgaagcaaaagaatgcggttatcgcacaacgcgctgtggctgatacgaccaatgaacttttgcgtgccaatgcagatatgcttcaccaaagtgcggttgaaacggctaaggaaaatgagcgtggtgttgtcgatattgagacacttcaagagacacaaaacagtttgattgcaacgattcaagagacgatgcaaatccaacgcgatggtcgcgctaagcgtgccgatgctgagcaacaaatgcaagtgatggagaatgagttgaaggaaaagttgttggggatggccgaagaacaaggccgaaaagacattaattaaaaaaattttttcgcggacattgtcatagatgtccgcgttttttatcacgataaattcacgttttgcgctgaaattgaggcggtatgaaataaatacaaaaggatgtgataactgtatcatttcgtgcatgaaccccattaaaataatagcgaacaagtaaactcggccttaatcattttttaataatttgtggtcgcgatagacgatttggttgtcatgtttctgtaatttgttcgcaatttttcgtaaaaatgggggttacatgttcacatattgacggttataataggagccataggtagcagtaacaccgtagaagccggaaggaggcacatatggtcacgttatatacatcacctagttgcacatcatgccgcaaagcgcgtgcatggctcgaagaaaacgccattccctatactgagcgtaatgtcttcaaagagccattgagccgagatgagattaagaacatcctccgcatgacggaagatgggaccgaagaaatcatctcaacacgatcaaagctatttgctgaattggatgtgaagctagatgacttgtcattgagtcaattaattgaaatgattcaacagcaacctgcgctattgaagcgcccattaatgattgatgaaaagcgtatgcaggttggttacaatgaggatgagattcgtcgcttcttgccacacgaggttcgtcaacaagaacttaagcgtgcaacgctcatggtggatttgtaacatcccaacccatacatagaaaatgaggctgctgggtgtggcctcttttttagcccaaattggtggttaaaacactaatatatcgactattaatcagtaactttgctataatggttaacaaagataagttcccgagtagcgggaagggaaggggtgcccaattatggaaatggaacgcattaatgaggatacaattcgagttgtggtgacaaacgacgatctcgcagaacgcagtatctcagtgatcgatttgctgggcaaccaggaagaaattgaacgtttcttctacaatatcttggaagaagttgatgttgagcacgattttgaaaacaatgaggctgtcactttccaagtattgccaaaccgaaatggcttggagttgtttatttcaaagaacattggcgataaggccatgatggatggcgttatcaactcaatgtttggaaatcgcgatgcgggcgacgtaaacgatgatgtttcagacagtttgttggagcaactactagataacgatggaacgaacgaccgtaagccaaaggctaacagtcgtgcccgtgctgaagaacaagctgctaaccaaatggttaatgcagctcgtgaattggcacgcgacaagcaaggtcgtcgccaagttatcttgaagtttaacgactttgaagcaatcatccaattcgctaagatgatgcaagaagaagttggtgattcaaagattattgaatacaacaaggcttactaccttgagttgtcatttgatgattcagtttcacaaactggtttgcaagacatcaccgcggtagcacgtgagtatggtgaagtcacgccggtagcagcagaagtgcttgcggaacacgggcgcacgatcttcgctgaaaacgcattgacgcaagtgttgtcatactttaactagaatatagtccaaaagcacacaatcgatttttcggttgtgtgcttttttgtcgtgcactccgaccgtgagggatgacaaaaaccaccaactaacaaatcaaattactcgaccatatacaaatcttataaattaaagaaaaagaattacgccataaacacggtttgttgcaaaagttttacaaatgaaaaggtgggcaatgtatcagatggtaatgtgcctcatttggcagtaaacgctttcattgttgccattttaggattgttcataaaaaaacttacaacttaatcacagactataaccgtcagaattcataatttagtctttttgttcgaaacttttacaaaatatatctgtaatatagttgttacaacgaagcagtaaattgtgtttgtaaacgcttacattaattatttgcgacgttgggttttcactttacgtaaccgaatagggggatattatgggactaaagttgaatgatgatttcctgtggggtggtgcgattgcagcacaccaagccgaaggtgcttggaacgtcggtggtaagggtgtctcaattgcagacatcttgactgctggtgctcacgggaagccacgtgaaatcacagatggtgtgatcgaggggttgaactatcctaaccatcacggtatctacttctatgatacttacaaggcggacttggctttgatggccgagatgggctttaaggcattccgtacgtcgattgcttggacgcgtatcttcccaaatggcgatgatgcaacaccaaacgaagaaggattgcaattctacgatgatatgtttgatgaaatgaatcgtcttggaattgagccagtaatcacattgaaccactttgaaatgccataccacttggtaacggaatacggtggttggtctgaccgtcgtttgatcgatttgttcgtaaagtatgctgaaacagttttcactcgttacaaggacaaggtgacttactggatgacgcacaacgaaatttcaaatcaagctaacttgactgacgaaacgatgggcgaattcatgatctggacgaattcaggtttgaagttcccagaaggtacaccagccaaagaaaagttggcagccatggttcaagctggtcactacgaattggtagccagtgccaaggctgttcaaatcggacatgcgattaaccctgatttcgtcatcggcggtatgttgaacgttgcgccattgtacccagcttcatcaaagccagcggacatgttggcggtgcaaaaggcccgtcaagcgcgtgactggttctcagatgttcacgttcgtggtgagtatccagcagaatttgaagcatttgcaaagcgtacaggaatgcgccctgatatcactgaagaagatcgcgaagcacttcgcgccggaacggttgattacttggcaatttcttattacaactcattcgtgattaaggcaacgtcagatgatgatgcagaattcgataacctacatggttatgaaattgtgcctaatccggaagtgcaagtttcagattggggttgggcaatcgacccacaaggtttgcgttacacgttgaacgaactgaacgacttgtacccaggtttgccaatcatgattgttgaaaacggctttggtgcttacgacgaagtagttgatggtaaggttcatgaccaataccgtattgattacttgaaggcgcacgttgctgaagttgaaaaggcagttgtgatggatggtatcccagtaatcggttacctatcatggggaccaattgacattgtgtcagctggaactggtgaaatgagtaagcgttacggctacatttacgttgatttggatgatatgggtgaaggttcaggcgaacgtttgcgcaaggattcatttgattggtataagcaagttatcgcctcacatggtgtggacttgtaatttaattctaaaaaatttttattaaaggtatttctggaggaaataattatggcagacaagacgattatgttggcatgtgcggcaggaatgtcaacttcaatgttggttaagcgtatgcaagatgcagctaaggctgaaggtaaggactacgagattttcgcaaagtcaacgtcagatatcgatgcagaattggcatcagatcacaagcctgacgtattgttgcttggacctcaagtcggttacttgaagaacgatgttaagaagaagactgacgaagctggtattccaatggatgttatcaacatgatggactacggcatgatgaagggtgacaaggttttggcagccgccgaagcaatgatgtaacacgatttgagcagtaacaaatgacggtttgactgactggtagcgtaacggccagtcagtcattggtatatgggggaataattatggatgacgcacgtatggaagtcgtaatgggcttgatcatgcacggtggaaacgctaagggacaagcataccaagcaattcaatttgcgaaggaacacaagtacgacgaagcggaagaagctttgaaggcagctaacgaagaattgaaggctgcccacgacgttcaaactgacatgttgactaaggaagcacaaggggagcacaccgaagttgacttgtacatggttcacggacaagaccacttgatgaacgcgattacgttccgtgacatggccgttgagttgattgaattgatgaagcgcgtcgatgctttggagggtaagtaatggtcaaaggctataaaatgcctgatgggttcctgtggggagcggcggttgcggctcaccaacttgaaggtgcctgggacgtagatgataaaggggtatcaatcgccgatgtcatgctggctggtaagcacggtgtggcacgtgaggtgacggatgaagtattgccagatggtaactatccaaaccaccgcggcattgatttttatcacacttacccagaagactttaagttgatgaaggaacttggtcttaaggcattccgtacttcaattgcttggacacgtatctatccaaatggtgatgatgtgttgcctagtgaagaaggattgcgttattacgacaagatgattgatgcgatgatcgaaaatgacatcgtgcctgtcttgacgttgagtcactttgaaatgccacttcacttggtaacagagtacggtgggttccgtaatcgccaagtgatcgacttcttcgtgaagtttgcggacacggttattcgtcgttacggcgaccgtgtcaagtattggatgacgtttaacgaaatcaacaaccaaacatcatggatggatccacacccaatgttgcaaaactcagggttgaaggattacagcgaagatgaggcgcaagagttgatgtatcaagcatcacactacgaattgttggcatcagctttggtaacgaagcgcgcccacgaaatcgcccgtgaaaagggttgcgagttgttggttggggacatgattgccatgaacccagtttatccagcgtcatcaaagccggaagatattttgatggctgaacgtgccatgcaaacccgttatttctggggtgatgttcacgccaacggaaagtatccaaactggttgaagaagttctgggcacacaagggcttcaagattgatatcacgccggaagatgaaaagattttggcggagaatacagtcgactatgtcgcattctcatactacatgtcatggacggtttcagatactggtgatgagtggttggaatacgatgaagaagcgaaccacggcgacaacccattcttgcaaaagtcagattggggttggcaaatcgatccagttggtgtccgttgggccatgaactggatgtgggatcgttggcaaaagccaatgtttatcgttgaaaacggctttggtgcctatgacaagttggaagaaaatggcgaagtccatgatgactaccgtattgcatacttccaaggtcacattgaatcaatggaacgcgccgttgtcttagacggtattccgttgattggatacttgccatggtcaggtattgatattgtgtcagcctcaacgggtgaaatgttgaagcgttatggcttcatctacgttgatttggatgacatgggtcaaggatcaggtaagcgttaccgcaaggattcattcaagtggtatcaacaagtaattgcctcaaacggagaggatttggggtaattctaaaagaggattggtgttaactatcggttttaaaaatttaactatattattcatagaatgaggataacaacatgaatacatttattaatgaaaagttgttgccgccggtaatgaagttcgttaacacgaaggcggttacagcgattaagaatggtatgctttacccaattccattcatcgttattggagctattttcttgattttgggacaattcccatatcaaccaatcgcagattacttggataagattggtctaggacctatcttcttgcaagcaaacaacgcatcatttggaatcatggctttgtttgccgtatttggaatcgcctactcatgggtacgtgatgaaggatacgaaggtgtgtcagccggtttgttggccgttgttgtcgacatcttgttgcaaccagacacaattaagtcagtaacgaacattgctgacccagacaagacgtcaactgcttggcaagtgtcaggtgttatcgacaaggcctggcttggtggtaaggggatgatcgttgccatcatcgttggtttccttgttggttggggttactcatggtttatgaagaagggcttcactatcaagttgcctgaacaagtgccagcaaacgttgcagcatcatttacggctttgttgccaggtgctgctatcgtaacaattgcaactgctgtttacggaatcttcaagttgggattcaacactactttggtagagtggatttacacgacgattcaaacgcctttgcaacacgcaactgacggacctttgggtgtcgtagttgttgccttcttgccagtgttcttgtggttcttcggtgtccacggtgcaaccatcgttggtggtatcatgacgccattgctattggctaacaacgccgacaacttggctttgtacaaggctggaaagttgacgttggagaacggtggtcacattgttacgcaagccttcatggaccaatttatcacggtaactggttcaggtatgacgattggtttggttgtgttcatgttggtacgcgccaagtcagttcaaatgaagacgttgggtaagttggaaatcgttcctgctttgttcaacatcaacgagccaattttgttcggtttgccattggttttgaacccattgctagccgtaccatttatcttgacgccgcttatctcaggattcgctacttactttgcaatttacttcggtatcatcccaccatttaacggaatgtatgttccttggacgacgccagccattatctctggtttgatcgttggtggatggcaaggtgctttgtggcaagctttgatgcttgtgatgactggatttacttacttgccattcgctcgtaagtacgacaaggtcttgcttgctgaagagcaaggtgatgctgagccatcagctgaagacattgaaaagttggaagaagcaactaactaatcaagttgattaagaattaagacttataggtcagatgacttataagtctttttcttttgcaaaattaaattggaaaatccgggatgccacaactctttattatcaggaggggtgtacatgtttatagcgaagaaaaaagaatcggtggatttagtgaaagctgacgtagcggtaaagacgacggtttatgtttgtcctggttgtgaaggtgaggttcaggtaaagcagggaacaattaatacaccccatttttcacacgtgacgttgcgggattgccaatccctggctgagggtgaatcgagtgatcatttattgggaaaactacaactagctgatttttttgaaagtatcggtggcactgttgaactagaagtttggctaccggaaatcaagcagcgaccagacttggtggtgacgtttgacaatgtgaaaattgcggttgaatttcaatgtgcaccaataacagcccagcgcgtatcagaacgaacgcgtgggtttgagtcgttggggatggatgtcgtttgggtgctaggtcccacttatcaacagaaaaagttgcaacaagccacttgggcgaagttcgcacggattcgtggtggacggttacaagtggcgttttggcatgctaaagggaaccgggttgaatggcgggaatggtggcgccttgattgtcgcaatcgcgtaaacgcgcatgatgcgggcgatgcgcatcgacagctattgaaattacaacaattggtgacgcaacgctcggaggtgtgtcgtcggtggcagaaacgcttgtatcggttaggcagaagtttggtcggcatgccttgggtttgccatcgacttaaggcaatgccaggcggtgcccgcacagcgcaatgggagttatcattggcggttttgctggcactagaggatgggccacagactaagacgcgattgcatgaggtgttatccaagcaagtctggtttgaatttggtgcgacgcaacaagatgatgcgattgtgctgtggctggatcgattgttggcggaatggggcgcgacaaacgtgattatgcaacgtgatgacatggtttggctgaagcgagtaacagaatggtacccggattatcagcataaattggccgtgttagattagcatctccgttaccacgtgcaacttcggaacccaaagtgtagaataacaactataataaacttgaaatgaggttagctattatggcaaaagaattaccattgcgcgaagagttgcctgagtcaatgacttgggatctatcaaccatctttgcctctgacgaagcgtgggaagatgccttcgcggatttggaagaccgtcttgaatcagctgagttctttgcagcaagtgtgacgaattctgcaacggatttgtacaacgctttgcaatacggcctaggcttgatgcaagatttggaaaagttgtatgtatatgcctcaatgaagtctgatcaagacacggctaacacttactaccaaggtttgaacaacatggccgagtctttggctgctcgtgtgtcagctgcgattgccttctttgacccagccgttttgagcttgtcagaagaagagttgtcagaattctttgcagctgagcctaagctacaagactacaagcactactttgatagcattttgacgcaacaaggtcacgtcttgccaactgagcaagagtcacttttggcagccgcgggtgatgtctttggggcatcacaacgtacatttggtgtgttggacaacgctgatatttcatttgaagccgttgaaaatgaaaacggtgaaatggaaacgttgtctaatggtgtttactcacgtttgttggagtcaacgaatcctgaaatccgcaagaatgctttccaaacgttctacaagtcatacatggctttggagaacacgtttgcctcattgattggtaaccatgttaagggacaaaactttatggcggctgcgcaccactacgacaatgcgcgtgaagctgcgttggctggtaaccacgtgcctgaagttgtttacgatacgttggttgcggaagtgaacaaggcattgccattgctccaccgttatgttggtttgcgtaagaagttgttaggcttggatgagttgcactcatacgatctttacacgccaattttgggtgaaccagattatgatatcgattatgaatcagccaaggctgaagcattgcaggcgttggcacctttgggggatgattatcttgatatcgtgaacaaggcctttgatagtcgttggattgatgtcattgaaaacaagggtaagcgttcaggtgcttattcaggtggatcatacgacacaaacccattcattttgttgaactgggtggataacttgaataacttgagcacgctggttcacgaaatgggtcactcagtgcactcatattacacgcgtcaaaaccaaccatatcactatggtgactacccaattttcttggctgagattgcctcaacgacgaacgagaacttgttgacggattacttgttgaagacggttgatgacaagaagctccgtgcttatatcttgaaccaatacttggatggcgttaagggcacggtcttccgtcaaacgcaatttgctgaatttgagcaatggatgcacgtaacggatgctgagggtacgcctttgacggctgacgttttggatgaagcgtatggtgagatgaaccgtcgttactatggtccagaattgacgtttgatgaagaaatcgcgcacgaatgggagcgtattccacacttctactacaacttctacgtcttccaatatgcaacaggctttgcagctgcaaccgcaatggcagacaagattttgactgaaggtgagccggccgtggcagcttacaaggaatacttgcaagctggttcatcagcattcccaattgatgtgatgaagaaggctggtttggatatgaccaagccagactacctacaagacacattcaaggtcttcgaggaacgtttgaacgagttcgaagcacttgttaacgaattggcctaaagtaaattgctataaaaaagacgctgacttcaaattctgaagtcagcgtcttttaatttactgttcttacttaaacaatgtccaccacaaagttgaggcgacgataccaccggcgataggtgccaaaacggcaacccatgcgtactcccagtgtgatgatcccttaaacttcaatggcaacaaggcgtggaccaaacgtggaccgaagtcacgcgcagggttcaaaccaggaccggttgcaccacccaatgatgtaaccaacgttgcaacaaggacacccaatgccaaaccggcaatacccttgtattcagctgatgacgtaattcccaaagcggcgaagaccaaaacaaatgttccaacaaattcgttgatgaaaccgttgaagcgtgagttagcagcgtcagtcgttgagaatggggcgaagaccgcatcaacgtttgtcgtcaaatcaaagtatggcttgtaggcagcgacaaccaaaagttgaccgaacatagcacccaaaatttgagcgatgatgtaaggcaaaacctctgaccatgggaagtcaccaacaacggccaaggccaacgtaaaggcagggttgatttgagctgagaaagctccgaaagccatagctgggatagcaacaccggctccgtaaccaacggcgatgttcaaccaaccagtttcagctccctttgtgttcttcaactcggtattggcaactgatccattacccaacaaaaccaagaacgctgttccgaaaaactcggcgaacaaacgtacgactaatgagtggtccataattcctccaaatgtgaaaataatttttaactgtttaaccagaacaaatgtttgcacatttctgtgcacaaacgaacgcttatcaatttatcaaaaaaatgcgttcagttcaatgttttttgcgtgtttttaacccgtttgtaacgtttttatgccgtttacgacagagtctatgaacaaaatatgaaacattttgatgagaagcgtaattcatacataatacagccgtatatcattaaaatcactttcattgaaaggaagcgcttaaacagttagaataagacctataaaggaacttggaggaataactatgacagcaggtcaaatcgcgttgattatcattgcggtggcggtattgttgttggtcttgtttattgggctatttttggttcgattgacacgaactttgggggtcattacgcgtgatgtggacatcattgcacgtgaggcaaacgacattttagctaacgcaaatacattgttgaacgatgttaatggcaaggtagcgacaattgatccagctttccaagcggtggcagatttggggacatctgtgtctgagttgaacgcggcaacgcacaacttgacggggaaggttaagtcaacggctgcttcacgtggggctggtgttgcatcagcgttctcagcggttaatggattccgcaaggcgcgcaaagcacaatcatcaacgacaaagtaatcggatataaaccaggagggtattaaccatgtctaagggaaaaggatttttggcaggattgttgtttagtggtgtagcagctgcggctggatacgcctacttcaagagcttgtcaccagcagaacaagaaaagttgaaggctaaggttgacgacatcgttgttgatgttcgcgacaaggcagttgattacacatatgcagcaacggatgcggtggcatctgttcgtgatcgcgcagacgatttcgtagccgaaaagggcttggacggtaaggtcgctgacttgaaggcgcaagctgatgagaagacggctggcttgcgtgcgaaggccgatgaacttaaggctcaagccgacgaaaagacggcaggattgcgtgctaaggctgatgatttgaaggcccaagcacaagacttggctgaccaagcaaagtcaaaggcaagcgaagtgaaggatcaagttcgtgccaaggttgcacctgaacttgaggatgaagacattgatatcgttttggatccaacagcaccttcattgtcagaagcatttgaagacttggaagaaccagttgcggttgaagaagcaaagcaagtaacggctgaagttttggaacccgagggtggtttgtctgagacgaacaagaagggcttgtcagaagaagcttaataatatgtaaaaagaggaacgaccgttaagtcgttcctcttttttgtagtcattattgcttcgttgaatcgcgatcaacgtaaccgtgtggcaagatgatgttcttaacagccaattcttcgcggttcatcaacttcgtcaacatacgcatagcaacggcaccaaggtcgtagatgggttgcgtaattgaagacatttgtggacgcgtcataacagccaactttgagttgttgttagtaatcaattcaaagtcttcaggcatcttaacgccagcatcagtcatggcgttcaacaaaccagcagccatttcgtcgttaacaacaacggcggctgtcgccttagcgtcacggaccatttcagccatttggtaacctgattgatagtcgtaatcaccttgaataacaagtgattcgtcgtaatcgacaccagcaaccgccaaagcgttcatataacccttaagcttgtactcgcggttgatgccgtgatccaagcttcccgtcacaaaggcgacacgcttgtggccgttcttcaacaacttggtcgttgcttcaccgatggcacttgtgtagtcaatgtttacagaaggttggtcagtaacgtcatcaactgagcctgccaaaacgataggcacatcggccttagcaaattccttgcgaatatcatcatcaatcaagttacccatgaagatgataccgtcaacttgcttgctcaataggttttccaaaacttgcaattccttggtatcagattcatctgagttagccaagataatttggtagtggtacatagcagcaacgtcatcgattccacgagccaattcggcaaagtagtggtctgtgacgtcgggaatcacgacaccaattgtggtcgtacgacgtgatgccaaaccgcgggcaacggcgtttggacggtaaccaagtcgttcgataacggcttcaaccttttctttcgtttcttgcttaacgttggcattgccattgacaacacgtgaaacggtcgccattgagactttcgcttcgcgggccacgtcataaatcgtgatggtctgcttttccatgctgatgctcctttataaatctctcatacagaatttttgtcgttttcataacttttcagtcattaaccaagttgcatatctgcaaacggttacaaggtcattgtatcatgctttcataaaatgttttcatgagaacattcaatatatcacaagttaatagtttagcataaataatcggtgtattgcgtcattttctgaaaatgagtgtacaatgatagaaaagtgaaacaagaggggatttcagatgactgaacaacttacaaaaatccaatcatggttgaacgacaatgaattggatgtcgcctacttctcagattttcattcaattgcctatttgacgggctttgaatctgacccaatcgaacgtgttttggcgttggttgtctttccacaagacgagccatttatttttgcgccagcactagaagtcgaggcagtaaagggcgccggttggacgcaccctgtttatggttaccaagaccacgagcaaccttatcaaatgattgccaactacatcaagcaacacacgacgcatgcaacgaagtgggccgttgaaaaggcgcagatgacgttggaccgtgctgctttgctagaaacggctgtaccagaagctaagtttgtggctgatttgtcaccattgatgactgaaatgcacttgatcaagaccccagatgaaattgctaagatgcacaaggctggtgatgatgcggatcgtgcattcgaatttgcctttgcggctttgcaagaaggtgtgtcagagcttcaagtgatggccaagttggaatacgacttgaagtcaatgggtgttgtggggatgtcatttgagacgttggttcaattcggtgcgcacgcagctgaaccacacggtgacacaggttcgactttgttgaaggctggcgatttggcgttgttcgacttgggaacgatttacgacggttacgtttcagacgccacccgtacagttgcctacaagtcagtttcagatcaccaacgcgatgtttacaacgttgtcttggaagcacaattggctgcccaatcacaagcaaagcctggtatgacggccggcgagttggatgcgattgcgcgtgatattattacaaaggctggctacggcgagtacttcgtgcaccgtcttggtcacggtatcggctcatcagtccacgaatcaattcaaattgccactggtaatgatttgattttgaaaccaggtatggcgttctcaattgagccaggtatttacattcctggtgacttgggtattcgtattgaagactcagttgtcatgacggagaccggtgctgattcattcacgcactcatcaaaggaattgcgtattatcgattaaacaaaataggatggtaccttgattttttcaagataccatcctattttttagtgccagttattaatgattgcttcggcgttttcttcagtatcggcaacttcagaacgtgtcttttcagccttcaataaaggtagcaaagcttcttggcgagcactgtgcttaatcacccaaactaagaaaaggggttgttcgaatagccaaacgatgtgacgagctgagtaagtggtcgtttgaccagttacggggtttggcttaaccggtgcggctagttctggcgtgacagctgccaaagcatcagcttcagtatcgaatgtttcctcaatcttcttgcggagatccttcttgaatgcgtcgtacttcacgcggttcttttgcttgtttgggtaatcaacaccccacaactttacgatgtcgaggatgcctgtcaaattatacgtggccatgtgtttgctcactctctattaattagtaacctaagcataccacattaggcagcgtctagtttgataatcatcttatgaatcttgtgaccggtagtggccaattcgatggttgcatcgacgttgccgtcggatgcaaaactgtcggaaaaatcaccgtggaaggtgacgtgagctaggacttcgtcgtttaaaggttcgacggagtaaatactcgtttggacgttatgcgcaaagaagtattgcttaaaatagctttgaatgtcaggcaacccgacactgatttgctttgaagcaacatcagagacaatggcgtctggcgcaaatagggagacatagctcccgtccaaatcattcagataacttatgacttggtacataggtgtagatgctgacatgaaggtgcttctttctaattagactgtaaattcattatctgcttataaaatgtgggcgtcaaacggaatgaccactaaaatttgccacttcctaaaaataagcgtaaagtagataagtcgtctttctaaggcgacgctttttgttaatcacaacaaaaagggcacttatttgtttaattttgaaagtagaggtttttatgaattccggaaaaaccaagatctttaaccagtcatttcttgaaattgcgctgattaacttcctagttttgatgacgttttacagtttgattgttgccgtcggaccatatgcggtagatgttcttcatctatcaacagcaagcagtgggttgctagttggtatcgtggttattggctcacttgtcatgcgtatgatgtccggtgcggtgctagcacgcttttcaaccaagacgatgatgatggttggtgcctttgtattgattcctagtatgctggcttatcatgttgcaacgtcaatgatttcattattggtactacgttttgtccaaggaatgatgattggactaatcgggacggttacaaatacggcagtcgtgtttgttgtaccggaagagcgtcgcagtgaaggaatttcatatttctcattgagtacagttatcgccactgcaatgggtccattcttaggtctggccttgagtaagattggctatggcttcttgtttaatattgaaaccgtgattgctgtgttggcatttttagcaaccattttgattcacaaggaagccgttgatattaaggcacatacagttaaaaaggttgaaacggctgataagccaactggtcttaagaagtttttggagcctaaggcagtgccgttggcaattgcactgtttattgccacgttgacgtattcagccatccaaagttacttgagcttctttatgaaggcgcaacacatggcctcagtgaccgagtacttcttcttgatttatgcggcagtaatcttcattagtcgcccatttacgggtcgtttggctgatgaaaagaacgaaaactacatcatttacccaggtttgattttgcttgccattgggtttgtgttattgagccatgtcacaaacgtttgggtattcgtattagctgcgattttcatcggtgttgggttcgggaacttccaatctgctgcccaagcaacgattgcaaaaattgtgccacctgagcgcatgtcatatgccacatcaacgtacttcatcttctttgatttggcatttggtgtcggaccatacttgcttggtttgattgaaccaagtattggcttcgtaggcttgtacgagttgatgattgcgtttgcgattattgccttggtttggtacttcttggtacacgggcgccacgttaaacgataaatactattaaaacattagcgaaaactcggaaaatctgctacattagatacagataagattcgagtttataacgacaaaaaagacgaccaccacagatcacttccggtctgtggtggtcgtctttttgtatactttcgactattccgtgaattgtgtgaacgttttatgaatttaagggttgtcacgtgaaatacagagcaaatggcattattctattgttacaaattagttacggatacttttagaagaggtggggacaatggaaaaagtgactaggttatttagaggggcaatgttagcgactgtaatcgtaccctttgccggtctacttacattaccgacagcacaaagcgtttcggcggcagattatggggtgaaaatctctaacggaacgcaggtgctatcaaacattgatggcacggtgacctttgcagggggaactgttaagcaaacgaaaacagccgatggccaggtgaatttgtatttggctggtgtaacgttgaatccaaatggcgatggggcgtcaattgtttcaactggcaatcaacaaacgcacctttacttccaaggtgaaaagccttcagtggtaaagggtgcgttgcaaggaatcacgacggtaactggggctgccagtttgttgggtgggtctcgtgacgcattggctgtctacgcagaggacacgccaggcatggctagcgagatgcaacttgaaggggattttgctaagccagtgaccttgacgcataaggatggtagcaaggctgtgccaactatcacgcttggaaaagatgatgcgacccgtttgaatcaattgattttggcaggcaagtcgacggatagcgttgttggtggggatgccattatttacaacccagaacgtgttttgtcaggcgatttggacaagataattggggcgacatcatggcgtgtcgattatgatcaaaacgatacggactggagcgatgcggcaaattacagcactcgcccattgtcattgaagggaccaaatggtgagacggcaactcgtatcgaggtttcaagtgtgccgttagcgtttaaagcaaataatttggcggttgtgaatactaccaagttggcagctgagaagattaacccaaccgatttgtacaccgcaggtaatggacaaccggtgacggtatcgattagtcaaaacgggtcggattatacgacctttaatggtggtgagctggcagctggtcaatatagtgtgaaggttagccaacctgcaaatgttgacaagggcgtgtttggtggcgaagcgactggtgaattgactgtccaaacaacgccggcaccagcaccaaacaatggtgggggaaccacaccaacgcctgtgccaagtacaccggtgacaccagcaactgtgacgccgacggcaacgcctgtgacgccagcagtgtcgagggcggttgtggcatcaacgccagcaacgacaactgcggccactcaaacggcaaccgcagcaccggctaagcaaacgccagccgcagctaatgcaacgttgcaccacggcgcagcgagtgatccattacatggaccacttgaagtcgatatgccggtgaagtcaaagacgacggcgaaggcaccagctaaggacgctaaacatgagaatgccttcctaaagcgtgcagccggcttgagtacccaagctgttgtggccatttggtcagtcgctgtgctggtatttgttggcttagtttaccttggtatgcgttgggcaaagcagccacaagctgctgaagtcaacgacaataatgaagagaagtaaatagatgacaaagcatgctgatgacagcatgctttttttgcccggttggttaatttaaggcaaaaatcattctaaaaatgcccacgcttaacaaccgtaaacgtccatctgacctggtattctggcactggaaagggagaatattgcaaatttgtgatgttgtcttgcttagaaagtattgtttggggaaataacaatggtaaaaacaaaggataaaaagaaaaggctggaaaacagcaagttctgggtcgcagccggactgaccgccgttgccgttggtggcgtgacgacagtcgaaccgcaattctgggactttattgatgatgaaatgcatcaaacatatgccgctacggttaactcgacaacaacgattgatcaggtcaaagatgtggataccgagaatggtcaaagtcgagatgtgaactggggagcaacaccaatctggaataacagtgaagtggacggattgggaacgtacaagccgactggcaatccttgggttgcagatcgaaattataacggtggtaataaatattcgaaaaatggtgcgtattatacgaaattggtagctgatggacaaactaatgccggatatacttacttaaatcgtcagttcgatgccacgaagccctttacaatttctgggtatttgcacccaggaaaatcagatagtaacacgacgctagtaagtaattattctgattggactggattattgctgacaccaacgaaccctgatgatattgccaaaaaatatagtttagatagttatggtggaagtggtttaggaattcgcggaatggcgaaagcgtttgcgttggggattgactttaacgtaaacacatcaacgggttataacgatccgagtgcgacatccccatttgctgcgctccgtactacggatgccagtggaaatttggttacgcctaattctaatctctataagtcaggcgtttctaattggcaaaatacaattcgctacacgttaacttggaatccaactggtgggccagacggcaagtcgccatcaatcgttgcgacgatgacgcctgatggtggttcgacttggacgatagatactaaggcgtctggtgtaacgctacaatcagtcagtgcgttgacgtttggattgaacgccattaacggaaataatgcaggtgatcaatatgcattaatggacaatgtaaccggtaccttttcaacgggaacaaccaccgttaaatatgttgatcaaaatggtaaagaaatcaaaacagcaactagcttcatcgccaacgttggtgaaacagttggaatcaccggcttgtcttctggtgttgactcagcggattatggctatgcagccccaacgattaaaggctatacggtgagtgcggcttcggctgttaagaaggtttcacaaacagcatctgataacgttatcacgattacctatgctgaaaagccaacgcaacaagctaacattcaaacaaatatgccagcactctggaatgggtcatcgacgattgcctcgtacacaacgaagcaacaagatatgccattgggaaattctagtagcttggcaactagcatttcggatgcaagtttggtgcggtcaggatatagctactatgtgacggggccgaatggcgcgagttatgcaacgatggcgtcagcttcagcggcaactactaacgtttgggacagtactgcgaacgccgttggatcagcggatagtactccgcaaacatggacggtcaactacgtggcaaacccacagcaagccaatttgtatgtacaatattttgcaccatcaggcggtagttgggtttcttcaggaagcagttcattatatgcgtcagccgttggttctacaggtggcagcatttcatttaccgcaactgattcacagataacagcagcctctgggtatcgctatgtcatctatggaccggataattcgtcttatacgacattgagcgcagcgcagtcagcgtacagttttgatagtacaaataacacgacaactgatgcgtcagcacaaaacttttggttgtactactatccagcgatgcaatttactagtttggtggttgatgcaaattcgccggtaaatgccgcatctgtgttagcttcctcatatggctacaccaatacggcgttggcattgccatacactgacggttcgctgtctgcacaaggttattcttatgttgtgaagggaccaaatggttcagagtacagtaatttgtcagcagcaatgtcggccaatgcaatgtacgatgcgacaactaatccatcgaacacggatagttccgcacaagtgttcacagtaagttacgtgccacagtatcaagcggcgcaaatccgatatgccactgatggaccaattggttctggagctgttttggcatcggcagctggtacgacgaacaataagattagttttgcgatgtcagatggtgacttggcacgcgttggttatacgtatacggttacttatccgggtgatagtgtttcatatgcgaccttgtcagctgcattggtcgcgcacagcaattatgacaacacatcaaacgctggcacgtcagatgctagtggtcaggtattcacggtcaactataagacgaaccaatatgctgttttgcagacaacaccaactgatacgtcgagccattcggtcttgagttattcagcggtcagtgaatcagcgaatgggccagcaagcagtgccatctcatttagtacaactgattcacagttggcccgcagtggttacacgtattcagttgtggttaaaacaatagattcagcgggatcaattctgggaagcgtgctggcttcatatacgacgttggcttcagcattggctgcgcaaaagtatgacaatacgtcaaacgcaacggcggcaacggttgatgcacaacgtcaattgtttgaggttgtttattcaccagactcagcaaccgtgacgtatcactatgttgatgaaaatgggacaaaacttatcgaaccagtcagctcatcaggcgtggtcggagcgacaatcgatgatcgctcgatggtcatccccggttacaccctaatcggaccggatactgctatttcggatacagacggcatatacgatgctgacaaagtttcaacggttacctacgtttatcgtgcaaaccaccaagaagccacattggcggtggatagtgcatccccaaccgctgcaaactcagcaattacatcagcaagtggtgtaacaagtggcagcatatcgtttaacgtaacggacgcgcaactggcaaaaacagggtacacctacacgattatcggaccaactggtagttcttatgctaatttgacggctgctttggcctctaatgccttgtatgacaacacgacaaacggatccgctacgactgattcatcagcccaatccttccgcgtgctttataaggcgaatgtgcaatcagcccaaattacggtccaagaaggctcaccaattagtggcggtgcttcactggatgccattactggtgtcacgagtggtgcgatgtctttcaaggtgaacgatacgacgttgccagtatctggatacacatatcgcgtcggagttggctatgatacgtcaaatatcacgtggtacgcgacgctgtcagaggctctatctgcaaatgcaatctttgacaacactgacaacactggtacaacggatacgaaggcacagttcttctacgtttcatatgcaccgatgagtcaggccgcgacagtcgccgtgacgagtgactcaccaatcagtgcaggttcaacggtgctttcagccgctggatcgactgggtcagcgatttcgtttgcatcaaatgtgtcttatgcgacgttggattcacaattggctaagtcggggtacacctacacggtcaagtacggcagtgatgcaacggcgtacacaacgttgtcatcagcgttggcggatcacaataagtacaacagcaataacacaacatcaggcacaagcgatgctaatccagatgtctttaccgtgagttacaaggcggactcacaaaccgctattttggctgtgacgagcaattcgccagtggcgtcaggctcgattgctgattcagcttcaggtgttacgtcaggtagtttggcgttcacgatgaccgattcaggcctggccaagcgtgggtacacgtacacggtaaccggaccggatggtagtgtttacagtaatttgagcgccgctgtggcagctaattcgttatttgataacacgaataatccagtttctgtatcaagtgacacggctattaaaagcttcttggtgtcatataaggctgattatcagacagctgaagttgtacttggcgagtcaggaccatacgcctcagattcagtctttgcgacgacttccggggtcacatcgggttcactttcgttcagtatcactgacgccgatttggcgctgtcaggttaacactatgtggtttggggtaagtatgcgacgagttcatacgcaaccctaagttcagccctcgcagctgaaagccactttgacaatactccgaatgggtcagcaacttcagatagtcgcgcgcaacaatttgtggtgatttacacagcggattcacaaacagcaaatatcgttgttgacacaacctcaccaattagcgctgggcaaaccgtgacgtcagcggccggtgccactagtgaagcaattgcgtttgcggatacggctgacagtgatttgtacgtgcaaggttaccactacacggtgacgggaccagatggttcggtttacagtgatttggcaacggcgattgccgcaaatagcttgtatgacaacacgactaacacaggcacaactgatgcgagcgcacaaaacttcacggtgacttacacggccgacacccaatgggcatcattggccgtgacggatgattcaccaatcaacgccggctctgtgattggctcattgtccggtaagactgctacgaacatcccgtttgatgggtcagatgcagcgttagttgtgtcaggttacacctaccaggttcaaggaccaaacagtgagtggtatgacacgctagctgaagcacaaagtgacaatacgacgtttgataacactagcaatgccggtgattcggatgctgagacacaaatgttcttggttagttacacggcaatgagtcaagctgcgacgattgttggggcagcggattcaccaattagtgcaggcatggccatcgaaagtgcagctggtgtcacgagtgagaagattagcttcacacacaacgacagttccttgagtcgcagtggctacagctatgtggtctacatgggttctgacagtgggacgacatacagtacgttgtcggcggctctggcggcaaatagtttgtacaacaacacgaatacgacggattctgatgccgatccgcaagtgtttacggtctcttatgtggctaactatcaatcagccaacttggtgattggtggcgacacgcaaattagcagtggcgtgacacttgattcagctgccggtgtgacgagtggccgtgtgtcattcgccacgacagattcagcattggcattgagtggttatacgtacacgatccagacaccaaatggcactgtctttgacacgttgtcagcggctgtcgcaggatcacaaggcttgtatgacaatacaacgaatgctgggacttcggatgccacgccgcagacctttacggtggtgtatgcagcaattacacaaacggctgaagtggttgttggtgaaaccagcgatatttactcaggtcaggtgttggctaaggtcactggtgatactggcgcgactttgggactaacgttgactgatgccgacttggctaacatggagatgacgcatggttatacctacacagtaactgttcaaaatgcggatggcacgatggttgttgatgcggatggtaatccagtgcactacgcaacgttggcagatgcggtggctacaaatgatttctttgatgcggtaaatactggtatcaagaagtttatcttgaaccccgtcgcatcatatcaagagagtacattgacggtgacgagtgaatcgccaatttcagcaggagtggccgttgaaacggctagtggtgtgactgatggtcagctgagttttgcaatgacggatgcaagtctggcgctttcagggtacacgtacaccgtgacagtcgtgaatgcggacggcacgcgcgatacgtacaatacgttgtcagcggcggtttcggccgtttcaagttacgacagtacaattaacggtagtgggtcaactgattcaagtgcccaagcctttgaagtcagctacaaggccgattaccaatcagctaatgtgaactttgcgacggctgacggtgataagccgatgccatcaattgtaaccgcgggtgttacgagtggcgcttacacgtcaacttacacagcggctgatgggtattacttcgttgcttcaggtcaaccaagtggcgtcagtgtggccgcagatggtcgcacggcgacgttgacgtttaactatgacaatacgaccaatttaagtgcgacggatagctcggcacaaacctttaatgtattgatggctgaggcaagtcaatctggtgagattagttactcatattcaaacgcagttggttcgccaacagtgccagatgccgtcccaatcgccggggtgacaggtgatacaaagtccggcacgattacagcgccagacggttactacattgtctcagtgacgggtgatcaatattcagtggtttacacagatgaaacccatcaagaggcaacgtactcagttattttggatgacactaacaacggtaatgagacatctgatactacgccacaaaacttgctggtcgtcttggcaccaaacaatcaaactgcaacggtgactgaggtaatgccaacgggctcaagcagtgtggttgatacccaaaatgaccggacggccgattcttacagttacacctatacagcaccggcaggatattacattgccagtgatggtgtgacacctgcttcgggcgtgacggcgtcaattagtgcggacggcacgacggtaacgttgaccggtacttacgataattcaaaggatttggatgaagctggtaccgatagtgccgtccaaaataccgctattaccttgacccaagcaacccaattagccgagtttaaggtggtcgtaccatcgtgggcgaagaccgtttcggccaagctgaacacgattgaaggtaaaaccggcgaggcgattaccgcaccgactggctatacggatgcggaattagctaaggatggttatacgtactcagtcaagggaccagatgggacgatttacgacacaatggctgaagcgttggccgccaatgcaactttcgatgatagtaacaatggatcaggtagcgatgttgagacccaaacctttgaagtcacatacacggctcagaatcaaacggttaaaattttgcaacagtacgccgatggaacgacgaatgggccagcgtacccacaatctgatccaacgttgaatggtaaaactgatcaacaagttactggcacgattacggcgccaactggttatgaaatcgtggatatcactcaagttgatggcgtaacgtgggaaattgcggctgataatctatcagcaacctacacaattacgtatgacacgattactgaagaagcgccagcgactcgggcaatgctccgggcggcaaccgatggcacggtgagtcaagaatcagtggtgacgtacggtccgttggatcaaacagtcaatgtgacttttaaggatgaagttggacgtatattgacgtctgatactggcaagaacggacacgcgctagaaggtaagaccaacgaagcggttgattatgatgacgcatcgttggcagccgacaaggttatcgatggctataccattacatctgacacgacggatacggcaactaattatgatgacgatacatcggttgctcaggatgtcaccttcgtttaccgtgatacgcaagcgccaactgtgacgacgactaagacagaactggtttcctcaaaggatggtttgccagctgatgaagcggccttcttgtcagcagttggttatgcgacaacggataaccaacaatacggtgactcaacggtttcaaccgattacgacagtgtgatgaacgatgtgaaagctgacggcaaggctcgtgaagtgacgattacggttaaggatgcaacgggtaataccaccactaagacagtgatgttgacggtggttgatacggcgccagtctcacaagaagctgatgttcaaacggcacagaagaacttggatgatttggtgagtgatccgaatgcgagtgatgcagacgttgcaacagctaaggaagcgcttgaacaggctatccaggatgcgcaaacgcaacgtgatgaggcgaaggatgctgcccaggcggcatcaacgtcagatgaaacccaagccgtagctgatgatccaggtgttgttgaggcacaacaagctttgcaagatgctattgataatgccgatgctgatactggcacaacccaagcgattactgatgccacggctgcccttgaaaatgcagtcgcccgtgcggaagctggttccgttgatacggcaccggtttcacaagaagaggctgttatgcaagcgcaatctgatttggatgatgtgttggataatcccgacgcaacaacggccgaggtggatgcagccaagcaagctcttgaagacgccgttgcacaagccaagtctgaccgtgcggatgcgaatacgacagccgatgataccaagacacaagtgactgatagtcaagacgatgcggttaaacaagccgtggctgatttaacggctgtgcaggatgcggccgcaaatgacgacgcaacaacggctgatattgaacaagcagttcaaaaggtcgttgatgccgtgaaggatgcagcccaaaccgcactagatcaagatgcgtctccggttcaaaatgaatcaaccgttagtcgtgccaaggataatttgcaagatgttttggataatgcagaaagcacaccacaagaaattgttgatgcgacaaacgcttataacgaggcagtcgctgatgcaaaaactgcgcgtgatgacgccaccaaggcagctgaagatcaaattacaacgacgaataattcaaatcaagtgaacgatgcgtcggtaattgatgcgaagaataagttgcaagatttgttggataaggcagccactggggatgctgatgctttgacggctgatattgaacaagcgacgcaagatttggctgatgcggtggcagcggctggtggtgcgcaagatgcggcacgtacagcggctgatgaagcgttgaccaagacggcgccagtgacttacgagccaaatgtgcaagagaagattgacgccctgaatgatttgttggctaatgaaacagcaacggctgatcaaattaatgacgcaaccgcagcattgacgtcggctgttaacactgcaaccacgcagcgtacatcagctaacgatgatgcagcgaccgccatttcacaggcacagagttcaaatcaatctgaagagccaactgttcaagcagccgaaaaggcgctgcaagacctagttgaccaggcgaagaccaacacggaagacgcgttgacggctgatattcgtgatgcgattaagaatttgcaggatgctatcagtcaggcggcatctgatcaggatgacgcacgtgatgctgcccaagatgcgattacagctgcatcgccggtatcaaatgaagcggcaacaaaggcagctttggacaatttgcaaactgttttggcaaatgagaatgcaacgaccgctgaaattcaggaggcaacgcaagcagtaacggctgcgtctaaggctgataagaccgaccgtgatgccatgaatacgaaggctaatgatgctgtgacagctgcgcaaacgggaaaccaagcaactgaaccaggtgtcattgatgcgattaagaatttgcaagatttgcaggctaaggcggcgactgatgatgccgatgcgttgacggccgatatcgaacaagcgattgctgatttggcgactgcgcaagaaacagcggcaggtaaccaagaagatgcgcgtgatgcggctaaggcagcgattgctgagactgagccggtatcatatgaagatactgtttccacggcacgcaaggcgttagataagttgttggctgatccagcagcttcaacccaagacattcagaatgcaaccaaggctttgactgaggcaacgacggctgagaaggataagcgtgatgcgattaacaccgaagctgacagctatatcacggatgtgcaaaattcggcacaagctagtgagccaacggttgtgagtgctttgaatgccttgcaagaaatgcaggcagaagcagcgaccgattcatcggctgctttgacggccgatatcgccgagaagttggcagaattgaaaacagccgttaatcaggcagcaactgctcaagaggcggccaaagataaggcaaacgaagcgcttaatgatttgcaaccagtatccaatgaaccaggtgttgaaacagcgaaggctgcgcttgaaaaggtgttagcacacgacaccgcaacagctcaggagattacggacgcgacgcaaaagttgttgaatgagacggcggatgcgaaggctgaccgttcatctgctgaaacggatgcgcaaaatacaatcaccaaggcgatgaacagtgaacaaagtgaagaaccggctgtgcaggaagcaattgatcatttgaaccaagtgatgtcagatgcagctaatgattcaccggatgcgctaacagccgatatcgatgctgctcgtaaggcacttgataatgccttggcaacggctcaagctgctcaagagcaagctcgcaaggatgcagcatctgcaattgcgcaagctagtccggtttcacacgagttggccactgcacagacgattaatgcgttgaatgcagtgctcgcaaatcctgatgcaacagcatcggaaattgcaacagctaccgcagcgcttaatacggcggcgacggctgataagggcgaccgtgatgctgcgaatgcagccggaacacaagcgattgctgatgcccagggctctgatcaagtgaacgaaccagcggtgaagtcagcattgcaagagttgcaattagtgatgtcaacggcagcaaccgatacggcagatgccttatcacaagatattttggatgctatccaaacattggctgatgcgcgtgatgcggcggctgcaaagcaagacactgcccgtcaagacgctgctgatgcgttagcacaaacggcgccgctttcaaatgaaaagccggtggctgatgcagtgcgtgagttgaagaatttgttggctaacccaacatcaacggcagctcagattgcggatgccacccaagcagttcgcaatgcggtgagccaggcgcaaccagaccgtgatgctgcgaacacggcagctgatgatgcgattgcgcaagtaccaagcgatttggcggatgagccgtcagttagtgctgcggttgctaatttgaaaaagattcaagaacaggcagcagctgataatccaaatagtttgacagctgatattaatgcggcaacgaaggcgttggctgatacgattaaggcagccgaggctaatcgtaatgcggctcgtgatgctgcaagcagtttgctgggcaagacggtgccattgtcgaatgaggcagcggttggtacagctaaggatgccttgcaaaagttactggatgacccaaatgccatcacaacggcgattgaaaatgcaacggctgcgttgcaggatgcccttcaaaaggatggggctagtcgtcagtcaacgaacacggctgccgacaagcttgttgctgaggcaaagaacccagcgattgctaataatgaagcagttgcgcaagcgatgcaacatttgcaggcagtgcaagcggcagctgcccaagacagcgcatctgatttgacggccgatattgcggctgccatgaccgcattgcaaaacgcaatgcaagatgcgaataacgctttggatgccttgcgtcaagatgcttcggatttgatttcccaagctaagccagtttcacatgaggctgatgtcgcgtcaaaggtagcggctttgcaaaagttgttggatgatccatcagcaacgagggaccaaatccagcaagcgatggacgacttgcagaatgcgacggcgacggctaagactgaacgtgaagcggctaatcaatcagcccatgatgcgattgcctcagctaaccagtcgtcagtatctggtgatccagccgtacaagaagcgttggcaaagttgcaagcaatcatgttggcagcgtcaaacgacagtgcaaccgacttaacggcggatattttgaaggcgatgcaggcattgcaagatgcggtacagtcagctgaaagtcgggcagcagtagtggtgcaaccgacgtcatcggtaccaccagttaatggtgtacttgcctacacagcaaatccaacaactcgtttgttggctggtagcacggtaacacgatcaggcgttttgccttacacgggttaccatgacgattggcatttgatggcactcggaatctttatgttctcggcaaacttgttgtttgtagcagcaaagcgccgtaagaaggatgaagaagcagagtaggaaatgaaaaaaagaggctttgagacgaatttgtctcaaagcctcttttgatgtgtcgcaaaataaaaaagtagtacgtttttacaacgtactacttaaagagaaggagccaacgggatttgaacccgtgcgccggctcaacaccggttcggcggatttcgagtccgctgcattaccactctgccatagctccataacaatatttaatattataaacatgattattgattgtttcaaggtgattaaatgaaacaaaaaagacacccagcaaactggatgtctaacatgatagcccatcagggagtcgaaccctggatgccggtgtgaaaaaccggagtcttaaccgcttgcttagcttgatgaccctacacatttgtttcatcgaaacgatattcagttttcaatgacctacgtcgtcgccttgacgacttaaactatattacagaagaaagaatgaaatgtcaataactaatttcaatcaattttcatacgtcgttcataagcattaaatgccccgaaacgacttaatatatattacagaagactcaaacgattgtcaacaaccaatttgaacttctttttaatgaatcacaaccaattgattcagtacatttcgtaccgctcatttgagtgcttaaataatataccccatccacgaacgttcgtcaactactttgttatatcgaatttttccgaacaatccatagacacaaaaagcacctcagcgagtgctgaggtgctttcgttcttattgttgcgctgcgtcgtctgttggcgtctcttcacttgaagattcgctacttgatacagcttgttgaattgtttgtggttgtccacccaattcaggtgcatccgtcacatagtcacccattgtagacgtgtggttgtgctgatcaatcaaagtcgtatcactttgcttatccatcttcttcaagagagcgagtccgtcagacttcttatatgaataatccttcttatcgaccttcttgaatccctcaggcgtatagaaacgtagcaaatcgccagtttgaacatcatctgagtatgtcaacatcttatcaacatacgcttgtgtctcatcgataatttgcttagcacgtggatcttcctttggcttaatctttgtaccagtcgtcgtaacgtagtaattaccaccatacttcatgtattcagcggatacccagtcaccgttacggaacggcacaacctgcttacggtttggcgctaacaaatcttgaccgaactgcacattgtttgatgttgaaacaccaagcaagtgcaaaatcgttggcatcacatcgatttcaccaccgtacgtgtggttaataccaccttgcaatcctggtgcgtgcacaatgaatggtaccttttgccagttagccaagtcatacgcattaacagagctcttacccatcaactttgcaatcgctgctgggtggttctctgaaataccatagtgatcaccatacaaaacgatcattgagttatcgtacaagcctgacttcttcatccaagccaagaattcaccgaatgcttgatcaagataacgtgccgtctgcacataaccatcgacagtcttatcgcccgtcgtggtcttctcaattgagatgttttgcttatccaagtcatatggatagtggttcgtcactgtaataatctttgaatagaacggttgtggtagttgttcaagatacttagcagaatcctgcaagaaaatcttatccttcataccataaccaatattgtagtttgcgttatccgcatccttgaaatatggcttactaaagaagtaatcatatccccaagacttgtacgtgttatcacggttccagaatgaagcgacgtcaccgtggaaggcagcagtcgtatatcccttttggtccaagatagcaggtacggcttggtaggtattagatgtaccgtagttaaccatggctgatccagaagctgtaccaaacaatcccgtttccaacatcgtttcagcatcggccgtcttaccttgacctacttcgttatagaagttatcaaacgccaatgtgttttggtcatggtagaacgcattcaggttcggcgttacttcaacatcattcaccttgtaatcaatcaagaattgttggaatgattccaagtggaacatgataacgttcttacctttctccttaccgaagtaaacagaattttctaacgtcttattaccatcaacaaacttcttaatcttatctaggtctgaggccttagcttctttcttaacgtccgccgtttgcttcgtcttgaaaatgttgtacgctgcatactcattcaaaccaagatacttaacgatgtagttattatcaaatgtgcgcgtcaaaagtcctgaacgatcctttgaggcaatcccataaccaacaaacatcaacaaaacaccaaatacggttaccaaagctgcaaaacgcttttggaccgccgtcttatcgaccttaatcacctttgttagcaaaaggacgatcaagacaataatatccacaaagactaggaagtcagacccgtgaataatccccgcgattgacttactcaagttattttcaactgacccaccagaccccatgatgttcaatgacaagaagtcagagaattcacggtagtacaacatattggcgaacagccaaattgattgcacaaggttaattagcaacatcaaccagtaagcgatgcgtccacggaagtacaacgcaattccaagcaaaataatcgccgttggaattgggttcaagaacaacaagaactcttgtagtgttccttgtacccccagtgaaaagtttgtcttatatgcccaatatgtcttcaaccataccaagaagaccgatagcataaagaagcctacagttgagttgaagtctggccaccatttcttgatgactgaaactactcgttgcattttattacgctccattttctctctaggtccattcgaccttaaaaattacaatattcagtataccgcgcttccattaaagaaacataaaatcgtcttaaataatcgcgactaactacaactatttaaaaggtttccttaaagtcttgcagtgcttcataaatatcaattgcgactaaatcggcatcatcaaatgcaaaacgccgattattatcacgtagaccttcaaccgcaaataccttcgacggacgatcatagactactgtcacaactgtcacaccgaacgcgtcaaaatgacgggtttggatgtcttcgcggtcatcaatcatcatggcacgaatgcgttgtgcaatctgtaccaaatcactttctcgactcatgtttatttccttctcttcgctgcatttagattaaaggcaacgatacctgcaaacatccccaggtagtaggtaatcaaacgccaaatcatcatggcgaatagcaatacagatgcggatggcaagaactgcgagaataataccgcaaagcctgcttcggcacccccagttccacccggaattgggaacaacgaaatcaccatcacaatcagcacgtgtaatgctgtcaccaaaacaacattaatcggcgatactcccaaccccaacaaaataaagtacgggattaggtagtaaaccgccatctggaagaacgtgaccacaatcgctttgactagcgctggccagtcgtgactcatgcggacactctcacgatgaaaattatcaatcttttcatccacgacatccttccacttttcaactaaagctggtcggaaccagccaattggtttgaacactagcaaaaccattgtacgcgtcagtgttggccagtacataaccaacaagagacctacaataaccgccaagtgaatcacaaaaccaaacaagaccaagatggcccatgcatgcaatttatccgcaatgtagtgatacccaatcgttaacgccatcaaaaagttaacaacgatcatgccttggtaaacaacaaacttcattaacaaaatcgaacccgcgcgtccaggatcgatacctgcctgcgcaagggtaatcatttgcatcggttgtcccccggtagcaaacggcgtaataccattccctaattgttcaaccaacgggacacggatagcatcacgccaactcaacttttcatgggcatcatcgacaaaaattttaactacaaccgcttctaatagtagatagacaaccatcgcaccaaccgcgacaatcaaccaccaccaatttgcgtttttaacttctgatgcaaactgtgtccaactaatcttacggaaagaccagtaaaaaatccccaaaccaattaacatcataatggtaaaaacaatgccattccgtctcgtcattgacttaccccttgtttttcaagctcgcttgttcggtatagaatttttcccaaatatctgccacatagtcagcagaataacgttctgaggcggccaaggcctgctttgacaattcttcacgaagttcaggttgatcatgcaaagccgtcaattgtgcttgcatcgcttctcggtctgaaccagccaagtaataaccatcaataatggcacgatacaaatccaaatcgcgcaatacggttggtgttcccgtgctaaatgcttctagggctgacattgggaaaagttccgtataacttggcagcaagaagacatccgcagcattgtaataaccattgatgacagcacggtcaacaatccctgggaactttagatttgccggcggatttgccaaaaccttttttagctcatcgtacccagctgtaattgacccaaatgaaaagccaccaacccaaacgaaagtccaatccggattatcttttgccatcgcaatgaaatcccagatacctttacgctcttgaatttgacccacccctaaaacaacaaaggcatcttggtcaatatcgaactgcttacgaagtgccaccttttgctcatccggtaatggatggaattgcgtcttcgtgacaaagtttggaatgtacgtcactttctcacgtttcacccctagcgccaccagtttatcgatgaacgttgggttaacaacaacaatgtgatccatacgcttgtaaaacgccatcacataccaataaaaaatattcttaactggccagtgcaaattaatcgaaccctctaacgtctcaggtaaaaagtgcacatagccaacacgacgaccgcgaccaggtaagaacgtgttcaaataaaaccaaaaatcaatggtgtggtagtgactaatgtcagctggtgccaaactattgattcgaacttgaaacttatctttaaaccgcgccgtcaacaaatttatcaactcacgataggctgacccaacaccttgaccaggtaccgtttcagctgaagaaaacatcgtaattctaatcattaatcatctcgtcggaatggattccgaagcaggaatgtttttgagtactccacatcgtttgcttcggcagcttccgtatcctcctcttcatggtaaacagccaatgcttctgcatagaaatcaatgacgcgtttaccaaatgttcgttcgtcaatctcatgcaacacagctgctcgtgtctcaggattgccaatcgtctcacctgttgtcttagccttaagatacatgaccattggttcaagcagtccaaaactatcgtcaaccagtgtcccgatgttttcatcagtgacaatggtatcaagatagggactgtgaatggcaacaacgggtgtatcagccgtcatcgcttcaatgaaggttagtccttgcgtttcagaaactgatgctgacacaaagacatcacccattttgtaataaccatagacatcattgtgattgacctctccagtaaaaataacatggtcgtcaatctctaatgctgaaacgtgttcttgcaaagccgacattgcaggaccgcccccaacgatgatgaacatcgcatctggcacctcttccaaggcctcagcgaatactgatagtgcatcatcgagattcttttcaaaagcaacgcgtcccaatgataataccactggtgtttctggcttaagacctaatttttcacgcaaggcaatacttgtatcttctgccgctgagtgaagcacattaacacccgttggaataatctcaatcggtgccttcaccttatacttcatcagcgtatcgtacgtctgacgtgatggcgaaataataccagtcatgcctgccataaagttacgggcaattacagccacactacctgggcgaataatcttaccgttagcaatgtagtgcaagtagtcttcataattcgtgtggaacgtatgtacaactggaatcttcaattgacgtgcaacaaactttcccattacgccgagcgaaaactcagtttgtgtgtgtacgatatcaagttgtagttttttagctaattgtacggcctgaatcgcaccacgatatgtaatgcgtcgatccttaaatccaacgaatggcaaacttgcaaaacgatagatgttcggttcaagcgtccccttttttaccttcggatcggtagacgtaaaaatataaaccttatgtccgttagcttccagttgacgtcgcaacgtttgaattgatgttgcaaccccggaaacctgtgggaaataggtatccgtgaatagtccgatattcatgatttgtcacctttcacaatttgtctcatcttacattctaccaacaatcatccggttttgggataggcagtcgtgatggctttgtgaatttttatcacagtagctgttggtctaccccactgaccttagtcaggcgaaagatatcttctcaaatttttgcgcaaaaaaaccgccggcacgttggcccgcggtcacttcagctatgatttgcgacacatagctagggaagtgctactccaccaccctgtattcaattgtaaagggaccaccttagagaactaatctgcagttttagtcgtctgtcgctaaggtatggtcacaaccaaatctatagtctcatctctaccgcatccaagctatttgatttattcatcaaaccgtgtcgggagcggcctccaatctctgaacaagcttacatccatcgctggattatcgtccgtcgtcgaagtaaccgatgctaatgatcgcaagagatgtcaaatcatgactaatgcgtttatctcttaaaaatgatacgtgttgttatcttgcgtcattactgtgacacgcccgcatggattgcagtagatgatggcactactgtggttgaaataattgtttcttccaaagttatcatctacctttcttcctttggtacatgtttataataacgcaccttgtaagcggttacaaatataagcactcgaaaatacaaaaagttttttcgagtgcttatctatccgttatccgcgcgcttcaccccacgcctttgggtcttggcgccaggcttgtaacgtctccaaatcagtatcatctacttgtcctgatgcaatcgctgcatcaatcaaagctgagtaagtcgtcaatgatgcgaatggcgtcttggcagctgcgaagttttcgtcagccgctggtaattcgtatgagaagattgagacaacgcccagcacttcgccaccttcacgacgcgttgcttcaacagcgcccaaaactgagccacctgttgaaatcaaatcatcgataagcacaaccttttgaccaactgttagttcaccttcgatttgcttaccagcaccgtgatccttcggctttgaacggacataaatcattggcaattctagttcagctgccacccaagctgcgtgtggaatgccggccgtggccacgccgccgataacttcgacttctgggtactcatgcttaattaaattagccaagcccttcgctatcaacttgcgaacctttgggaaagcgatcgtcttacggttatccgtataaattgggctcttcaaacctgatgcccacgtaaagggatcatttggttgtagcttaatggcctcgatatccaacaaggcttgagcaactgctgctttgtaatctgtcataagttttttctccgtcttaagcgttaaattctgtttcaataagttggtaagttgcaactggattagttgcctgcgtaattgaacggccaaccacaatcccatcagcgcccatttcggaagctcgtgctggtgtgacaacacggctttgatcaccaaccgcatccccagccaatcgaataccaggcgtaattgataagaagcccgctggcgtgttcgcgtgaatgtctgctgattcgaatgcagatgaaatggttcccgccacaccggcttgagcagcaagttgcgctaagtgaataaccgactcgcgcattgaaaccgtcacaagttgggtagtctgcatttcttcttcagaaaatgaggtcaattgcgtgatagctagcaacttaggtgccgttacgccaactgcgtctgccccttcttgtgcacccttcttagctgcttcaagcatacgcacaccacccgctgcatgaaccgtcaaataatccacgcctagtcgcgcaacatttttcgtcgcctgttgcactgtgtttggaatgtcgtatagtttcaaatcaagaaagacggtgaagccttgttccttcaatgcggtaaccaaggctggtccttcacggtagaacaattccatccctactttaacagctggacggacgctcgctggaaattgatccaagaacccccacatcgtttggacatctggaaaatccaaggcaataaatactggctttgtcattgtttaattgtctcccgggtgattagcttcccatgccgttagaggcgctgggaacttttgtagcgccgttggaatctcacgaactgacgcaaagttatattcgtctaaggccactggcagttcatcaactagcttgctgataaagagtgggtcttcggcattcatcgccccaatttgtacggcagatgcgccagctaacatcaactctagcgcatcgtccattgagcgtataccaccaacgccaatgattggaatatcaacaactgaagccgcttcccaaaccatacgcacagcgattgggtgaactgaagccccagaaataccacctgtaccgcgatatagacgaacttgtcgtgatgcaatatccaagctcatccccaccactgtgttaatcaacaccagtccatcagcaccagcggtctcaacagctttagcaatcggcttaatgtcggttacgtttggtgatagcttggcatagagtggcttatccgttacttcacgaaccgccgcaacaacttcagctgcgctatctggatcaactccgaattccatgcctcccttatcaacgtttgggcatgacaagttaagctccaatgccttaatgtaatcgaacttatcaaagacctttgccaaagtacaatactcagccactgactcgccagcgattgaaatcatcactggcaaatctggcaattgcgtttccaactcaggcagaatttcagttgctaccttatccatccctggattagccaacccaactgaattcatgatgccggcttgtgtattgataatccaaggttgcgggttaccacgacgttcatcaaccgttgttgtcttcaaaaccaacgcacccatcttgttcaaatcaaaatccttcatgtggtcaagcccgtaataaaaggaacctgatgacggcatgaacgggttcttcaaatccaaacctggtagttgtaccgcaaatcgatcttcagtcatgataaattctccctctttctatatgtatcccagccgtagccgggtattttatatctgttagtccattggcgtaacagcaaatgattgtgattccaaaacgctcaacaaggctgccactgtgtcgaatgccgtaaacaacggcaccgcattttcaatggctgcgttacgaatcaaacgaccgtctgacatcgtcgttccatcttgacgcgtggtattcacaacaatttgtagcttgccatcacgcattgccgtaacagcattgttatcagtttcgctaatcttatccaacacatcgacgcgcaaaccgttttgggcgaagaaagcacccgttcctgctgttgcaaccagttggaaaccaaggtcatcgaagcgacgtgccaaagctagtgcttcccccttgtcttcatcagcaaccgtgaataagacattaccaaatgttggcactttcacgttcgatgctacgaacgccttgtacaacgccttttcgaacgttgaatctgatcccatcacttctccagttgacttcatttctggtccaagcaatgagtcaacatctggcaacttcgtgaatgagaagattggagccttgacgtgaaccgtcttaggctcagggatgacccccgtttcaaagcccatgtcggccaatcgctcgccgagcatgacgcgcgttgctaattgtgccaacttcaagtgtgtcacctttgaaatgaatggcactgtacgtgaggcacgtggattaacttcgataacgtatgccgtatcttcatgaataacgaattggacgttcatcaaaccaactgtgttcattgcctttgccaagtcgattgacgcagccaccatttcatccttcaccttttgtgaaagcgtttgggctggataaactgacattgagtcacctgagtgaaccccggcacgctcgatgtgttccatgacaccaggaataatgactgtttctccgtctgacaaaacatcaacttccgcttctgaacccatcaagtacgagtcaatcaaaaccgggtgatcatttgacacttgcacagcacgacccatgtagtccgtcaattcgtctgggtttgtcacaatttccatggcgcgaccgcccaaaacgtatgatgggcgcacgaggactggataaccaacttcatccgctgcagccaatgcgccagccacagtcgtcgccgtcttaccaactggttgtggcaaaccaagttgcttaatcacttggtcaaactcttcacgatcttcggcacggtctagatccgcaaccgtcgttcccaaaatttgtacaccgtgctcagcaagtggtgcggccaagttaatcgccgtttgaccaccgaattgcacgacaacaccctttggttgctccaaatcaatcacgttcatcacgtcttccaacgtcaacggctcaaagtacaacttgtctgaaactgagaagtctgttgataccgtttcaggatttgaattcatgataatagcttcgtagcccgccgcttgaattgcctttaccgcatgcacggtcgcgtaatcgaactcaacaccttgcccgatacggattggacctgaacccaacacaaggacactttccttgcccgtcacaactgattcgttttgttgttcgtatgttgagtagtagtacggcgtttgtgattcaaactcagccgctaccgtatcaaccatcttgtagaccggttgcaatcccatcgttcgacgcatttcacgcacttcagcaactgtcttaccccagaagcctgcgattgtcttatctgcaaaaccgttacgctttgccaattcaagtgtgtcggcatccccaacgttttgcttcaatgcttgttcgagctcgaccaagtgcaagaccttatcaaggaagaagtagtcaatcttcgtgcggttgtgaatatcatcaatcgacacaccacgacggaacaagtcagcaatcatgaacaaacgatcatcacgtgctggcatcaaggcatctagcaaatctgcgtccgtcgtattatcaaacgtgatgtcattcaaacccgtcgccccaatttcaagtgaacgaacggccttgttcatggcttcctcgatgttacgaccgatagccatgacttcaccagttgccttcatttgcgttcccaaacgacggtcagctgaagcaaacttatcgaatggccagcgtggaatcttaacgattacgtagtccaaagctggctcgaactcagccatcgtcgtacccgttactgggttaatgatttcgtccaacgtcaagcccaccgcaatcttcgctgccatcttggcaattggataacctgttgcctttgaagccaaagcagatgaacgagatacacgtgggttaacttcgataatgtagtacttaaatgactcaggatccaaagccatttggatgttaaccccaccctcaattttcaaggcgcggataatcttcaaggctgcgtcacgcatcatttgtagctcgcggtcagccaacgtttgtactggcgctaccacgattgaatcacccgtgtgaatcccaactggatcaaagttttccattgaagccacaatcaaggcgttgtcagcggcatcacgcatcacttcgaattcaatttccttgaaaccggcgattgaacgttcaatcaacacttgcgttactggtgacaattccaacccgttcgctgaaatttcaaccaattgtgcgtgatcgttggcgataccaccaccagttccacctagcgtgtaggccggacggacaatcactgggtaaccgtgctcgtcggcaaacgccaccgcttcttcaactgtcgtagcaatcgtagactctggtactggttcgttcaaacgatccatcaagtccttaaactcctcacgatcttcagcttcttggatagctgatagcttcgttcccagcaattcgatgtttaactcggccaagataccagcttcagacaaatccttagccatgttcaaaccagtttgaccacccagcgttggtacgatggcatcaggacgttccttgcgcaaaatgcgttccaagaattccaatgacaatggctcgatgtagaccttatctgccatctcagtgtccgtcatgattgtggctgggtttgagttaaccaaaaccacttcatagccttcttctttcaatgacatcgcagcttgcgtgcctgagtaatcaaactcagctgcttgtccaataacgattggtcctgaaccaataaccaaaaccttcttaatgtcctcgcgcttaggcatgtgacgcccccttcttctcttcagcaatcatctccaaaaattggtcaaacaaatactcggcatcgtgtggaccaggcgcagcatctgggtggaattgcactgagaatgctgggcggttcttcaaacgaacgccttcaacggtgtggtcgttaatttcttcgtgtgtgatttcaaggttcgtgccaacaattgattcagctgaaacggcgtacccgtggttttgtgacgtgaagtcaacacgaccattcgtaaagttgcgcaccgcgtggttaaaaccacggtgaccaaacttcaacttgtacgtttctgccccgttagcgagtgagaatagttggtgacccaagcaaattcccatcaatggcaagcggtcttgcaacgtacgaatgacatctaagacaccttcaactgattcaggatcaccaggtccatttgaaagcaacacgccatctggattcatatccaagattgtcttggcatcaacatccgctgggaataccatgacattcaccccgcgcttagacaaggcgcgcagaattgagttcttcaagccgaaatcaatcatcgcaattgaaaccccttcggttgggttcacataggtagtcttcgtcgttacttcggcaacttgttggtttgacaattgtgttgcttgcaagtcagcaaccgttgtctccgttacttcgtccacaatcgttgccttcataacaccataatcacgaagttccttcgtcaaagcacgtgtatcaatgcccgtcaaacctggcaaatccattgcttcggcccattccgcaattgacatttgtgaacgccagttcgatggacgacgggcaatttcgtgcgtgacaatcgccgatgcggcaggcttcaatgattcgaaatcatcgcggttaatcccgtagttaccaatcaatgggtacgtaaacgtcaaaatttgaccgtgataagacaagtcagtaattgattcctggtagcctgacatgcctgtgttaaaaaccaattctccaacgaccggcttcaatgatccgaacccctcgccggcatacactgaaccattttccaaaaccagatagcgcttcatgttcttccccttatgcttcataaacaacgttaccggcaacgaccgtcaacactgtttgtccgtaaattgtttccccgataaatggtgtattcacaccctttgatacaaattcatctgctgtaatcgtgtgtgccgtttccaaatcgaacaaggccaaatccgcgatttcgccgacagctagcgtcgttggcgctgccaaattaaaggccttagccggttgtgtaatcatccagtttagcaactgctccaaactagcaatgcctggcttaaccaaatgcgtgtatagcaattggaaacttgtttcgataccggtaatgccaaaggcggccccgacaaatgaacgttccttctcttcgacgctgtgtggcgcgtggtcagtcgcaaccatatcaatcgtgccgtctagcaatccagcaatcaccgcagcgcgatcttctggtgcacgtagcggtgggttcatcttaaacaaggcgttgtcaccgtcaatgtcattttcgtccaacaacaagtggtgtggtgaaacttccgctgtcaccttcacgcccatttgctttcccatacgcaccaaggcaactgactccttcgttgacaggtgtgccacgtggtaatgtacaccggcagccttggccaataccaagtcacgtgcgagttgcgatgattcagccaatgggtcaatccctggcaacccaagttcttctgagcgcttaccaaggttcatcaccccaccgttcatcaaagactcatcttccaagtgcgccactaatggtcggtcaactgctgctgctgccttcatcgccgttagcattgttgctgccgtttgaacacccttaccatcgttcgtgaaggcaaccgcgccggcatcagccaatgcttgaatatcgctcacatcatctgacgtcaaaccttctgaaattgcggcatattgttcgatattcaccacaccatcagtcgaattcttagcttgaacttgttggaatgctgcaaccgttgctggtaccggattcaagttgggcattgccgcgaccgtcgtaaatccgccacgtgctgaagcctttgagccagttgcaattgtttccttatattcaaagcctggctcacggaagtggacgtgaatatcaaccaagcctggcgttagcaacgctccctttgcgtcaatcacgcggtcagcttgtgcatccaaaaccacatcaatcgctgcaattttgccatcttcaaccaagacgtcttggttaatcaattcatcatcatgtgacacaacttgtgcgttcttaattagcaaacttgccatgttaattctcctcagttaaagcgttcaaaatcgccatgcgggcgtaaaccccgtttgtcatttgttggaagatgcgtgacttgcttgcctcaaccaattgatccgcaatttcgaccccgcgattaactggcgctgggtgcatcacgattgctgaatctttcaaagtgttatagcgttcctcagttagcccgtattcaaagtggtacgtaatcggtgaaaagtcagcattttcaacggtcgcgatgcgttcatgttgcacacgtagcaacatcaccacgtccaagtcggctaaatcatcatcaaacgtcgtatacgtaccgaattggtcgaaatcagccgggtaccagtcttctggaccagcaaatgaaaccgttgcaccaagtcgttgcaaaatttcagcatttgaacgtgccacgcgtgagtgtgataagtccccaacaatgcgaaccttcaacccttcgaacataccaaactcttcatagatagtgaccaaatctaacaagctttgtgatgggtgttggccattaccgtcaccagcgttaacaagttgtggcatgtaaggtgttgcttccttaatcaatggcgcataccagtcattaatcttgtggcgcagtaccacaacgcttaccccgattgccccgagcgtcttaagtgtgtcgctcaagctctctcctttttgggtcgagctggtttgtgggtcgatcatgacttggtgccaacccaggttcgtttcggcaacctggaaactcgaatgtgtacgagttgaattctcaaaaaatagattggcgaccaatcgatttgactgtttaacatcttttgatccgttcttataagccaacgcatcctcaatcaaagtcataatcgtctcggttggtaaatcgttcaagttaacaaaatgccgcatgtgccactccttttctgcaataaaaaagcctcgtgaatccagtgattcacgaggctgtgcttctgattagtctggtggtagtccttccccatgcgagtgttgaatttcccctgtacccctaatcaacgcaaccctttgtagcctcacgggactaaaaatttaaaaggttatttgttgttgaaaatactatagcacgggcatttcatgacgtaaatatgactttttaccaatcaaaatttcataaaacgtttaacgtgttgctatgatagggttcttgtttttattacagtttaattacattttactaattgggttaaacacttctttttgtttagttaaatggaggtagtggtgtgtgtccgtcctatcggccggagtgcttggctccttctgaggtacgtgtctatacgcgtggcagggccaagcacagcagctgagtaatactctatttgtgtttgatctacatccaccgaaatactgcgaggtgaaactgttcacctatttaattcgcggtagatgatcatctaagacagactagaacatcttggttgctggcatgggatttggttggggtggcggtgcggagctcctgcgatattagccggtgaccaagcaaggacaggagcaccaattatcacttagcagcagtggatttcaagccggcaggcgcggaaatacgctgaggcttagggagaatgggactccgttgccaccagcttatattgtaggacggagcaccgcctccccaaccaaatcccatgcctcggcgcgatagcgacgacacacactactaaaacgaaaaacaccacaacccgaagattgcagtgtttgtgattagctaatttgtgcttcttgttcacgggccataaagacgtcgtcgttgacgcggatcatgtgtccacgcaattggaactcttcaacaccctttgagataaacttggtcaattgcatcttaccaacgtggaggtacgcagctagttcagcttgcgtgcggaaacggtgttcaccgtcgacttcataacgccactcgttggctgctttttgccattgttcatgtgcccatgccacgacttcagggtgatccaaatcaccaccatacttggccgcgcgcttcatcatctcaggaatccaattcatgtctccacctctcactttctatctcttcttttttcacagtagctgttggtctaaaacccctgacttcagtcaggcgcaagaccaaagacgcacctgataagggcgacttggtcacgtcggaggtcaaaaacctccgacattctcagtctgctttatcgtttgccccttggctatgaactaagattatgacataagtgcgggtatcaacccaaaagtgccagaattgacacaaatatcgcaactttttttattcgtcaagcgaatcgttttgcatttgcgcaattccggtaatcaaattgaagtgatgacgaagcgtatcggcgatgaaattccgttcgtttttaaatagctgattccccgttaggtgctgatagtcgcagacaaagtcctcgaacgcggctaaaccgacttcgggataatcgaagaacatttgataaactcggtaaacatctaggcgccagcgccacgttgcaaatgtgaagatacgtgggtcacgttgaacctcaccttctgcaatctttaggatgcgatcaaaggcttcacgattgtcttcaagtaagtacttcagcaacacaaactcagcattatttagaactgagctaatcggcgcgcggaaaacctggcgattgtgcatatactcatccgcaattccgagtcgcttaatgatgaggtcgacattatccaaatcaacaaacgaataggtaaccaggcggtgttccgcttcgtgccattcatccaaatgtagcaagtattccgtaatcgtttttgccaagtcgatttggataatactcgtcggatcaaaatcagacaactgttgattcacatagacttgaaactctaacgccgtttcataatcagcatgattaccagtccgaccgtactctgctagcgcttgttcagccactgtttgatagtcatatggattaacatcgaaggccgcaaaacgattcttagcctttgaattcggattcacctggaaaaacacggttaaatccgctggcagcaatcgcaggtacctcatcatatcaaacaagtcttccaaacgaatcgctacttcctggtgaataattcggtacaacttagaccgcgtgaccccgtactgcgttaattcactactattgatatgttttcccttaatcaaataacgcaaggcaactccaaaactatctggcatttccgccttaggtaagtcatcgtacgttgttgaaaacatgcttggggcatcgtgcttcatgtggtgtcgcttcattgtaagtgcttgccagagtccagggaatgacatggtgtcatatgtcattcggacttcctgacttcctcgcttaacagccactgcaatccactctgcaaattgacgttcagccgctggactgttttcaatgtaatacgacttcagcatcttcgcgaattggcgtagcataaacagttcaacattggatggtcgcgcaggttgattgataatggcatccaacacaaataacatcgtcggcagtgactttagggttggacgcatcaagtgtacgagcgcgtaataatgaatacgcaaaatcgttaggtagattggcatcggcatgtagccggcgaatatcccaatactcttagtgaaaatctcgtacattcgatagaatcttttcggggtcagcttatcagcgataatcgaaaagagttgaatttcaaagaacgtgaacaactggtaatccttcagttcttcatatatcgccgtcacgaatggcttacagtccacttcctgcttatgcgcaatcaaatactgaaacgctaaattgtattggaaatacgccaccaactgggttcgttgatatttttcccacaaggctttttggtaaacctctagttcggttaacgtcaaatcgcgagcacgcagtaaattcaaagtgaacggcgcttgaaccacatcagtatccacaactaattcggcaaatgaaatcgtcagcacatccatcaaaatctgcagatcactgattgccaaatcacgttcgccgcgaataaaggcaaaatatttacttttcgaaatcccgttatccacaattgtttggacagaaacgttcttgtttttacgaatttcattaattcgttcagcaatcatctgcgtcatggtggctgctcctttcatcatttccttcatgatacccacaaactatgaaaaaagcgggcgattttgtctcatttttgatactttccgttaaataggactgtcgcccaactatactaataacatcaagagaaaagagatgaggattttcatgaagaatttgatgccaaactggatgttgacacaaatgcctgccactacgcgtgcagcctacgaagcacacgttgagacgactaagaaagccttgaagaagtagcaaaaacgacccacacagatttgtgtgggtcgttttttaggctaagccgtaactatcactaatgtcgttaagcaacacttgatagcgtgacgtgataaacggcttacccgtcagcatgtgataatccgaaaagaagcgctctaactggcgcatcgcttcaactggatcatcgaaaaatgtcgcatacaaattattaattgccatgcgtgttcgccaatttgcccactgcataattttgctgtcgccagctgcagcgcggttcataaccgtcaaaattttgtcaaagcgggtttgatctcgcttaagcaacgcctgaatcaaaaccggctccaagtcatgcaacaccacattaagtggcgtccggaagatatctcgattttccacgtgacgactcaaaaacaatgcgcgatagatgacgtcctcgatatcttcgcaatcaagcatcgcccaacgtgcgacacgatggtccgcttcctgccaaacctgcaagctatcaagatacccctgcacatcccgcgctaactgggcggcatcatctgataacaaccatttatcaatcagatgttggcccgctaaaccacgatacgtaaaactatttaacaagtgacgtgggttttcagtgcgctcatacgcatcttcttccgtttgaatcatcatcttgaagtcttcagctgtgcaagccgcaaatgaatcgttccagtctacgcctggcgttcgtaccgtcaacttcgcatataccgtgatatctgtcggctcaacacgcagaatatgcatcatcttaagcatttccgtgagcgtcattaattctggctggtcaacaatcatgtctaatcgttgctttgaaatgccgaaactcagcaattcatcttttgaaatccccttcaccatgcagatgtctgccacgctatcacgaatattttcattcaacgacacaaacgtttggtcttcatacggcttggtaaataagcttttaccatcattcttcaagtggtggcgctttgacgtgaccacttgccaaatacctgctaagtcgaacgtcatttcaccaaacgacatcaacgcaacctgtcgtcgctgtgcggcctcaatgaatattctaaattcattagctgcatgaactggattaccaaagaaatattcttccagcagttctgcataatgagccagcatacgcaattctaagttaccagcattattgggttgctttgaaatcgcatgcaaaacgaaacgcatcgtctcaactgaattcactgaatcatgaatcaacaacaccaacgcgcgataatgaacgcgcaaaactagttcaccaacccgttgcggaatataacttgtgaactctgggacactacgaataaagatttcatataatgggtagaattccgacgcccgtaataccggtgcaagttgcgagaacacctgcatttcaaaatgggtgaacatctgataacgagacaattcacccaacaacgcgtctagtggctcgcgatacgacacttgcacacgtcgcttatacaaaacatcgaacgtcaaggcgattagatggaagcccttgtaaccagtatttcgatactcttgttccgtcttattacgtttctgcgccagctcctcagccgacatcgtttgggccccgtctagttgcaccccatgggtgtcatcccattcatcagtatccatccagagttctgcaaatgacatcgttaacaaatcaagcatggtcgtgatttccccaagcgtaatgttgtcattgctgtgtacgaactggcgatagcgatcagccgaaataccgtttagcgcaatcgtttcaagtgaaacatgcttggcatttcgaaccgtatttagtttttcaacaattgttgccaagatgcacacctcccccaaggtttaagttctttaaggatattgtaactgcacaaaaaaagcaacaatcgcactggattgttgcttaattggtttattaactaacctgattttcagtgaggattttctgaatgatttcatccatctctggtgtcttcgtccattcagtgtattccttgatggctaccatctctggaatttcaaaattctcatttacatacttttcatacttttcaacgttacctgagtgcgggatattaatcttaagaatgcggacactcttaatcatcccctgctcagccgcgtactcagcttgaccattatgcaatagatttccaatttctttgtaggtcgagccatcattacgcgtaatttcttcaatgatatcaagcgtttgatactctgcagccattattagtctaccccaacttctttacgaacaaccgctacaatacggtcaacgtactcaccaacaagttcttccgtttgggcttcagccataacacgcaacaaatcttgcgtacctgaagggcgaacaaggacgcgaccattgtcacccatctcggcttcgacttcagcaatcacttgcttgattgcttcgttttccaaggcagctttcttgtcttgtaccttcacgttaaccaacttttgtgggtacaccgtcatctcagcagcaagctctgacaacttcttacccgttgacttcatcacgtgcaacaattgcaaagccgtcaacataccgtcaccagtcgttgaccagtccaagaagaccacgtgacctgattgctcaccacctaggttgtaacctgacctcaacatctcttcaacaacgtaacgatcaccaacggccgtcttaacagatgaaatgttgtgctcagccattgccttgtacataccgatgtttgacataaccgtcgtcacaatggtgtcttgcttcaagcgaccatgttctgacaagtacttacccgtgatgaacataaccttgtcaccatcaacaatgtcaccgttctcatcaacggcaatcaatcggtcaccgtcaccgtcaaaagccaacccaacttgggcaccgttttcaaccgtgaacttagcaattgcttcaggatgcgttgaaccaacacccttgttgatgttcaacccgtctggtgatgttgccatcgttacaaaatcagcccccatatcggcaaacaagtttgcgacaaggcctgacgttgcaccgttagcagcatcgatagcaatgttcatgccatccaaactatcaggaatcgtcgtttgcaagtactcaaggtacttagcagccccttctgggaagtcagagacagttcccagaccttcagcagctggacgaggcaacgtatcttctggcgcatccaacaacgcttcaatttcagcttccaattcgtctgacaacttgaaaccatcagcaccaaagaacttgataccgttgtcttcagcaggattgtgcgatgccgtgatttgtgcaccagcatcagcctgttgtgcacgaaccaagtaagcaacacctggcgttgaaataacgttcaaacgcaaaatttcgataccgacagaaagcaaaccagcaatcaatgcatgttcaagcatttgaccagacatacgtgtatcacgtcctactaacacacgtgggcgacgtccttcagcgtggcgcgtcaacaccgcaccacccattcgtcctagtcgaaaagccaactcaggcgttagctccttgttcgcaattccacgaaccccatccgttccaaagtaatgtaattcaaccatgtcttaattctgctccttcggcgtaattgtaattgttactgtcgttggatcaacgctgtctgtaccttctggcgtgttaacagtaatcgtctgtgatgacgcacttgttacgccagacaaatcaacagtaactggaatttcctttattttgttcaatacatcaatcttaccacgaaccgtgatttcgttcaccgagcccgtaagatcgaagttatcggcattgccgttctttgttttaatggccaccggcacttgcttcgttcccgtaccagcagaaaccggaatcttaaccgttgtcacttgtggtgaaatcgcaacatctaccacgtgtccattcgcatcaagcgcttgtaggttaacttcctgtgagacagatttctttgtatcgcgttgcaaattaactgcagcgacaacacttgcaactgaatcaatcgcactttgacgacccatcaattggacgttgttgactgaagatgtcaccgtaccaactgtgtaaccatcagcgatggcgtccttattatagtccgtgtgaacggtgtaataagctgacgtacgcttgtagatggtaatcgtcaatttttgcttggctagcttatacgtcaaatcgcgattcaatcccgataccttcaaagcaaccgtgtgctcaccatcggtcaactttttcaaatccgcatagacttgaaagttctttgtgttcttagcagccgtcacgagagccgatgaaccggttaacgtgacatcaaccgtatccggcaccccattaatataataatcatcagtatcaatgcccgtcaattgcactggcactgctacagtctccgttttagaggataccatgcccttaaggagacccgtcgtcgactcgctcgtcgcagtcttcgtacgcgttgtcccatttgattgtccgtcggcgtaagctgacatcaagatggcaacaagcaaagtcgcaacaacatagacaattttgtcatatccttttttcatgttacttctcacctcgcttaccaaatggcatcacgcgtgaccaccatgtctgcttgacatccccatcagctggtaccaactgacgcgttaagtacttgcggtaatcttcgcgagacagcgattgcatcaattccgcattacgcgtgattgacacatcccctgtttcttccgacacaacaatcgtgagggcatccgtcacttcggaaatccccactgaggcacggtgacgagttcctaattccttgggaatcgttgggttatcagacaacggcaagtatgctgccgccgctgccaatcgcgcgtccttaatgataaccgccccatcgtgcaacggtgtattcgggataaacgtgttaatcaacaattggcttgaaacttcagcatcaattttgatacctgtttcaatgtattcttccaacccagtctccatttcaattgaaatcagcgcaccaatatgacgctttgacatgtattgaatggcatcatccaactcattaatcaaacgcgtttcttgctggtatgcctgcttttgcttgaataaagctgagcgtcccaagtgttccaaaccacgacggatttcaggttggaacacaacaaccaaagcaataactccccaattaatgatttgatcagtcaaccaggaaatggtcgtcaaaccaacgtaccaactaattagcttgaccgcgataacgataccaacaccacgtagcaacgtgacggctttcgtgccgcgaatcaacatcatcaagcggtacaacagccaccaaacgatgacaatatcgataatccggacgacgctaatagtctttatgagtgactcaaaatcaatgttcataacgtcccctattcttcttcatcagtcaacataccagcttcagcaaaattaatcatttgacgaatcttcaacccagtttctgctgagataaagtgggcatcgtacaaatgttgcgtcgcttcacgctgggcgttcaacccagaaacttccaaatccatgcgaacaagcgcttcttgttgtggaccaccatggtcatgcttctcatgctcaaggcgtgaacggtacgtaataatcaaattataagctgccgtttgatccgtcttagaagcttgacctgcctcactctcaaggtaatctgagatagccgcaatcgcttccttggcggcttcgtgacgagcaaccctgtattccgcaatcaaacgatcagacgaatcgtcgcttaaccaaacacgaattgatcgacgagtcatgaccacgaaacgcttaagttggcgccatgtgcgcttacgcttatcgtgcgtcaccaaatcatccaagtcggcttccatacgatcaatacggcggttttcactggcaaataccaatggtgtaatgcgttcgtcaactaacaacttacgtagcgcactgcgctcggcatccaaggcaagcgcacgtaggttaatttcggccttcaaaattggactcaacttgtccgccttcataaagcgcatctgcaactgacgaatttgcatttggtaacgcaaaattatttcgtaagcaatcgcttgatttgactcgcgacgacgcgtttcaatttcacgaaccgctgattgcaacacataaacacgcgcacgtgcttcagacatgtgctgggctacaaccggatgtgcttccgtatcaccaggtggcacttgggtctttggcttttcagccaatagtggcaagaagataacggctgccaatagcgaaatgataatcgcaattgcagcgatgaatagcatcaatgaacgttgtgggaacggtaagcctgagtccgtcatcaaaggcacagacaacacaccggccatcgttacggcaccacggacacctgacaaacctgacaacaatgccacacgccaagaagcggtttcatttttgtggttcttcaagcgaacccattggttaatgtatgtccaaatcacacgcataccgaagatgactaaccaagtaatgactgcgtatagcaacgccattggtaatgacactgaatttcctaggttcgtcgccaatggcaattcaattcccagaatgacgaaaatataaccattcaagaggtaaccaaacacgttccaggtgttaatacccaccacgtgcagttcaccagaataatcggcgtcgttttgtgtatgcaaattctgaacaatagcagccaccacgaccgcgataacgccggatgtgtgtagctcttccgccaacagataaactaagaacggtgtgaacagctgaagcaccacgcggaaaacaacgtcagtattaccatgagctgataaccaatcgcccaaagtattcaatgcaaatcccaataccagtccaacaaccgttcccatcaacgagatgtaaaggaaattagatgtggcggcaaatagtgagaatgtcccagctgacgcagcggcgacagcaaatttaaatcccaccaaaccactggcgtcgttaatcaaactttcaccggcaaccaagtgcatgattgatggtggcaatttagcttgcttcgcaatcgctgccacagccaccggatcagttggtgataagatggcggcgatggccaaagcaaccggcaatggcagctccggtaccaacgcataaatgataaatccgcctaaaattgttgtaataaagactaataagatggcatttccgaaaatggctccgcgaagctcccaaagttctttctttggaaagcgccaagcatcggaatacaaaagtggtgcaataaacagcaacaagaaccattctgtctctaactcaacgtgtagatttaaaaacaaagcggccagcagacccaaagcgatttggatcaagctgaccggcacacgtttgaggaagtgagacaaaatattactaatgaccaccaatgacgttaatgccactatggtttgtaatagctccataaatcctcccctaattcaattacaaattacaatcccaaaatacgcacttcagtttccaaatcaacgccaaacttttccttgacgactgattgcacgtgcttaatcacgttgatgtaatctgagccggttgcatccccacgattaacaatgaaacctgcgtgctttgttgacacttgtgcgccaccaatttggaagccttgcaagccagcatccataatcagctttccagcaaagtaaccttctggacgcttgaaaacagatccgcaagatgggaactccaaaggttgcttacttgctcgcttttggttgaagtcttccatcttggcctcaatttcagccccatcgcctggctccaacttgaacgtcgcagccaaaataacatcacctgtttcttgcactaaactgtgtcggtatgcaaaagacaattcttcgtttgtgtacgtcttaatttcgccagttggcgtcatcacatcagctgattcaagccattcatcaacttgaccaccataagcaccagcattcatgtagacggcacccccgacagaaccaggaatacctgcggcccactcgatacctgacaaatcatgctcgcgcgcaacttgcgtcacatcgatgatggcagcaccggcatgcgccttaatgcgtgtaccagatacggcgatgtcggtcatcttagttaagaaaataaccaagcctaccaagccggcatccgtaataatcaagttagacgcatttccaagcaccgttactggcatttcattatcattggcatacaacaagacatcacgtaattcttcatcatcatgtggccagaaagcccattcggcatttccaccaacacgcgtgttcgtgtaagctgacaaatcaacgttttgatgaatttctagccccggaaaggccgtctttagttgtgttgtcattactctttctccgctaaataacttttactaattgtttcaatggatcaacaccaaactgctcagcttgcgtcactaagatgcgcgccgctgcaaccgtatcatccaaagcgttgtggtggtgttccaaatcaatattcagggctgctgcaactgtattcagcttgtgatttggtagctgtggatacaacttgcgtgaagtacgcaccgtgtcgagtgacaaataatgcggtgctgaaataccgtagtgtcctaacgtctcacgcaaaacaccgttatcgaatggcgcattgtgtgcaatcaccaattgattaggcgtataaaattgcttgatgtgatcccagaccgctggaaacttaggtgcatccgcaacatccgcctcagtaatcccgtgaatcttggtattacgcgcatcgaaatacgattctggcttaattaacgtataaaattcatcaacgagtacattgtcgcgcaccaccacaagtgccattgaaacggcactatgacgctgtgcactcgctgtttcaaagtccattgcgacaaaattcatgttatctattcctcaattgttagtttgtaatatcaagcatcatatcaaaggctgcaactggtttacctgcgccatcaagaacaatcgcgtcagaaccagccactcgctcaaagccaaacttttcataaatgtgaatggctggtgcgttatgcgcttgaacggtcaaacgaataatgtcgactgagctatactcagttgcccaatctagcatctcggcgatcagtgcttgcgccaaaccaaagccttgataagcttcaagcaccgcgacaccaacttccacttcacgtgggtgatttggtagcgcagcagccgaaatgatgccaaataggtcaccttcatcactcgccgccaacaaaataatattgttggtcgtcgattgcaagtaactaatgttatccgcctcggtcacatcatcaatcttgcccaagtcttgggccaccataaaggttgttgattcagattgtaattgatgcaacaacgccaacattggcttggcatcttgaccttcagccggtctaatcatgacatccattacgcttctccttcgatagctgctaaaagctcctggctacgaggtccgtttgcactaaccgtaattgttctttggtttcccgttgtatctgatgcaacccgatccaaatcaattgttagcacgtcagttggtagctcagattggataaactctgaccattcaatcagtgcgacaccctcaccaccaaagtattcatctaagcctaattcttcagctccaccttcttcgcctagacgataaacatctaagtggtacagtgggaaattttctgtttgatattcacgtaccaatgtaaacgtcggactcttcaaagggcgcttaataccaagcgctctagcaaatccttgggtaaatgttgtttttccagcaccaaggtcaccatttaataagattgtgtcccctggttggacattggccgctagtttagcagccaatgcttgtgtttcttctactgtattcactgctaatctcatagctataagtataccatttttgacagacagattacaggcgaaaaaggaagccgtttcccattagcgggactgcatttttaggagtttctctcgccaatttggaaataaaaaaactcacggaccaatcgatccatgagttcattttcaatcattaattaggccattgcttgggctgctgtgatgatggctaccttgtagacatcttcttcgttagcaccacgtgacaagtctgagattggctttgccaaaccttgcaaaacaggtccgatagcttcgaaaccacccaaacgttgtgcaatcttgtaaccaatgttacctgattgcaagtctgggaatacgaagacattagcgtgaccagcaacttctgattctggggccttagcagcagcaactgactcaacaaaggcagcgtcaaattgcaattcaccgtcaatagccaactcaggggcagccgtcttagccaacaacgttgcttcggcaaccttatcaacttgtggtgccttagctgaacccttcgttgagaagctcaacatagcaaccttagggtcgatgccgaagaccttagccgtgttagctgattggatagcaatttcagccatcgtttgtgcgtcgatgtcgatgttgatagcagcatcggcaaagatgtaacgctcgtcatcgcgttgcataacgaacgcacctgagatacgtgatgaacctggtgcagtcttgatgatttgcaaagcaggacgcacagtgtcaccagttgggtgagttgcacctgaaaccataccgtcagcaaccccaaggtataccaacatcgttccgaagtagtttacgtcttccaaccactttgaagcagtcgctgcgtccgtcttaccgttacgacgctcaaccaatgcatcaaccatcttctcacgggcgtcagctggatactcagctgggtccacgatttgaacacctgacaagtcgaagttgtttgctgctgcagtcgcttcgatttcagccttgttacccaacaaaattggctttaccaattcttcggcagccaaacgaatcgctgcgccttggatacgtacgtcttccccttcagggaataccaacgtcttaccttgacccttaatttgtgatgacaattgttcaaagagttccatgatggaaaacctccacttttaaaatcgttatttatcttacaaaatctattattacaaataatcagcctatttactagtgaaaaggagaaaatattgtgatttttttcacatcacacccaattaattggttttacgccgttatcacgcagaaaggtatttgtttgactaaatggttttgacccgaaaaagccacgataagctgacagggggcttgggtgcggtgcctgcaaaatcaagttgtgttcaccaacaatcagtttgcgcttcgcctgggcctgcttcccccacagaataaagactgttggttgcgcttgtttagcaactaatgaaataatcgcatcggtcaacggttcccagatttgccctgcgtgcccaccagcttggtgagctggcacagtgagcaccgtgtttaacagtaacaccccctggtctgcccaacgatgcaaatcaccatccatcggcgtgcccgcttgcaaatcatcagctagttctcgataaatgtttaccaacgactttggcaagcccatgtccgccggtactgaaaaactcagcccctgtgcttgacctggattcggatagggatcttggccaagaatcaccacttttacatcagccaaaggcgttgcaacaagtgctgcaaagacatttggcaaagctggatacacttcaccgtgcccataaacatccttcaaaaaaattgccactcgttcccaatattcaggccccatagcagtttgcaacggtgcccaccaatctgtttttgataatttctccatgttaatcaccgcttttcttttgcgaattctatataatagtcataaggaggactttgggatgcgtcaattacgattaacacaagttacccactcggcaaccggcatgagtcttgtaacagacgctaccggagccatcgcttattatattaccggagaaatgggtcaaaaaggaaatacacttcgaatacttaatcaaagcgcaacggtcttagctgagcttgaacaagcatcgctgggtttcctaccccgctttacaatgacagtaaacggccagcaagttggttcaattggtctatcgttacagttacacgaaatatcattcgtgagcggtttaaattggctcattctaggtaatctggataaacaaaaattccaaatcacgcacctgcatcatcaattagccatcacccaaccaaacaacgatggtcgcttagctattaccatctatgatgaaccaaatgaagcacaactggttttgattgccgccttcttggatcgttggcaattcattgccagtggtcggacggctccttggctctcgttcttcgcaacaccgcaacgcctactcgggtcttcttacgaattacatcccgagttgccaggtcaatcacagtctgatagactggaatcatcaattaaatcgcattaaaaagtttgctagggttccgcacgcagtggtctggtccaagagcaaacgcgtgcctcgcacgtacacggaaggataaaagcctgggagttaacgacaaatgtgccgctaacttccaggcttttcttattttaatgcgtcaaggagatttatatgaaattatcaaacccctggctaaaagttgccgcagcggttgtcttagaaccgatgtgggtacttggtatgaagcattctgacagttggccaatgtacctactgacagccgcctcacttattctgtcattcttcatgattttgaaggccagtgatgagttacccgtcggcactgtttacgccatctttgttggccttggcacggccgccacgattgttgcgaactggatgttctatggcgaagctatgaacgccatccaactatcactgattgccgttttgttattcggtgtcattggattgaagcttatggaggatgcctaatatgtcttggttatttattattatcgccggtcttggtgaaacaagcggtgttgtcatgatgaacgaatggcaccgtcgccgtcactggggggccattgtcggattgctactcagcttcggctttagtttgtcattcctatcactcggcattcgtgatattccactaggaactgcctacgctgtttggacaggtattggaaccgttggtggtaccctagtcggcatgctcttctacggcgagtcccgcgactggaagcgtatcttattctttgctttgattcttgcagctgcagttgggttgaagttgactgagtaaccttttcaaaactaaaaaccgcgtacccaccaaacttagtggatacgcggttttttatttacgcttaaacattcaagaccttgtccaagaattccttcgtacggtcatcttgtgggttgttgaatacttcttctggtgtgccttcttcacgaatataaccatccgcaaagaatacaacccgatccgcaacttgcttggcaaagcccatttcgtgggtcacgacaatcatcgtcatcccctcttcagcaagttccttcataacacccaacacatccccaaccatttctgggtcaagggctgatgttggttcgtcaaacaacataatcttaggattcatcgccaacgcacgggcaatcgcaacacgttgcttttgtccacctgacaatgtattcggcttaacatctgccttgtctgccaagccaacacgggccaacaacgcacgggctgtttcttctgcttcagcctttgtttgaccagccacttcaaccggtgccaacatcatgttttgcaaaaccgtcaagtgggggaataggttaaagtgttggaacaccatcccaatcgtttcacgggtcttatcgatgttgttctttggatccaccaagtcccaaccattaatcttgatttgaccagaattaatttcttctagcttgtttagtgaacgcaagaaagttgacttacctgaaccagaaggtccaatcataaccacaacttcgccttcttcaacgtccaaactaatgccctttaggacttcgtttttaccgtaactcttgtggacatctttaacttcaacaatcgctgccattagttaatcctcttttctacccagttagataaccacgtcaacaacgtgatgacaatcaagtacaaaacggcaatcatcaaccaaaccttgaatccttgcaaattacgcgcaatgatcaacgttccagtttgtgtcaattcgataataccgattgctgacaagattgatgtatccttcaacgtaatgatgaattggttaatgaaacttggaatcgtcaaacgaattccttgtggcatcacaaccttacgcattgccttaccatatggcattcccaatgaacgggcagcttccaattgaccagggtcaactgacttaaatccaccacgcacaaacgcaccaatgtaggccccttcattcaaaatcaacgtaatcacaccagccgtaaacgctggaatcttttgacccgtcaagttaggaattccgatgtaaataaagaatgccaaaactagcattggtaggccacggaagatgtaaataatcgttgatgagataccacggaccaacttacttggcgcaacacccatcacacccaacaagacaccccagatggcagccaaaacgataccaacaactgttagttgcaacgtcttaatcaaaccatccaacaaggcggccttgttttcttgaatcaatgaccaaattgattggtcggcagctgacttagcagccgcgttttccttgtagttgtagccaccttcaccaaggtaacggttaacaatcttatcgtaggttccgtccttaacaatcttggcataaccttcgttgaacttcttcaacaactcagcgttatcacccttcttaacaccaaaaccgtaccagtttccatcagctggatccgtcacgattttcatctttgtaccttgttgaatggcataggccataacgggttgatcttcaaacgcggccactgtgttaccaatgataacgtcattgtacatcgtgtttgagtcattgaagtacgtaatcttaaagtcgtacttcttagccatgcgttgtgcatacatcgcacctgaactaccagtcttagctgccacagtcttgcccttcaagtcatccaatgagtccaccttagacttgttggcaaccgccataacgataccactcttgtagtatggtgttccgaaatcaaacgtttgcttacgttcatctgtaattgacataccggccaagataccatcgacttgaccagcttgcaccgcctgcacaccagcgttgaaactcattggcttcaacgtgtaagtaaagtcctcgcgcttcgcaatttccttcagcatatccatatcgataccacggtagtcaccaccttgagtttggaactcaaatggtgggaatgtcgtatcggtcgtaattgtgtagtgtgatgatgcagcatgtgcgtttggtacccctgctaccatccccactattgatgccgcaagcaccatgaggccaacgagccatttacgcattacacaatcctcctctagtcataattttgtatcccatttcctcttatgctacaccaaaccgattttttaatgttgtacgatgtcagtttttctgacataccggatgattatacacaaaaaggagcgaattctggtggaattcgctccttttgcttagcggacttttaaactgcgacgcaaatcgcggtcttgatcacgctttttaattgtttcacgcttatcgtaattgtgcttaccagtcgcaacgccaattagtaccttggcgaaaccgtgcttcaagtaaacgcgcaatggcacaattgttttaccttgttgtgccgtagcctcacctagcgccttgatttcttttttgtgcaacaacaatcgacgactacgcaagggttcgtgattgaaacggttaccttgctcgaagggactaatgtgaacattatccagccaagcttgcccatcacgaatttgaataaacccatccgcaatcgtaatcttgctagcacgcactgacttgatttcagttcccgtcagttcgatacccgcttcatacgtttcgccgataaagtagttgtactttgctttattgtttgttgccaatgcaccatcagcatttgactttttcttggccatctttaacgacctcctaaagctttctgttgctctatgctctgttaaacgcctggcgtggtttcggtcatcactgcgttaagtcaaaaattttctgcacgccgttggcgtaccgagaaattttcgtcttaactccggataaccgattttctcgctctgcgagaaaaccaccactctatgctcttttcttagtgacggcccttacggttagtgttctggtgctttgattcaggcttgcggtctgactttgcaccgaatggctttccaccgttgtgagtcttaccacccttgcttgagcggttgttcttgtcgttgctacgacgctcaccacggttgcgaccaccaaaggcaccacgacggtcctctggcaccttgatgtcagtgattggggcagcatctggatcaaccaaaacgaagtccaaagctgattgttccttatccacacgaatcaaacgtaccttaaccggttgtccgatttggtagatgtggtggaagcgacggccaatcaaagccatgtgtgcttcatcgtagacgtattggtcatccgtaaagtttgacgtgtgaatcaaaccttcaaccgtgttctccaatgaaacgaacataccgaacttcaagacaccgtttaccactgcctcgaattcgtcgccaaccttgtcctccatgaactcagccttcttcatggcatccgtatcacgttcagtatcaacggcacgacgctctcgaactgacgtatcctcaccaatttgagccagcttgtcacggtacttagcttgcgcctcttcacccaaaccattcttctcgtaccacttaatcaaacggtgaaccgtcaaatcagggtaacgacgaattggtgacgtgaagtgtgtgtagtattcagcaccaataccaaagtgtcccaatggttggtctgagtacttagcttgcttcatcgtacgcaacatcattgttgaaaccatttgttcttccggacgatccaagaagaagttgtggatggcttgcaagtccgttgacttgatgttttctgggtcaatcttaaccggtgcaccaagcgccttcacaaagtccacaaagttttgaacacgatcagcatctggtgactcgtgaatacggtacaagaatggtacgtttgcttggtcaaagtgcatggcaaccgtttcgttggcagccaacatgaatgactcaatcatacgttctgacaaaccacgttcacgcaattcaatgtccgttggcttacccgtttcatcaacgataatctttgcctcaggcgcatcaaattcgatagcaccacgttctgtacgcttagcagccaaggcgttgtgcaattgttccatttcttcgaacattggcacaaggtcgctgtactctgaacgtgtctcttcgtcaccagccaagatagcattaactgccttgtacgtcatacgagcgtgtgaacgcataactgaagtgtgcaaacggtggcttaccaaatcaccagctggagtgaattccatttcggcagacatggccaaacggtcaacaccagggttcaatgacgcgattccgttagagatgttacgtggcaacattggaatgacacggtccgtcaagtaaactgacgtaccacggttgtaagcttcctcatccaatggtgtgccttcaacaacgtagtgtgaaacgtcggcaatgtgaacacccaagtggaagtttccgtttggcaacttccagacaacaacagcgtcgtccaagtccttagactcaatggcgtcaatcgttaccagtggttgatctgtgatatcttcacgaccttcacgctcgaagtcttgcacgtcatcaggaatcttgtttgcttgttccaacacagcttctgggaagacgtgtggcacatcgtggttgtacacgatttgtagaatgtcgacacctggatcatccttgtatccgaccttctccgtaatcgcaccagtgaaacgctttggtgcaacggctgaagggtattggtcaattgaggccaccaccacttcaccgtcagtagctgaaacgccaccttccttaaccaagaattcgaatgacgcaaacttcttatccgtcaaacgaatgcttccaacgtaacccttgtattctgaaccaagcgtgaattcgccaaccacgtgctcacgagcgtgggtaatgatttcagcaaccttaccttcaggaccacgaccagtgtttgcgtcacccttcgtcaacaactttacacgaacttcgtcaccttgaacggcaaacatcgtgttatcaggattgataaagacgtcttcttccttatcgtcatagtgaacaaagccgaagcccttgtcattagacttgaagacaccaataatcccttccttttcggcgtcatattggaatgcgccttcctcattaacctttaccttaccaccgcgttccaaagcagctagtgcttgaacgaccttcgtaaaggcattggcatcatccaagcgcaaaccatcagccagcgtttgtgctggataggcttgcgttggatttgccttcaagaacccaaataattggtcctgcaaattttgtgcgtccatttaaatctcactcttcttaaataatcaaagacccctcgtaacaagtcacgagaggtcatagcgctgttagtgtttagtgtgaagaaaggtaaactagtgccaatcccaaaataaaccagatagctccaagaatagccgtgattcgttgcatcactgcctcgaacccacgtgccttttgcgttgcgaacaaatctccgccaccacctgacaaggctgacaaagcatcttgttgcttcgatggttgcatcaacactgccaaaataatcaacacaccaacgacaatcatcgctgtcaacaatacgttgtacatgtgggcaccctcctcttcattttcgtttaaacgaattaccccagccctggggttttatacctaactagcataccataggaaccggccactctcaacaaaaaacgagatattcgaatttcgaacatctcgtgaatttttttaaattacttcgtcgcacgacgcatcaagacacgatagaacgtaatgatgaatgcaatgaccagcaaaacgccggcaactgcaaaggcaacgtgcattccgaagacaaagacttcagggttgtgcgctgggtaggtcgtaattgccttgcccaacttagcgctcatagcagcgtacaaaactgacgtaaccaatgtcgtaccagtaatcatacccaagttacgagacaaagcgttcaatgatcccgccacacccagcttatcttgaggtgcgtttgacataatcaacgcattatttggtgattggaagaaggccattccaaatccagaaccggccaacaacaaaccaatcaacaacattggtgattcgccatcaacgaagaaccacgtgaacatgacaattgccaataccgtcaacccaaacaaggtcacatattcacgatccatcttgtcagccaacgtacctgacaaagctgagaagaccaacatggcaactggccatagcaacatgtacattcctgatgtaccagtgctcaagccacgcaaattctcaaggtagaatggcatcaaaacattaataaagaagttggtgacgaacactaggaacgccgtaatcaaactgattgtgaatagctttgatgagaaaatcgtcaaatcaagcaatggcttttcggcatgcaattcgtgacgaataaacaagacaaacaaaatgatggcgatgacaatcaaaaccaatggccaagctgccaagaatccttgcacttgcgccacgtttagcccaaggaacaaaacagcaacaaacaagaacaatgacacggcaccaaaccaatcgatttgaggcgttacacccttctttgatgactttggtagcaagaacgcacctgccacgatagcaatgataccgattggcacgttaatccagaaaatgtatgaccatgacaagtgttgtagcaacaaaccaccaagcgctggtccaaggattgaaccaagtgatacccaagcagcaatgaatgacatcgcacgaccacgtaggttttgtggtgcaagtgtcgtcgtaattccgaatgaattactcattgtcattgaggcaccaacggcttgtacaaaacgggcaaacaacaaaaatggcaaacctaaatcaattcccgccagtacagaaccgagtgtgaatacaatggttccaatcctaaaaatcttaatcttaccgagttgatcacccaagttaccaaacaaagccaacaagccagaaataacaatcaaataaattgagactgtccacgttgcttgattcattgggatattcatctcttttgacataacaggcaatgcaatattaacaattgacgcgtccaaggtgctcataaatgtgaacaatccgactgccgtcattgataaccatagcttcaaaccgttttgactctcttgcatgatatccttacttccttatcttttatcaacagttagtatagcaccctgacaaatcaatggcagaatttaggactccaaaacaaaaaagacgaaaccaaatcttgcgaattggtttcgtctttaattaatctatcaaattgacagatgctagtgattagcgcacgtagttaacgattgcttcacgagctgacttgtcaatgttgtagaagctgttgatacccttgtattcagcaaccttttcagtcaacaagtcttcgatgcgcatcaattggttgtactttgcaatacggtcagtacgtgacattgaaccagtcttgatttgacctgcgttcgtagcaacaaccaagtcagcgatcgtcgtgtcttcagtttcacctgaacggtgtgaaacgatagccgtgtaaccagcttccttagccatttcgatagcttccatcgtctcagtcaaagtaccgatttggttaaccttgatcaagattgagttagcggcacccttttcgatacccttagccaagaacttcgtgttcgtaacgaagaagtcgtcaccaaccaattgaaccttcttgcccaaacggtcagtcaactttacccagttatcccattgctcttcatcgttcaagtcctcagcttctgctagagggtcttcgattgaaacaacagggtacttgtttaccaagttctccaagtagtcgatgaactcgtcagtcgtgtattccttcttatcaggctcacctgccaacgtgtagatcttcttctcgtggtcgtagaattctgatgaggcaacgtcaaaggcaattgcgatgtccttaccaggcttgtaaccagcgcgctcgatagcgttcaacaagaactcgaatggctctgcgtttgaagcaaagttaggtgcaaatccaccttcgtcaccaacagcagttgagtgacctgactccttcaacaatgcttgcaatgcgtggaaagtttctgaacccatacggatagcttcagcaacagtctttgcaccaactggcatgatcatgaactcttggaagtcaacagagttgtccgcgtgggcaccaccgttaacgacgttcatcattggcgtaggcaaaacctttgagttgaaaccaccaaggtagttgtacaaaggcgttcccaactcatcagcagctgcacgagcagcggcgattgaaacaccaaggatagcgttggcacccaacttacccttgtttggcgttccgtccaattcgatcatcgtacggtccaacaaaacttggtcagttacatccataccaaccaacttgtccttgataaccttgttaacgttttcaacggccttcaaagttcccttacccaagaaacgacccttgtcaccgtcacgcaattcaacggcttcgttaacaccagtagaagctcctgaaggaacgattccgcgaccgaaaccacccaattcagtgtaaacttcaacttcaacagttgggttaccacgtgagtccaagacttcgcgtgcgtaaatatcagtaattgcagacatgttgtcttctccttacttgttttaaaagtatagttatctgggaatatcccttgtcatatattgtaacataattcacacgttatgttgcatttaatcggctttctcgctttttgtttgaaccgtctgtgaaacgcttatcgttaccctgaagcaactattccgttttacgtttgttacatccccgactgttatgtcatgcaatgttgtgtagacttatatatataaacagcataagcaaaccaacgaggaggaggttacgtttatgaataaactaaaattttcaatattaggattgattggtctaattattgcagtgccaatttatctatttggcgcctcttacgcaatgagctggtttttgccggaagacaggccacaaaatccggttcatcagtccgaacgcgtttcagcatcattggctagcattcaatcttttaacgataaattaatcgctgccggtattaatccggttgagccagctagttacattgattcgatgtcaaacacagatagccaaacaagcaatccaacaatggctagaacaagtcgctttgtccgtgcagaatcaaacgaagacgctatcctggcacaatcagaagatactacacctgtttttgaatcaactagcacacctagcagcatcatttcagcggcagcaagcgcaacgccaacaattaactcgggcgtcacacaagaatctgcgcttagttcgataactcagctaagttcttcagaatctagcgcaacatcaactagtggcgactcttctgtcacaactacaaccagttcgacttcttcagattcatcagaagtatcttctagcttatccagcaccacgacttctgaaagctcaaacactgaagatggttcaggtacggccgacgatttaacaaattctgaagttacgccagatactgatatttcaacagtcgaaaaatcctaatccagtcaatcaaaaagcacgtctcattttaccgagacgtgcttttgtgtttaccagtgttcgcgaacagctgcgatttctgattcgttcaccgcatagcggaccttgcgaccacctgcgttgtgtgatcccaaaatcatgccttctgcttcaccgttaatttcattcaaaatgaatgactcccctgacgttaggtagacctttacaaagctaccatcagacaaaatcttttccatgaacttaaacatgtgtcgatatccccctattacatatactattatcaactctacactgatagtatatcgggcaacttcgacaaaactacgatgcttttatgcgtcttttcgcaacgttcttttggcttgttgtgcaagactaactaactcaataaacgttgatgcatccaaggctgcatccccaacaaggacaccatcaatatcaggttgtgacaagatgtcatacacgttcgttggcttcacagacccaccatacaaaatacgtaggttgtctgccacatcttgattaaacatgtccgcgactgtttgacgaatcatccacagactcttttgcgcaatttctggactcatcgcctgacctgaaccaattgcagcagttggttcatatgccaacataacattcgccatatcagcttccgtcacaccctttaatgactcaaccacttgattaacaatccagtgagcatgatcgttacttgattctagttgcactgcttcatcaatcgcaataataggcatcaagccatttcgcaacgtcgccaacgttttcaagttcaccatttcatcagtttcccggaaatagttacgtcgttcagagtgaccgatgatgaccattttgatacccaaatcagctaatgccgctgggctagtttcacctgtataggcaccacgatcttcccagtacacgttttcagcaccaatacagattggtgtgcttcgtgctgcgtaaaccatcgcatccaacaggacatcttgtccagctagcacagtatcgaccccctcgtactgcactagcattgggccaacttccctaatatacgcagctgcttcgctgggtaatttattcattttccagtttccaactacaattggtcgtctgctcatagcttcccccaaaaaaattttaattacaaaaggcgtgccaccgagcggtcgcacgcctttcttattcattactcagctggaacagcttcttgaaccaacttgataacttcttcgttcgtctcagcatccaaggccttgtcagccaattcagccatcttcgtcgtatccaaacgcttcatcaatgaacgtgtttgcaaaactgacgttgcagacattgagaattcatccaagcccataccgaccaaaactggtacggcaattgggtcacccgccatttcaccacacattgcagcaaacttgccgtacttgtgtgctgaatcaatcacgttcttgatcaaacgcaaaattgatgggttgtatggttgatacaagtatgaaatcttatcgtttccacggtcagcggccattgagtaaccaatcaagtcgttcgttccgattgagaagaagtcaacttcttgggcgaacttgtcagccaatacggctgcagctggcacttcaatcatgattcccaacttaatgtcatcagctactggcacaccatcttcttgcaacttagccttctcttcgttgaagatatcgcgcgctgcacggaactctggcaatgttgccaccattgggaacataatccacaaatcaccgtaaactgatgcacgcaacaaggcacgcaattgtgtacggaagatgtcatcacgatccaatgagatacggatggcacggtaacccaagaatgggttttcctcttcaggaagtggcaagtaaggcaagtacttgtcaccaccgatgtccatcgtacgaaccgtaactggcttaccattcataccttcaaggaccttcttgtaggcttcgaattgctcatcttcagtaggcaattcctttgaatccatgtacaagaattccgtacggtacaaaccaattccttctgaaccgttatccacaacaccttccaagtccttaggcgtaccgatgttggcaccaaccaagaactccttaccatcagcagatacagacttttcattcttcaacgttgcccattctgccttttgagcggcatacttgtcacccttggcacggtatgttgtgatttggtcttcagatggatcaacgattgcaacaccgtcaagaccatccaagataaccatgtcgccatcttgaatttcttcagtggcaacctttgaacctacgatagctgggatttccaacgtacgagccatgatagctgcgtgcgctgtgcgtccaccaacgttggtgatgaatcccttaacgtattgacgatccaattgtgctgtatctgaaggtgtcatgtccttcgcaacaatcacaacttcttccttgatcaatgctgggtttggcaattccttacccaacaagtgactcaagacacgcttcgtcacgtcacgaatatccgctgcacgctctgccatgtatggattgtcatcagccattgcctcaaacataccaatgtacatgtccgtcgtttccttcaaggcggcttccgcgtttacgctgtcactgtcaatcttgccagtgataccacccaaaagttctggatcttccaaaaccatgatgtgtgccgtaaacacttcagcttcttctttccccattgaagtcgctgctttgtctcgaatttgctccaaatctgtcttagatgctaaaaaggccgctgctacgcggtccttctcagcttgaacatcgtctactgtacgagtatcaaaagacaaatcaggatcaacgagcttgtatgcttttgcaattgcaacaccgtttgatgccgcaattcccttaatttcttttgccatcgccgtcttatccctcaaagtaaatgttcaaaatattaattgttaactaaaattagtcagtcaaaccttcagctgacatcgtgtctgcgattgcagccaatgcttcagcttcgtcatcaccttcagctgaaatcttaacgtcagcgttttgaccaacacccaatgacataacacccatgattgacttcaagttaacgtccttgccttggtatgacaaagttacgtttgatgaaaactttgaagctgcttgtaccaacaaagttgctggacgtgcgtggataccagtttctgctacaatgtgaaattcgcgtgattccatggtgataatctcctctagattaaataatttctttaatacggaatagctgagttaaaaacgctttcaaaacatctttcaactaaccttatgtagttaattctagcaggtataacaaatataagcaagcgcttacattacctttttcataagcctttcgtgaagaattcgtgaactctaaaaaccggcgatggttctactcagcagtatttttagccgtataggttacgacaccaccacggtctgcgatgccacgaatagcattctgataagggtaattgcgccaaacttcgtagaactctttaaaatcctttgcttcaagaacgaactggtcaagttcacccgtacgtaactggtcgagtaattcttcatagttcatgtttgtcccctcctgttctaaatcaactgttactattttaacaaactttcatgcaaacggtgacatttttcaaaataaaaaagaacatgtgtgttgcatcaacgcacatgttccataacatttatatgcaaactagaattcaagcagcagacttccgtatgtaaatccggcaccaaagcccgtcaacaaaacgcgctttccagtcaaatcagttgccttgttcaattcatccaaaccaatcccaataccagctgaagacgtgttaccgtactttgtaatattcgtggcaaacttgtccattggttgatcaattgcctcagcaatcgcctcgataatacgcaagttcgcttggtgggtgatgaagtaatcaacatcatttggcgtcaaatcacggtcagccaagaaattggtaatgtgattaggaatcaaacgcacaacttcttcaaagacttggcgtccttcttggtggaaggcatctgtctttgggtaattgtcagctgcaatgcgtgacaatggttgaatgcgtcctgagtgaacgacttctgcatcaccaatcgtgtgcatctcttcgcccttcacaataccctcgtcttcttcagtcgcaacaaggaccattgcggccgctccgtcaccaaagaaaacggttgatgtacgatccgtgaagtccatcatcttagagttaacttcggctgaaatcaccaaagcgttcttataaactccagaacgaataaacttgtcggctgtactcataccaaagacaaatcctgagcacgcagttgaaatgtcgtatgcccaagccccttcggctttcaaattacgttgtaccaacgccgccgttgatggtgcaagaccatctggcgtaaacgtcgtcacaataatcaattcaatatcttcagggttcaagtcggtttgcgccagcgccatgcgagctgcttgcgtggccaaatcagacgtattctcaccttgcaatgagatacgtcgttccttgatacccgtgtgtgcttgaatccactcgtcgttcgtatccatgattgccgccaagtcatcgttcgtgatgatatcacttggaacgtagtgagatgaggcaataatcttagttccttgcgtcatgtgtggacccctttctttcgtatcagcaaaaacgctcttgtatattttacgctatcttctgacattttggtaataaattaggaaagactaataaagagtcaaccgcatacacgattgactcttgttagctatctcattattcagttacttcagatgcacgcatcttaaagttttcgttgtatgaaaaggcgttttgaccagcaaccgctgcatccccaaccgccgttgtaatttggcgaagttccttttcacgaacatccccaatggcaaagattcccggttgtgacgtttccatgcggtcattcgtcataatccaaccattggcatccgtaatacccaaatcttgcactgggtcagaaactggcagcaagccaacgtagataaacacgccggctgcgtcaatctctgacgtttcgtcggtttgattgttacggacgcggacacccgtcaccttcttgtcgtcacccaaaatttcttcgacttcagagttccaaacaaatgaaatcttttcattagcgaaagcacggtcttgcaaaatttgttgggcacgcaacttatcacgacggtgaacaatcgttacgtgatcagccaaaccagccaagtatgttgcttcttcgacggctgaatcaccaccaccgacaacaatcacgtgttggccacggaagaatgccccatcacacaccgcacagtaagaaacaccacggccagcgaaggcttcttctcctggcacatcaagcttcttgtaggcggcaccagtagcaacaatcaccgtgttagcactgtattcgtccatgtccgttacaacgcgccagctaccatctgcttgtgcttcgacgtgaagcactgtaccaaaggcatactcagcaccaaattgcgttgatgatgcgtacatcttctccgccaactcaggtcccaaaattgaaggaaaacctgggtagttttcaatttctgccgtgttgttcatttgaccaccgtaaataccacgatcaatcatcaatactgacatgtttgcacgtgaagcgtatgttgcagccgtcatgccgccaggtccagcgcctaaaataattgtgtcatactgttgtgccatgatatccccccgcagtcactttcatcattttctaatcttgttcgttcttatattctaactgctttgttgttgaaataaaagaccacctagccaactcaatttaaaaattagttggctaggcggctaacaggcttagaatgacctacattattttactttttcttgtgttcttgccaatctgacttcaacttttcaacctcgtcaaacagttggtcgtcagatgtcgttgttttcgttgcatcttcctgttgcttacgacgcgtgaacaagactgcgaacaatcccatgacggctgtcccaattgaggccatcaatgacgctagccatgattgattatcccctgtcacctgtttttgcgcagctgacgttgtttcagtatcattcgaactcatatcttgaatctgagcacctgctactgtacgaccatcagtaccttggtcgttaattgtcgcagttgtcgcagcctcagattgtcctgtggctgctggagtcgacgccccgttatcaccggcgttgtcaatttgtgtttcagcagataaaccagcagttgtcgttactggcatacctgacaattcattgacctcgtttgcggtagcactatctgatggtgtgtctgaatctactgaggctacgtctgcttctgaaccggcaccttgatcaatcacttctgacgccactacggttgtaccatctgctgattcaggcgcgtcagaagaaacgcttgtctctgagacgacattcgatgtcatgtcagatgtgcctggcgtttctgggttatcggaagcacttaatgcgacgctatctgaaggcactaccgaatccgatgtctctgaaaatgcgtctgcgttagaatcggcaccttgctccgacgcttgtgattgagatggtgtctctgaagatgtgccttctgaaccatcgttttgttcagatgtcaaagaaggtgcgtttgacgtctcaccggccgatgactcagcaggcgcagccgagcttgtttcaccatctgacgttgatagtgcttcattggcatcacttgtagcgccactatttgatggttctgttggtgctaccgaagtggaagaatcgcttgttgcgctgtccgacgttgccggcgcttcactcgacactgtgttatcaggtgaatcaggttctgttggcgcctctgatggcgtcaccgtcccatcactttgctctggtgtgtccgcaggagccgttgacgtttcgctggtatcacttgatgcgatactatccgatggcgttacaggcgctaccgaagctgatgattcgtttggtgctgtgttatctgatgtcgtcggcgcttcgctttggcctgtcgtctcgccgtctgacggtgctactggcgctggtgccactgatggcgctaccgttgaatcagcatcagaactctcaggcgtctctgcaggtgcaactgacgctgagctttgggctgccaaaatcgagttgacaatgctactcttcatcgaaacagcaacgctcgcttgcgactctgcgacaaccactgcagaagatgcctgcttgaagtaactatcagctgctatcgtgtcagagtttgcaccattcgttgctgatgtcatctggctgcgggcgattgacgctgcactcgatgtgttcaaggttgttccattgcccaaaaccgtatccacatagctcaaacctgcattgccagtcacacttgctaaactcttaacagcatctgccgctgactttatttgatccgtgtaactttgcgcaattgaggctgcttcgtttgcctttgcaactgcactggccaaagatgcggcaactgtataatctaataacgcagccaaactactattgatttcacctgtctcattcaacagggactttaccgatgtcactaagctagatgccacggctgccgaactttgggccgttttggcgttactgttaacaaatgaaatggtatccgcatcgctcaccatcgttgaaccaactgcagcagcacttgctgcattgcttagttgcgcatctgccgttgattgcgctgtaccggctgacttaatcaagtttgctgcagaactatacaacttgtcagcagcatcataaagtgagttagctgaagataagttacctgctgaagcgtacgaatttccagcagacaatgctgaagaagccagattcatattgctttctgcatttgacaagtaactggcggcactcgatgtaccgcggtctgccaatactgaagttgttgccgcggtatccgcctgatagtctgcactcggatcattagctgcaattgacgaagccgccttggccgcactcgatgccactgacaaaatacttgaaatagccgagctatatgacccaaagtctaatcctgactgcagtgaacttagctcaattgcaattgaggccccctttttagtagtagcgtctagctccgactgggtcgctgacgaatctgcttcgctagaggcagctgtaccatttactgttgactccgtttctttatttgccagttcttgattgtcgtcagtgactgtttgcatggccgtttgcaatttatctcgcaccaaatccatcgctgatttagcttggaaaacagttgagtagttatcgacgttatccgttaacgacgccatattgggtaacatttgccaaagttgttgtaatgcgacgatgtctgttgcgtatttctgtgctaacttttgatcctcagcattgtcggactttgataatgtcaccactgcgtttgctagcttcgttaattgcgcttcaacccccggcttcaatgacaaatattcatcctgcaaactttgagctgtcttcgcaacgtatgttgatccaacctgaccaacaatggcaacttccttgccaccttcagcttgataagctgcatgaccgccgttcattgtaaggacaaaatcaggattatccgtcatgattttctgcaaccaactcatttgaccatcttgcaaaggattgttgtccaaatttaatgattgcaactggtaaaacacattttgaacgcctgatgttaaataattaattttattatcagccaaatttaaattcagcaaatttggcagatgagagagagaatttgatcccaatcctgaaatgttgttgttagccaaattaagcgttgtcaaagaggatgaactaatatttagcgaattgacatcaattgcaccactgttatctgacaaatcgagagtcgtcagcttggtcagctttggcaaattaactgcctgcataaacgccgtaataacagacatgtcttttaccccagccattagcccagacatgtttagcgaagtgatacccgtcatgacaccaaagagattttggaagttgcgtagttccgcaccggtatcttgccctggattataagtcgcaaacccaatattcttttgcatccactcgttaagcgttgtgttgccagaaagattaagcttggtaataacctttaacgacccaatcgtgaccttgttgtaatcgtccggtgatgacacctttaagacctcagctaatgtctgaccgttggcagtcgttgactgcaacagcgcatcaatcaagccggcaggtagattaacctcagtgattggcgtcgttagcggtagagagctcgttaatccactaccattctgagccacattattcgtaaagtgcgtcgcaactgcagacggtgtaataacagccttgtaaccagatgactggatataatttaaaacaccaagcaccgtggatgttggcgacccttccgcaattgataccgccagttgaccgttcactaatgagatgccagtcactgcaggattttcaccaaagataaattcagcagcagctaagtcagcaggtgttgccgtttgaccaccgatcgtcgctgagacctgcttacccgttgccatcaagctatatttactagccagtgagttctcgtcttgcagcgcctgggtcaacgccaaatttgatgttgattgattcgtgtcgtcagccaagacgctacccgccatttgaataattggcatgatgggtgatgaagctgccaataccgtcgacaaaatcgcggcgccttgggttacccacttcatacttgatttgttttcgcgggccttataaatttcattttctttcataatatcgtcccccatagttatccctaattatagcgggttgtccgattttccactctcaaaaagacttttaaaatcatgaaatatctagaaattaaaagaggctatctgctgcataacagatagcctctttgtatgttatttaaaaatctggaaattacttccaagaatccttcaacttatcaacttcgcttagcaaagcatcatcgttgttcaaacctagacgctcgttcatttcttcttccgtctccttgcgacgacgccagaatactaggaacaaagcaagcaatccaccgacaattgctgacatgattgatgcaatcaagccactcttgtctgacttaaattgtgtatcgtgaagtgaagacttcgcatggttcaaaccaaattcgctgtcttgaatttgcgctgcaccagcagaaactggtgttgcgacaactgatcctgatgctggggtagttgcgttaccggccgttgtagcaccagttgttgaaccactcgtagcagtgccagcagccgtcgttgtcgtagcgattgatgttgcaacttggccacctgtaacattagcgtttggcaaagaacttacagttacaccacctacgcgagcatcgttaccaacattaacattacgttgagcaacattgttagttaccaattgatttgtgttgtcaccggtttggttatcatcaccgttgttgccggctccaccagggtttgtgctgtcgcctgtttggttatcttcaccgttgttgccggctccaccagggtttgtgccgttgcctgtttggttatcatcaccgttgttgccggctccaccagggtttgtgctgtcgcctgtttggttatcnnnnnnnnnnttgttgccggctccaccagggtttgtgctgtcgcctgtttggttatcttcaccgttgtttccagcgccaccagggtttgtgttgtcaccggtttggctatcatcaccattattgccagcgccaccattgttcgtgttgtcactattgttgccagcgccaccattgttcgtgttgtcaccggtttggctatcatcaccgttgttgccggctccaccagggtttgtgctgtcgcctgtttggttatcttcaccgttgttgccggctccaccagggtttgtgttgtcaccggtttggctatcatcaccgctgtttcccgtctttggcgtaccatcgggattaacttcagccgtgaaatatcccccgacaccatgattatcttggccggtccagtgaacataattaggattttgaatattagatatcatctgttgatcattaccgctaagatcaatagtcttgactgtatcattacgctccaaacccatatcagggtgcatttgtgttactaaattgttatcaaaattattattagacaaatttaaagttacaaaagataccgtcttaatgtttggcaacttcatataccagaacatttgtgctgaaatcattgaatcttgcgcgtttgcggctttaaatacgccacttaaatcaacggttgttaagttaccattggcagccaatgccgcaccaaaatcgcccaaagccttaattgctgcctgttggtaaccatagttataccagttacgagcaactgacactagccagtctgaaaattcttggttatttgataaatcaacgactgcattattcttggcggcatcaagtacgctctgaggcacttggctaaaatagtccgcagaatcagtagccgcttgtaccgcttgaattgatgacaactgtaccccagccgtcatcactggcgcaccaacaatcaatgcaactcccataattgatagtccacgggttacccacttcttaccatctttgtacatcttgaatcgaactgtgcgttccgtttcattttgcgtcttcttgaacataagaaaacaccccttttctctttaacaattccctttttgcaaatactgaacatcaggcattccggtaacaggtctatccccgtccgatatttactaatttattgtaagtcttgcgcaacacttttgcacgttttttgggaatatgtaaaaaaattgataattttagttaatgtatcggatataaaaaaacaaccacccttgcaatatcaaggatggttgttatcttcaaaatctttaaatatcacagaagtctagcgattacttccaagaatccttagtgttttgaacgtccttcaacaatgcctcatcagcattagctgcgacattctcttcttcttgttgcttacgacgcttccagaagaataggaagaacaaagccaagactgcagcaactagtgctgaaatcaatgacgttagaagaccagtgtgcttgttagtcatttgcgtatcgtgcaatgacttgcttccttcagcaactgcctttcgatcatgaatggcagccttctttgggtggcgaccattatctgcatttgcagcttgcgtagcagcaccgttgtttacacttgcagtcgcaactgttgcatttgcaatcggagcaaccgcaccagcagttgtattagtaactggtgttggtgttgacgttcctgctactgcattcgcacttgcttggttgccagcgttaaccacggcgccatttacaccactaactgcagtgttgcttaccacgttcgtattaaccacgcgaggagccgcaacgttacgagatgctgcatttgcaattgcgatagccgccttatcagctgcatccgtcaaagagtctgcatccgttgcattcttaatgttgttgatatcattaacaacattttgatcattcgcaacatgttgtgcactagcttctttgttagcctcagcaactgcggctgacttttggttgttgaagtcggctacgttttggttattcgtagctgcctctgatgctactgatgtagcatagtgttggccttgctttgcttcttctgctgcaactgatgaagctagggctgagttagccaatgattgttccatcgctgcgtttgactcgcggccagcggcgttagcttgtgatgctgcttgtgatgctgacgcactgttggccaatgattgctccattgccgcatttgactgacgagcactctcatttgcgaatgaagttgcttgtgactctgccgcgctggctgccaatgatgactccattgctgcgtttgaatcacggccagctgcgttggccaatgacgctgcttgtgatgctgatgcactgttagccaatgattgttccattgctgaattcgactcacgtccagcgttgatcattgattgtgcttctgagttcgctgcagctgacgctgctgcagaatcgcttgacgcctttgcgtcatttgctgaagcatctgaagctgttgaatccgcattgtgttgtccagctgctagttctgacgcaattgctgctgactttgccgctgatgtggccatagaattttctaccgcagcttcattttcggcacgtgtctttcccaaatcagacgtcgtatcagcatcatgtgcactcttttgttggaccttagaaacttctgcttgtaaagcagcatcagccccaagcatgtccaacgcatctgatgagttgtcatttgatacattttcagcattctcaattgcctttgtcaaatcagccgttgaactatcttggttacttttcgcaactgaaatttcttgatccaattgattcttagctacttggcgaagaccagccaatgcatcacgcaactttaattctgcgtcgttaaccttgtcatagtcaccagggttcatttgttgtgtagcagaaaatgtcccgttaccagaagtgacagtctgggtaatttgatccatgttttgcgtaaacttgccggaattaattgcatcttgtgccaacttcaagtcagcttgcaatcccaaacgaacagcagtcttgttatcagctaccaaagcatccaaattcgtaccgttcaagtcggccgttaccttagccaatgcttgggtcaacgcagcatcttgtgtgtatcccgtgtattgcttaacgacatcataaccattttgagccgcaataattacgttaaccaattgctcattagcatcattaatggccatttggccacgatatgaataactaggcttcacattccttactttagcaactacgttcttcacaatagtataattcgcaagataaccgtattggtcattaacagcgtccaaattgtcttgtaagatatcgtatgcatctcctgaaccctgacttacttgaacttcacttgcttcaacattggctacattcgccacagtccccgcaactggcccaccaaccatcaaagaaacggcaaacaaagccaacccacgggttacccatcgcttaccgtctttatacatcttaaagtgaaccttggtctgattctcgttctctaacatcccttttaccactctttcttccaacggttctttaaaaccgctctaaagcacccgaaccaccggaacactcccttatataaaacataccttgtaagtctatcaccatatttttaaaatagataaaatatagtgtaattaggaatggttacaaaaaggaagttcgaaaaaacagactcatctaccacaaaaaaacgctctgattgaacaatcaaagcgcttttgtttaataattattaatccaacgttgctgccaaatccttgatgtattgcttcaaggcttcaccagtttgtgggtggttcaaaccgtattcgatgttagtcgtcaagaaaccaatctttgaaccgatgtcgaaacgcttacccttaaattcgtgggcgtaaacgtgttgacgcttgttcaatgaatcaatggcgtccgtcaattggatttcgttacccttaccaggcttcgtgttctccaactcttcgaagatttctggcgtcaacaagtaacgaccgatgattgccaagtctgaaggtgcatcttctggctttggcttctcaacgaatgagttaacttggtgcaaaccgtcttcaacttccttttcaggtgcaatcacaccatattcagaaacttgctcgtgaggaaccttcataacagcaagtgttgactcacccgtcgtgttgtaacggtcgatcaattgcttagtcaatggcgtctcgtcagccatcaagtcatcacccaacataacaacgaatggctcgtcaccgataaatgacttagcagtcaaaacggcatctcccaatccacgtgggtgtgattgacggatgaagtacaagttaatgtcagtcgtctcttcaaccaacttcaacaattcatccttacccttttccttcaagttgttttccaactcagggtttgaatcaaagtggtcctcgattgaacgctttgactttccatcaacgataacgatgtcttcgatacctgatgccaaagcttcttcgatgataaattgaatcgttggcttatcaacgattggcaacatttccttggccaaggccttagttgctggcaaaaaacgagttcccaaacctgctgctgggataatagccttacgtactggcttcatagtgtgttacttcccttcttgtgaaactggacgacccatcaattcgttgatggcctccttgatatcttgaccttcgtacaagacacgataaattgtagatgtaattggcatttcaacgtgcttcttaagcgcaagttcatgagcgaccttggttgttgaaattccttcgatgaccatccccatgttttcgacgatgtcatcgagcttcttgccttctccaagttgtacaccggcacggtaattacgtgagtgtactgaagtggccgtgacaaacaagtcaccgacaccagacaagcccatgaatgttagtgggtttgcaccgaatgcttgtccgaggcggctgatttcagccaaaccacgtgtaaacaatcccgccttggcgtttgcatcaaagcccaagctctcgagtgcgcccgcaccgattgcaataacgttctttaatgcagcaccaaattcagcaccaatcaaatctgtgtttgtgtacacacggaatacgctattcgtaaaggcagcttgcacacgctcagcagttgccaagttttcgcttacagccgttactagcgttgggtcatgcttgataaccccttccgcgtgagatggtcctgagataattcccaagcccaagcgctgtgaatcagccacttcttcagcaagcatctctgatgcacgcttgtaagtgcctggctccaagcctttcgttgcagcgaccaacacaacttgttggtccaacgctgacaacacgtctgacaattgatgtgcaacctcgcgtgttgccttagtaggcaccacactcaagacgattgtcgcatcgcgtaccgcttcggtcatatcggccgtagcaataacgccttcatgcaaagggttatcgccaaggtactgactatttcggtgttgttcattgatttctgccacttgagcgggcttatatgtccaaagacgaacatcatgtccattctcagcagcaacatttgctaaggcagttccccaagatcctgcacctaacactgcaattacttcattgctcacaatgttcctccttgcgttaactttggtctcaagccaaagttaacatactctataataccatattcacaaattttgaaaatgcataaaagtgaaaaagcccgacagttggggcttttccttaatgaaatcattaatcttctgaattttcagcaatcaacttgttcaaattatcattaaacgtttcagttgcatcaaatcccatcttcttggcacggaaattcttagctgccgtttcaatcaaaacagccaagtttcgtccagtttgaactggcaaaacaaagcgtggcaaatcaacgccttgaatttggatcgtttcctcaccatttcccaaacggtcaaccttttgatcatccgtccacttagccaagtgcaagttaaaggcaatcgttgcatgagagcgcacagcaccagcaccatacaagttcatcacatcgatgattcccacaccacgcaactccatcaagttacgcaaaatggcaggtggctcaccaaccaaacgctcctcgtcttgggcgtacacatcaacacggtcatccgcaatcaaacggtgaccacgttgcacaagttcaagcgccgtttccgacttaccaacaccagaatcaccggtaatcaaaacacccaatccaaagatgtcaaccaaaacaccgtgaactgattggcgttctgccaaaccaccactcaagaaaaatgtcatgtttgacaagatacgtgatgacgtcaattccgtcgccaacactggaatttgtgcttcaagcgctgcttgcataaattcttgtggcaactgacgtcctgttgaaacaacaaacgccggtgtattaggttgcatcatcttacgtgcaaccatcaacaattcatcgtggttcatgcggtgcgcgaatgacgtttccgtaattcccatcaattgcacacgctctggtgcgtagtaattgaagtatcccgtcatttccaaaccaggacgagaaatatcagctgtcgtaatttcacgatttagatattcttcaccggcaactaaattcaagtgtgtattatcaagcaaatccttgactgtaattttctttgccatatcgttaatcttccttattgatgtcgctatctcgtcggctgaagtaacttgaaataatcaggtttaccagtgacatgatgatagcaataaagactgcccaaccaaaacttgcaaaacggaatccatccccaacaatcgctgatgccatccacaaaacgattccgttaacaatgagaccaaaaataccaaacgttagcactgtaaatggcaacgctagaatttggagaactggcttcaccaaggcattcaggacacctaagataagcgccgccaaaactgccgtgaacaagttgctaatatagagtccttgcttaaacaaaccagcgagagctaataacataatggtattaatcagcaatcgttgcaaaaaagagaaacgtcgaaatgttattgtttgcatattcatccccctagtttcttctgttttattatagcaaacctattgtactcgcggtatgaagaaaaaataaacgtcccacgctttttgctgggacgttcgtcatattatgctttcggcttaaagagatcatgaaatggtgactcaccattattggccacttgcgttaaaaacattttgaccgcttgttgcgttgttagtccttcttgacgaaacacctcatcagcgccattacggatttcttcttcaactcgaatttgtattaacttttccataatcgatatccccttttatcgaatattaacaacatacttattatagtacatcatatggttaagtcgtagctttatgtcttaatatgcaaaaaacgccggtccgaagaccgacgttttccgcttggcaatgctagaattgacgtgctctagctcacgtgatggttacccatcagtcaacgtacaccaacgagcgaactcgaagttagtcatgtgcagagaagcgagttccacaactccctatctcaccctccagcaatgcggctgttaatgagggccgtttatcaaagatctaacgtgatcttctcgactcatcgcataacaagtattatacatggctatcatttgggaagcaagttaagaacctgttttttcaccgctgacataatttagtaacattcaaaacaaaaacgtcataaagtccggttcgacgctcattattttctcgattaatcgtctaacagaaaccgcttacattcttgtatcattgggtatataataatttatatcaaagggacacatacaaatgttgtctaaatcgattaaaaaaggatggtaaatcgccatggctgcagaaagcattaactacaagaacattttggccccagtcgacggatcaaagatttcagaaaagttggttgaaaaggccgctgccgttgctgtacgtaacgagacttcattggacttgttgtacgtaatcgacacaaactcattgtcaggtttggctggtatgtcaatttcaggtgacgttgtctaccaattggtacaagacgccgaagaaaagttggctaagtaccaagaacttgctcaaaacgaaggtgctaaggatgttaacatccacgttcgtttcggttcacctaagacggttatcgctcgcgacttccctgctgatcacggaaacgaattgattatgcttggaaagtcaggcttgaacactttggagcgtttgttggttggttcagttgcctcattcgttgttcaaaacgctaagactgacgttttgatcattcaataattcgatattgccaccaaccaaactcgcaggttggtggctttcatttttaatacacaaaaccatctagtcgtattcgatatatgttggtattataatgcttatcaacgttttattaaaatgttattagaaaagagtaatttttatcattctaatttattattcgataaagtcgaggaactcgctatgaagattattggtaacacgttggagacgattcacaagtttcgtcacgagaacgttagtcaacgtttcgtttcagatccattcctagctgcgaaggccgccctaggggccaaccgtaacatcaagttgcagttgttgtacctagatacaaatgagaccttctatctagttgagaacacatcatcaattgcacgcagtttgcagtacaatgatggtgccattgttgtcagtgaatggtctactgttgacttcattgctttgatgcaaagttatgacaagcccggatttgataactacttccaattgcttgttaacaacactgcacaagcccatgaagtgcaagaggaagaaacagcgcactaacaaaaagcacacgctctctgagcgtgtgcttttctttttggctttacttgcttgaagcatccttcaccacttcaactgacgttaccgtcaccgtctccgttggcttatcgttgtcatcagttgcgactgacgcaatcttgtcgacgacgtccatacctgaaataacttgaccaaagaccgtgtatgagccatccaacgttgggtttccacccttcttgtatgcgtcataaatcttctctgggtaacgcttcgcactaatcttgcttgtcacatcatctgaattttggttaataaagaattgtgaaccgtttgtatcagcaccagcattcgccatcgcaagcgcaccacggatgttgtacaaagatgggctgatttcattcttgaaaccattaccgctatcaatcttagaatccttaccattccagattgactcaccaccagtaccatcccccttaggatcaccaccttgaatcataaagtccttgatgacacggtggaagtttgtgttgttgtagtacccatccttggcgtgcgtcacaaagttctcaacggccaatggcgcatacttgttgaacaacttaatcgtgatgtcacccattgacgtgtgcatgacaacttcactctcgttcttggcaaccttgtctgacaattgtggcaacgtcaacttatccaacttcgccttagacaaagttgaagatgacgctgcacttgatgaagagctttgttgcgcatcccctgacttagcagacattgctgcaaataccatggctcctgcgacaaccactaccgcaatgactgcaatcagcacttctggtcgaaactttttcattagacttacttctcccctgatttaaaaatcaacttaaccactccattatacgtgtctttccttagaataactgtaaatattttgtgactgcatgcaaaaaggccggtgcattactgcaccgaccctcatcgcttaacggtttgtcatcttgaattccaagaagtaatcgttatattgaccaacccagtatgggccaaggtcttggtaaacttccaaatgtgacaatgtcttcgcatctggataccattgcttatcgttacgaagtgactttggcaacaaagccttcgccttcttgttaggcgttgcataaccaacatattcagcattctttgctgcattttctggcttgctcatgaagttaatgaacgcatatgctgctttcttattcttcaccgtcttaggcataacgatattatcgaaccacatgttaccaccatcagatggcaccacatagtgcaggtgactgttttcagaaatcatttccgcagcatcacctgagtaatcaactgccaaggcagcctcatcttgggccatgtacatcttgatttcgtcggcaacaatcgccttaacgtttggcatcaatgtttcaagctttcccttggccgcagccaattccggaatgttcttcgtgttaactgagttaccacttgatgccaacgtcattcccatgatgtcacgagaagaatcaatcaacatgattgaattcttgaaacgtgggttccataggtcattccaggtcttaatttctcctggcttaacgtacttgtcgttgtaaacaattcccagcgttccccagaaataaggcactgagtactcgttaccacgatcaaacggttgatccataaaacggtcatcgtaattgttcaagccagtcaacttactgtgatcaagcttaaccaacatgttggccttcttcatcttctgaatcatgtaatctgacggaaccgccaaatcatagtgtgttccaccttgttgaatcttagtaaacatcgcttcatttgagtcgaatgtctcataatccactttgtaaccagtctcattttggaacttcttaatcaaagttgggtcgatgtaatctccccaattgtaaatcgttagggtcttattagcgcctgacttcaagccagactcagccgacttttgcaatgctaggttgataccaaataacaaagcgactgcggccagaataatcccggttaaccatgctaatctcttcattattgatgtaccaccattcccgctgcaccgccacgcttcttcttacttgacttcatactgtagtttgaaatgaagtaatagattgtgaccaaaagcaaagacaacaagaacatcaaggctgacaaggcgttaattgacaagtcaattccttgacgtgcacgtgagtaaatttcaactgacaacgttgagaatccgtttccagtaacgaagaacgttaccgcgaaatcatcaagtgaatacgtgatggccatgaagaacccagccaaaataccaggccaagcatatggcaaaacaacacgtgacaacacttgatagttagacgcacccaagtcacgggccgcgtcaatcaacgctgggttcatttcgttcaaacgtggcaagaccatcaacacaacaatcggaattgagaatgcgatgtgtgacaacacaactgacccaaagccgagactcatgccaatcatcgtgaagaaaatcaagaaactggcaccaatgataacgtccggtgaaaccatcaacacgttattcaatgatagcaacaaattttttgttccacgacgcttcgtgttgtatacacccaaggcaccgaacgttccgattagcgttgcaatcacagatgatagcaatgccacgatgaacgtattaaccaagatttccatcaagcgtgtatcagcaaacatgtcgccgtagtgacgcaatgagaagccttcaaagccactcatgtaatcacccttgttgaatgaatagaaaatcaaatagaagattggtgcatacatcaagatgaagacaaacaccaagtaaatgtatgaccacttttttggcttattatccacgacggcctcccttcttcttacgatcacgcgtaaagaacattgttgctgccatggcgataatcaaaatcactccgattgttgaacccattccccagttttgtgtcaccaagaagtgctcttcaatggcagtaccaagcgtaatgacgcggtttccaccaatcaaacgggtaatcatgaatagtgatagcgttggaatgaagaccgcttgaataccagccttcacaccgcccattgacattggaataatgaccttcgtcaacgtttgccatggtgtcgcacccaaatcacgggccgcattaatcaagctgcgatccaattcaaccaacgaattgaaaattggcataatcatgaatggaatttcaatgtacgccgcaacaatcataaacgatgcatctgtaaacatgatttggtgtgggccgataccaataaagcttaggaagttattcactgttcctgtcttagaaaatagcccaataaatgcatatgccttaagcaataggttgacccatgtaggcaaaataacaagtaacagccacaattgtgcgttcttcaaacggctcataatgtaagccattgggtatgaaatcaacaaggtaattgccgtcacaacgaaggcaaaaaataccgagttaaacgtcatacgaagatacgtccctgaactaaagtaggtcgcataattgtcgaacgtgaagtgtccataaatgtttccaaatgattggataaccaataggacaactggcgcaatgacaaagagaacgagccacaagtagtacggaaccgtgtagctgattgttcccttattcttcatttgcagctccttcttcctcttcagtatcctcatattgctccaaacgagcatcgaagtcttcttcagattcgttcaaacgcatgatgtgaatatcttctgggtcaaagtacaaaccacgacgttcaccgataacagctgggttcgtcgcttgaatttgccactcgttttggtcatcatcgtaagccgtaatttcgtagtaatcaccacggaatgattggtcatcaatcgttacgaccaacttaccttcttcttcagacaccaagtccaaatcttccggtcgcaaaacaacttcaacttgttcgttaggacgcataccaccatcgacgttttcaaattccttaccggcaaatgaaaccaagtagtcctcacgcatcacaccaggcacgatgtttgattcaccaataaagtccgcaacgaagtggttgattggttcatcatagatatcaactggcgtaccgttttgaacaatttcaccttcgttcgtcacaaaaatccagtcagacatcgccaacgcttcttcttgatcgtgggtaacgaagataaatgtaatgcccaaacgcttttggatttcacgcaattcgtattgcatatccttacgcaacttgtagtccaatgctgacaatggttcgtctagcaacaagacttctgggtcgttagccaacgcgcgtgcaatcgcaacacgttgttgttgaccaccagaaagctctgaaatttcacggtcctcatagccacccaacttgaccaattcaagcatttcagcgaccttcgccttaatttcattctttggctttcccttaatagacattccaaaggcgacgttctcaaatacgttcatatttgggaacaatgcgtagttctggaaaaccgtatttacacggcgcttttcagctggaacatcattaatacgttccccttcaaacaggatgtcacctgatgacgcctccaagaaaccggcaatcaaacgcaaaatcgttgtcttacctgatcctgaagggcccaataaagtgtaaaactttcctgcttcgatttctaaatcgacagacttcaatacgactgtatcatcgtattgcttagccacatgcttaaattcaataatgggttgtgccaattactgagtaccacctttctttacataagcttaattttaccaaaaataaggaaatttgtatcacttttccattccacttaatcgttctgtaaacgccatgaagtaaaaagcaccagcgagatgccggtgcttactagtctaataatcagtgtcagatcccatctgttggaaagcgtattgcataatcaccgctgtgataatgttggtgaattccttctgggtctttatctcttcagaagttggcatcttaacagattgattatcattacgcgtcgttgtcaattgcgctttgaaagcagtctttttacctgcaactaacgcttctgacgctactttgacttggtgccctttatctgccatggtaatagtcaatttagggttttccaggtcatcaattgatgctgtgatgtctttccaagtctccgccttaatcttcattgtcttagcagtttccgttttcttcaatgctcccacaaaactcttataatcggccttcttcaatgtgacttgataaccatccgtcacctttttgaactttttcccatccaagtccgtgaaccacttcgtcatggtttgtgcatcttttttaacagcttcgggttcaaccttactgtaagacttattatcggtttctaaccaggtattcttaagcactttcgccaactcaggaatgtccgttgcaccatccatcttcatgacatcacctaagaaaccagctgagacatacgtatgcttggcattcttctttaaatcatacgtcgcagtctgaccatccgttgtcacatcagccgtaagtgcgatattggccgtcttctttgcgtcttgcagaactttaccagagacacgcatatcggttttgtcagtcgaatttacactgaatttatagacgttatcgtccgacttaaacatgctcagcatgtgtgacgcaaattgtgctttagcagtatgtgtcacgccatatccaacaccacccgccaccacggctgcaacgataacaccgcctacgacaatcttcttattcatacactactcccccattcttatggtcatattttaacagtctaaaacaaaaaaggatgaagataactcttacgaattatcttcatccttaattttcatcttaatattgtaagcagtcgcttgtaattaaaaattactcagcgtctgaacccttaccgtactttgagatgatgtcatcttgcacgttcttaggaacagcttcgtagtgatcgaatgccatttggaacgttccacgtccttgcgtagctgaacgcaaagtcgttgcatatccgaacatttctgatagaggaaccttagcgtggatcatcattgagttaccacgttgctcttgtccttccaacaaaccacgacgggctgaaacgtgacccattgcatctcccaagttatcctcaggaacaacgatgtcaaccttcatgattggctccaagataacggcaccagcagtctttgcagcttccttcaaagccaatgatgcggcaatcttaaaggcagcttctgatgagtcgacatcgtggtatgaaccatcgtacaacttagccttcaagtcaaccaatgggaatccagccaaaggaccattgttcaatgagtccttcaaaccagcttcaactgaagggatgtattcacgaggaaccacaccaccaacgatggcatcttcaaactcgaatccagcaccttcttcgtttggtgagaattcaatccaaacgtcaccgtattgtcccttaccacctgattggcgcttaaagtaaccacgggcttgaacagtttgcgtaaatgcttcacggtaagcaacttgtggcgcaccaacagtagcttcaacgttaaattcacgacgcaaacggtcaacgatgatgtccaagtgcaactcacccattcctgagatcaacgtgtcaccagtttctgggttcgtctcagcacggaatgatgggtcttcttcagccaacttttgcaaagcagttgacatcttgtcttggtcagccttcgtctttggctcgatagccaattggataactgggtcagggaactccattgactccaagatcaatgggtgatccgtagcagtcaatgagtcaccagtagtcgtatccttcaaaccgatcaaagcagcgatatcacctgagaacacttcttcgatttcagtacggttcgtagcgtgcatttgtagcaaacgaccaacacgctcacgctttcccttagacgtgttcaaaacgtatgaacctgactccaaagtaccagtgtaaacacgaacgaaagtcaaacgaccaacgaatgggtccgtcataaccttaaatgccaaagccgcaaatggcttgtcatcgtcggcaatcaagtcaacttcttcgtcagtatctgggtccgtagcaacataaggcttaacatccaatggtgatggcaagtagtcaacaaccgcgtcaagcatcatttgcacacccttatccttgtaggcagaacctgcaagaactgggtagaattgcaatgaaatcgttgcacgacggatagcagccttcaattcagcttctgaaatctcttctccgcccaagtacttgtccatgatttcgtcatcaacatcagcgatggcttcaaccaattcgttgtacttctcttctgccaattcagcgtagtcagcagggatttcgcgcttctcccacttctcacccaaatcatcgattgggtacaaagcaaccttttcgatcaagtcgatgatggcctcaaagtcatcttcggcaccgattggccattgaacagcctttgcgttagcgtccaaacgtgacttcaatgagtcaactgacatttggaagtcagcacccatcttgtccatcttgttaacaaagacgatacgaggtacttcgtacgtctcggcttgacgccaaacagtttcagtttgtggctcaacaccggcagcaccgtcaagaacggctacggctccgtcaagaacacgcaatgaacgctcaacttcgatagtgaagtccacgtgtcctggagtgtcgatgatgttaacacggaatggttccttgtcgtattggtcgtggaatccacgccaaacagcagtcgtggcagcagattggatcgtgattccacgttccttttcttgctccatgaagtccatttgtgaagctccgtcgtgagtctcaccaatcttgtggatcttaccagtgtagtacaaaatacgctcagtcgtcgtcgtcttaccggcgtcgatgtgcgccatgataccaatgttacgagtacgtagcaatgggtattcacgcttgttagccatgagtatttctccttgaaattctattacatccaacacaatgttaatgcgttagtactattataccgtatattcgcaaaaaatggctatagtcttcacagactgtagccatcaattggttattaccaacggtagtgtgcgaaggcacggttggcttcagccatcttgtgcgtgtcttcacgcttcttaacagatgcaccagtgttgttggcagcatccatgatttccttagccaaacgctcatccatcgtgtgctcaccgcgagcgcgtgagtattgcaccaaccagcgcaatcccaacgttacacgacgttctggacgaacttcgacaggaacttggtagttagatccaccgatacggcgagccttaacttccaatacaggcatgatgttgttcaaagcttcttcgaacacagccaatggctcttgaccagtagcttccttgatacgatcaaaagcttcgtacaagatagttgaagcagttccgcgctttccatcaagcatcaaacggttgatcaaacgtgaaacaagctttgagttgtaaattggatcaggcagaacttcagcctgcttagtgtaacccttacgtggcattattaatgtcctcccttaattacttcttcttaggacgctttgcgccgtactttgaacgtgattgcatacgaccgtcaacaccggcagtatccaaagcaccacggatgatgtggtaacgaactccaggcaagtcctttacacgtccaccacggatcaaaacaactgagtgttcttgcaagttgtggccgattccaggaatgtatgccgtaacttcgatcaagtttgaaagacgcacacgggcgtacttacgcaaagctgagttaggcttcttaggagtcatcgttccgacacgagttgcaacaccgcgcttttgtggtgaagaaacgttagtcgtcttctttgattgtgagttgtaaccgaagttcaaagctggtgactttgacttcgtgctctttgacttacgaggcttacgaaccaattggttaatagtaggcatgtctaagagtcccctttcaattttctatatagtgtgtagtccacatttccaggcgtgtcatttaataaccaatctgaaaacgtagctgaatggtacttctcgttcacgagttcagcacgtcgcgtaacacgcaaacaccctgctcactaaaagcacaagtaataatataacactgcattcacgattatgcaaccctttttaccaattaaaaatgcctatatataggcattcagtttgcaaacaattccgggcgtgtcatttttggaaaatccgctgttttcaagctctttcttactataaaacaatggaggattatcaatgtcgatctacgacctgccctttattatcgcactttgttcactaactgttcaagatttgaaacagtgtctaatcgattcaagattattagccccagcattcttattgggtgttacacatcatgattcgcatccggttactgcatttattatctatgtttgtgccttaataataaatcaccattaccgtgaaaagtttctcggcaatggtgatctagatgttatttttgttggtgctcttcatttatcaccagatcaactacctttatggctcacaatcagctgtggccttcatttacccattagtttgtggcagccaactaagccattacccttcttaccagccttaaccgttggtttcctgctgttagaagtaatccgccaatacggggtgttgacgtgttaataatgcgtccaccggttcaaattcttctggtgtgttcgttcgcaactcgccggtcaatagcaaactagacaatcgtttgtaccccagcaaccattgtgtgaatgcttgaatgctacccgacaattgcggtgcctcagtttgaacaacacgttctaatgtgccgccacgtagttcaaagcgtccaccattccacggcgcagtttcatcttgaacatcaaacgcaaccgtctccggcacatctagctccagaacttggcacaacgcttccaagttcacaatacgcgcttgcatatacggcttaacgaccgcttgatatttaggttcggtcatcaattgtgcaaccggcactgctgtgacgtcagctgttggtgcctcgtaagtaaacacttcaaacgaccccgcatggctgccaatgaagcgagtcaggcctagtaaagcttccgtggttagtacgacccactcacgaataacgaatgtcatctcgcggaactcatacatgacataaccttgcgccacaccctcttcatctcgatagatagcgaacttcgtctgtggcgttttcatgctgaagtaatagcgccaccaccagtcctcgcgagcaattgccccgtaattgaagacatctgcctgtcgatagacaagtttcattggctcgagcgctcgctcaaacggtaatctttccacaacaccaggtgttcgcttaccttgtggaaaatcatctgcacgccatgtgatatctgcatgatcaaaaacctgggcataaccaaaacgaccatagaacccatacgaaaacggcgctaagtaacttatcacctcacctgcatcatacgaatcttgcagtgattgcatcattagccgcgatgcagccccgttacctcggtattcgggataactagccacattgccgataccgttaccggcaatttcccggtgcccaaggcggacactaaacggaatccgggttacttggctggtcaattgattattgtcatcaaattctccatatacggttgtttgcttgaaaaattctgctaaagcgtcacgtcccccacgtggctccttatgaaatgcataccgataaagctcatacacggcgtcaaagtaagccgcttctagaataactggttatcccataaagtattccccctatacttattcgccattatcgtatcacacttagctgtccaaatcttgcttcacccatgcaaacaaaaaaacgcacctcgaaccctaaagttcaaagtgcgttttactaagcattaaaccaatgccaacaactcagccttctttgcagaagctgggaagtcgataccgttagctgacaagtaagccttgatttcagcaacagtgttcttgtctgaaggcttctctgatgaagcaactttcttagcagccttaggagcagcggcgttaatcttaacacccttttctgaagtagctgctgaagcttcgcgaacaacttgaccgttgtctgccaaagccttcttagctgcgtctgccaaagctgagaaagcttcgaagtcagaaacagccaagtctgccaacatcttacggttcaaagttgaacccatcaatgacaaaccgttcatgaaacgtgagtatgacaatccgttcatacgtgctgcagcgttaatacgtgcaatccacaacttacggaagttgcgcttcgtttgcttacggtcacggaatgcatagaaccatgacttccaaacttgttgcttagcaaccttgtagttgatgtgacgttgaccacggtaacccttggccaacttgatcatcttcttgcgacgtgcgcgcgtaacagtaccacccttaactcgcatgggtatttcctccagtaatttctataatttctaattcagaaccgatgaataatttaaagttaaaacttcaaattaacggctcaacatgtgaacgtaagtcttcaacgtcgtgttgttcatcattgaagttccacgtagttgacggcgttgcttcttagtcttaccgtggaaacggtgtgacgtaaaggcgttacctgacttcaaaccaccgttagcagtcttcttgaaacgctttgctgaagcgcggtgtgtcttaaacttaggcattgatatgtcctccaaacttggtttaattacttagtttccttgggtgcaagcaccataaacatgctgcgcccttccatctttgctctagattcaacttttgcaatctcctctagatcagttgcaaatcggtccatcacttcacgcccgatttccttgtgcgtgatagcacgaccgcggaaacggattgaaaccttgaccttgttacccttctccaagaacttaacagcgttcttcttcttggtgttaaagtcgttgtcatcaatcgttgggctcaagcgaacttccttgatgctgacgattttttggttcttacgttgttcgcgttgcttcttttgactatcgaaacggaactttccgtaatccataatcttagcaactggtggcttggcattagcttgaaccaataccaaatccaactcttgctcgtcggcgattgcttgcgcttccgccttaggcataattccttggtcaccgtcatcggtgatcaagcgaacttcacgagctcgaatgcgatcattaattaaatcttgttgttgttgtggttggcgcgcgtttgctatggtccttacctccgaaaaaacttgaaataaagtaaaagcggattatcgcgacacacgataacccgccattcatcatcaatcaataatgagtgatttacccgatgaggtaaactcatcaaggtgaacaacggggtcgctgttactttatttctctaacagttaaatagtatataaccttattctccaagagtcaaggctttgttcaaaattccgttaataaactttcgtgatgaatcatccgtaaagtcgtgagccaattgtagggcctcgttaacggcaatcttggctggcgtttcagtgtactttacttcatacaatgccaaacgcatcaatacgatgtcggccaagtttagacgatcaagcgtccaaccatcagccaagtgttctgaaatcgtcaagtcgaactcatcttggtggtcaatgatgccattaaccatgtccaacaagtccgttggcaattcgtcttcccaagtaatttctggatcaccatcaagtacttgttggacaactgcctcgacttccgcatcaggattcattgccaatccaaatacagattggaatgcggcttgtcgcaattggtgtcggttcaatgttgccattatgcttcagttccttccgtctcattgtcatcaccaaacaagttgtttggatcaacagtcaacgttggcttcgttgaaacaacaccttggatgtgcacgtttaccatcgttacttgcaattcagtcattgcagcaacttgtgacgttacacgttcttggattgcgtgggcaaccttaggtacgctaacaccgtagttcaagtaaacgtatacgtcgacttccaatccatcctcgccttgcttcaattcaacaccctttccgtgaacacggcgaccgaatgcttcttgagcacgttctgagaatgaaccacgcaagcgagcaacaccctcaacttcttgggctgcaagcccagcaatgatttcaagaacacgtacgttaacacgtgtttcgcctgaaatatcgcttgggtgcgtcaatacaatggtttcttctgccatggaactttcctccttcaaaatgaaagcgccggccggctgccggtcggcgctttcaacagtatatttattatacctgattttacttgtaaaaactaggcacgtgacgtgtatgatccaccgttgtcagtgttaacaaccaacttgtcaccttcgttgatgaagtcaggaacagtgataaccaatccagtttccatcgttgcaggcttaccaccaccgttagcagtagctcccttgatacctggttgcgtttccttaacagtcaactcaacagtctttggcaattcaacgtccaagatttcaccctcgtaagtagtgatcttaacgttcatgttttccaacaagaacttcaaagcgtcttggatcttgtcatcaggaattgaaacttgttcgtaagtttcgttgtccatgaagacgtgttggtcactttcagcatacaagtattgcatttcagtcgtctcgatgtttgcagtttcaaacttgtcaccaggacggaaagtgatttcgttaacagcacccgtacgcaagttcttcaactttgaacgcacaaaggctgctcccttaccaggcttaacgtgttggaactccaacacgcgccagattgattggttgtactcgatcgtcaaaccagtcttcaagtcattcataccaatagttgccatgattgaattctcctagatttatgtctttctgaattatattagcagagtttttgtctaaaaactagtattgcgtgcttttttgttcggaaaaatgttgtgttgcgcttagtttccgccctaaacaaaaaacgaagaaccacaactgcagttctccgtcattaacttctatcttacaaacgtgccttcaattcagccgtcaactcttcgtagcctggcttacccaacaaaccaaacatgttgcgcttgtaggcctcaacacctggttggtcaaatgggttaataccattcaagtaaccagcaatggcaacagctacctcaaagaagtagatagcttgtcccaaagcaaattcgttttgcttgtccaactcaacgatcatgttaggtacaccaccgtcaacgtgggccaacaacgttccttctgaagccgtacggttaacgtagctcatcttctcgccttgcaagtaacccaaaccgtcatcagcgtccatttctggaatcacaacgtccgttactggctcagttacacggaacaacgtctcaaacaagttgcgacgaccatcttggatgtattgtccgaaactgtgcaagtccgttgagaagtttccggtagctgggaagatacccttgccatccttaccttctgactcaccttgcaattgcttccaccattcaccaaattgtaccaatgttggatcgtagttaatcaacaattctgttgtataacccttgcggtacaagatgttacggtaagccgcatactggtaagctgggttcttcgtcaaatcagcatcagcgtattcagcttcaccagctgctgctccagccatcaattgttcaatgtcaccaccagcagtcgcgattggcaacaaaccaacagccgtcaaaactgagaagcgaccaccaacaccatcaggcacaacaaactcttcgtagccttccgtgtcagccaacgtcttcaaagcaccacgctttgcgtcagtcgtggcgtagatgcgctcgcgagctccttcaacaccatacttttcttccagcatttgcttgaatacacggaatgcaatcgctggctcagtcgtcgtacctgactttgaaatcacgttaactgagaaatcgcggtcgccgataaccttgatcaaactgttcaagtaagccggcgcaattgagtttccggcaaacaaaacttgtgggaagtcgcgttgctcatctggcaagtagttgttgaagtattcattcaagaaatcaattgccgcacgggcacccaagtatgaacccccgattccaataacaaccaaaacctttgagtctgattggattttctttgctgctgcttgaatacgggcaaactcatccttgtcgtattcagttggcaagtgaagccagtcagtgtaggctgatccagccccagttcccttacgtagcatttcatccgcaaccgtaaccattggttgcatcatagctaactcttgctccccaacgaattgggctaactttgatgtatcaaacttcaatgtcgtcattgtaaattacctcattccccattaataacttttggtatagaccaattataccacttcccaaaaaatcttgaaagcggtttcggcaatatcgcctgtttgtttttgaacgtttcgccaaataatctttagacgtaaaaaataacgggcacccgtcaaacgaatgcccgttatgtggattacaaattcttaaatgcgtatgtcgttgtgtatgaacgcttctcgccggctggcaagacaatatcaccaaactcagggtggtgaatagcatctgacaacgtttgcgcttccaaggccaccgcgttgtatgggttagcttcgaaccaatccaaatcaccttcgtggtcagcaacagctgggttcgtgatgaagaagataactgcattacggtcagtcgtcatttcaattgcacgacctgacttctcgtccgtcacgattgctgatggtgtaccagcttcgtaaaccaactcaaaagcatcgtcaaacttagcatcatatgcaccgttcatctcagcaatcttgtcaccaatcttagccggtgtttggaagtcgaatggcgtaccagccgtctccaacaacttacccgtaggaatttgatcctcacggaattccaagtgacgtggtgacttcaattgcaacgtcaactcacgcgcatccgtatcaatcccggctgggttgaagtatgcgtggcttgttgggttgtacaacgtgtcttcgtcagactcagctgagaagtccaaacgtacttcatcgtcgtccgtgaatgtgtacgtcaatgatgttggcattgtaccagggaagttatcatcagcttccgtcatcgttgtcgtaaacgtcactgaaccagcggcctcatcaaccgtgaagtcccagttacgcgttgcaaagttgtcttcaccaccgtgcaaagcgttcttaccttcattggccttcaaattgaccgtcttaccgttcaactcaaatgaagcaccgtcaatacgaccagccacacggccaatcgcgttacccaagaagtaagcgtggtcccagtagccttgtgcgtccttgtaagccaaaactagttcatcaccagccttagtttgcaagaattgccatgaggctccccaagaaaccaaaccaagcttgtggccattagcattctcaataaccacttgctttacaacttcaccgttaggcattgtgcccaaatcatttactgtaatcgtcattttactgttgtccttttcatgatgtcggctcacagtctcaaaaacttatctcgtgaatattttatcatactgaagcccgacattccgactaaatttctaattcaaggtctataccaactggcattaatcctcatgattaacgcgcatcaacaaatggtacaacgcaccaaacaagtttgcatcattaccaaaacgggctggtagaatttccggcgttgtaaaaccgtcacgaacttgtgggcggcgcgctaccaattcttcgtatgattcacgaatagtttggaccacaattggttgcgctgtgatacccccgccaatcacgaaacgttccaaatcaactactgcttggatgttgagtagcatcaatgccaggtcatctgtataacgcttaaagacatcccatgctggtccgtcatgcttattaatcaactcaaatacagctcggccatccttcttgtctggcaaatcatagatggtcgcaatcgttgaaaccatttgaactgcagagccaacaacgccgtatgagtccgtgtcaaagcgtgcctcaccacgatgcataaagcttaattcaccagcttggaagtgcgtacccgtgtgcaaacggccgttcaaaatcaaaccaccaccaacaccggtccccaaaacaactgccgccccgttatcgataccgttcaagttacccaaccaaagctccgcaagtgcggctgccttaccatcgttttcgactgcgactggcatatccaattgcagctcatcaactagattcaccttatctaggaatggcaatgcgccacccgcatagatggtttcatctctgtgatcaaccttacccggtgcgctaattgccactcccttaatgcggtaccggtataaatcaacaatcgtgtgaaccgctgcgacaaattctgccaaactttcattcggcgttgccacatcgtccttttcaatcaagtttcctgcatgatctagtaccgcataattgatgcgcgtacccccaatatcaattgccaaataatcattagcttccatgttttattcccccgaatacatgtttgctctaagcatacctgctagatatggtagaaaccggacaaaattgcgaaaaaagaacccgtcgagcactatgtccgacgggttctgttacgcttaatttcttattacaaagtcttcaacttagcaatcatgattgcaccgatgacaaccaagatagctccgataacaacgaagaccatttgacgctttgacttcttctcacccaataggtaaatggcaccgaacgtaccaacgatgataccagtttgtgacaaagttgaagccgttgcttgaccgatgttagggttagccgttgagataaacatgaagacgttacccaaagcccaaaccaaaccagtcacgatgttcatccaagttcccttttggaacatcgtcttaccttccttcataaagaagataacgatgatgaaggcacccaatacttgaccaattgattgtggtccaacaatggctgtcatgtagtccaaaccgtcgtgacggttgtgaacggcgtttgagatgtaaccgatcttgttcaacaagttagggaacacgaagtacatcatgtaaccaatcgttgaaatcaaaacggcaaccaaaccacccttgaagtcgtgttgtgggttaacttcggctggtgcctttgaatctggcaaagccgtaaagatagcaccaatcacaactgcggcgatggccaacaaaccaaacgtccacatgcgaccagttgtccactcacccaaaacagccgcagctatcaaagcgtttgaaacaatttgtccggctgttgaaagtgggttaccaactgaaacacccaacttcttgaacccaacgaattgtccggccgtaccaactgcccagaacaaacctgaaacgaatccgacaatccagatgcgtgggttaaaggcaaactccataccagcttgtgggacaacaaacaatcccaacgtcaacattccaaagacgaaggcaccgaacgtcattcccaacgttccttgtgcagcagtaccacccatcttagtcgtaacaagtcccgttgacccccaggccaacgcaggaataagtgcaatcaaaattgacatagcaaaatttccttcacaatcttaaatatttttagtttatttatcaacgagatttagaataacataatgaaaacgtttacacaacactttttactaacttttttgaaacgctttcaaaaaaatgtaaccgctaccaattaaactatagctagagtccagtatttaaaagactttagcgctatctcgatatcaacctaacaaattataagacaatcgttttcaagtacaacaaaaaagtccccgttaccggagactttaagtcttaattatgaagattagtcgtttttcttttgctcatcaggaatgatgacgtggaatgatgtgccgacacctggttgtgattcaaccgaaatttgaccatcgtgcacttcaatcaattgacgaataatcgccatccccaaaccagactcacccttcttcgtacgagatggatctgccttgtagtaacgctcccaaatcttgttaacttggtcttcggtcattccgatacccgtatcagaaatcttgaagtgcgcttcgccagcttcacgccaagcatcaattgtaatcaatccattctcagtaaactgaatggcgttgttcacaatattaaagatgatttgaataaagcggtcttggtcagcgaatactggcactgccgtcttagcgtgcagcttgatttcatcaccagctaaatcagacttaccagccaactggtcaatcaagtttgaaatcactggtactgaatcaaattccttcttcttcaagacaaccttgttctgacgcaaacgctcatagtccaagttatccttaaccaaacgcgtcaaacggtcggcttcggccttgatcaagtcatatgagtgcatcttttcatcttcaggaataaccccgtattgcaatccttcgacgattcctgaaatggtcgtcaacggcgtacgcatctcgtgagacgcattggccatgaattccttacgacgttcttcttgctcttcgatttcacgttcttgttcggccaatgacttggtcatgacgttaacgtcttccgccaaagccccgatttcatcgtgacgatgcatgttaacagccgcggtataatcaccacccgcaacacgacgcgtcactaactgaatcaaacgcaaacggttaacaatcaattgtgacaaaatgaaactcaacataaccgcgacgacaactgataccaagaaggcgatcagcaagtttttacgcagcatgtccatgttgtctgccacagtcgatacattcgcgcgggtaacaaccaccgcaatcagtttattctgattgtcgaagaatggtttcatcacatccatcgtattcgctgccgaattatctgctggattagctcgcttagccccacgtttttgaatgattttatgttgctttaattgtgcccactctgcatcggtaacgttagcagtctccttagcttgtgtctcaggataaaccaacttacgttcatcgttgtagagcgtaaaactaatattttgttgttctagcaatgacgcatccgtttccagtcccttcgtatcgaagtaggcaaaggaaccgtcatcagccttgaagcgcatcgcctcttcagccacggcaaccgcataacgattcaattgatgataagtattatcttcaatcatcttcgtcgtaaactgcgtaaacaaaatgccgacaattaccagagtagccatgatgaccgtaaagaaggccaacatttgctggtacatcattttcatgttgttttaccaaaaaaccacgccaggatgacgtggtgatctttcgttaatctctcttatattctcttcaaactagcttaggccttagcagaagcttctgcctcttcatcagcggcaacgtttgaatcgtcgaacttatatccaacaccccaaacggtttggataacttgaggaccaaccttttcgatcttttgacgcaacttcttaacgtgcgcatcaaccgtacgctcgtcaccaaagtactcgtagtcccataccaattgcaacaattgctcacgtgagaacacttgacgttgcttcttagccaagacacgcaacaagtcgaattcctttggcgtcaaatcttgaatcaagtgaccattcaagtaagcttcacgcgtgtttgagttcaacttgaacgtacgtgtttgtacgtcaaagtcttcgtgcacagctggttctgaagatgctggttgaccagcagtctctgaacgacggtgcaaagccttgatacgtgcaatcaaagtgattgggctgaatggcttcgttacgtagtcgtcagctcccatttccaaaccaagcacttggtctgattctgaatcacgcgccgtcaacatgatgattggcacatactttgatacttcacgaatcttaactgcaacttgcataccatccaaaccaggcaagttcaaatccaagataaccatgtcccatgactctggatcttcattaaacatcgtcacagcatcgttaccatcgtatgcgtagtgagcgtcccagttttccttcttaaagaacatgcccatcatttctgaaacggacgtgttatcctcgaccatcaaaagtttcatattcttattccccgtcttaatagtttttacaaaatcaattctttatttgtacacctaacacaataacaaaagaaaagcgattattgggcgtttttcacagaacgtctacaaaatctggcgactattctaaaaaacttcacatcttttaaaccacttacacgcggatagctatttttttatcacagccgtccacagtcctttataccgtatattatacaacgtaaatacggaatacttcactcttacttaaaaaaagcggtgcaaatccggtacgctccgatgtttcggatatacaattcgcattacctgaagaaagggcgtgttttctatgatgaacacgccctttcaatgaatgttgttatttaactatgataattgtgtctgagatgtttctgttatcaattgttgaacacggcgcattgcttggcggtcatgtcccacatgattgtccaatgtttgctgtaattcgttcgcaaatgccacaattgccaaatgattggcggcgcgcgtcaccgctgaataaatcaggtttgtcgtaatgaattttgaaatcattggcaaaacaacaatcacattatccaatgtaaatccctgaattttatgaatcgtcgtcgcataccccaggtcgaggttttcacggacgctgaccagcttaggcccgtaagaagatggattaaacccagtctgactcgtttcgttcaaatccaccaaaattggatcagccgtatcaaccgtttgaaccaataccatgtcataatccggcatgacatcaaccaccgtgatgcggtctccaccacgcatacgaaccttctcacgtgccccactggcttgattcgtgacatacaccgtttgcataacttgcacacggtcacccggatacagcgttaagtcatcgcgcacccacaagccaacttcagtgcgtaacaccggtgttgccaccaatgcgttttgcacggctgcattaatcaaacgacgtagttcatttgttggtaccaagacaaccgtttcgttttccggttcggcaatcaacgctcgctttaccgtctcaaccacctgcaatagcgccgtttcactcattggcgcaaacgtataaggtcgcgtcaaaaagacctctggcaacacctcagcgggtatcaattcatctggggccacaatcgtacttgagtcaccatccaaaatcgcattagcgacggttgcaatgattggtgaattggcacgcttgatttgttgtaagactggtgtgcggttcgctagtccagccaataccaaggcattcagcattggtaccgggtcgttttcaacagatggcaactgatttgggtcacccaccaacaagatttgcgaccctgtcgccagtccatacaaaatggcatcaattagggccctgacatttgaagcaaacgcctcatccacaatcattaaatcgtacgttgggtaacgggctgcgcgttctgggtcatcaaagaaatgtcctaagcgtgcaatttcagtcatcgcttcgtgattacggtacgtaaaacttgtcgccgtcgcaatcgtcacgtgatcaaccggcttcaacagatattctggttcatgttcgtccaacaaatcaccaatcgccctttcaaccagaccacgcgcattcgtcgcagctgcgtgtgttggcgtaatcaaaatcgtattcacatcgccttgctgagccaaacgaatcaatcgggccatcatgtaggacttacctgacccagcacgcccagtcacaatctggatcggcgttggcgtgtccgcaatatcctgccagacctcatgctgtccagccgtcaacgtgtcgtcggccaacatccccgcaatcaactgttgcatcacagcgggcacatcatgtggttgttgcaacatttcaagcaatgccaacaaccattgatcataatcttgctgattttgtagctctggtggtagtttttcgaaaatctcgtgggcgaacgccttcatttccgattccggggtgtgcgccattaaatttgcaaaactattcttttcataaatctgttctggtaacttgtgccgccagaaatacatttctgtttgttcttctggaaaccgtgccatgacccacacccctttcgttttttatccttactaattatacgcaactgcacaaaaaaacgagcgaaacaagttcactcgctttccctattattctggcaaattaatcgttgcttccgctggcttcgtttcaaccaaaacctcaccattgtgaattgaatacaacatttcggcacgttcgttcaacgcatcaaaccagttcgttgcgttgaaaatcaagaagttagcgggcttgccaacttcaataccgtatgaatcttgcacgtgcatcgtacgggcaccgttcttcgtaatgaagcggtatgaattcatgatttctgaataccccataatttgcgtcgcgtgcaagcccatgtgcaaggcatcgaccatgttaccatttcccattgggtaccatggatccttgatgtcatcctcaccgaacgccacgttgataccttcagcatccaattccttcacgcgcgtcaaaccgcgacgctttggatacgtatcaaaacgcccacccaagtacatgttaatcaatgggttggccacaaagttaatgtctgacatctttagcaaacgcatcaacttgtaaacgtaggcatcattgtatgaccccatcgccgttgtgtgtgacgccgtaaccttttccttcaagccagtctccagcgccaacgtagccatcgtttccaaaccacgtgaagctgggtcgtcgatttcatccgtgtgggcatcaatcaacaagttgtacttttgtgcgacttcaaaggcaaagtgcaatgattcaactgagtattcacgcgtgaactcaaagtgcggaatggcaccaatcgcatcaacgccaagctcagctgccttaatcatcaattccttaccaccagggaatgacaaaattccctcttgtggaaaggcaaccaattgcaacgtcatccaaggcttaacctcttcacgcacctcaatcaatgccttcaaggccaccaaatcagggtccgtaatatccacgtgtgaacgaacgaactgcaaaccgtgagcagcttgaatcttcaacgcttgaatggcacgttgcttcacatcttcatgtgacaacgtcttcttgcgctctgaccaaatacggataccgtcgaacaacgttcccgtttcgttccattctggatcaccagccgtcatcgttgagtccaagtgaacgtgaggatccacgaatggcggaatcatcaacttgttagtagcatcgatgacttgttcacctgcctcgggtgccaagttatctgcaatttctgcaaacttgccatcaacgatacgcacgtcctttggctcagctgcattttcaattaacacttgcttgattagcatttctttctctccctggaaaaaattaatgttgtgaactgttaatcgagtataccacttatttcctatcttttggatttaatttaaagccgtagaaagtgctgcccttgaaggtttgctttgccattttaccgactgcggtataagcttttccacgctttgacttagctggaaaactaatttcttcgcctgccaacagcttggtgatttcctcgtccgtaaatttgtgcccactccattctttagcaaaggtaatctcttcacccttgaacgttcccgtcgttttctcgctaactttgcgaactggcttaggctttggcgcacccagtgttgcctgcaacgcttcggcatttgcgaccattattggcatgtcgtgttcaaccacttgcgtcacggattcaagcaacttgggcactgtcatcttaaactcaccaacttcatccatcatttcaaatagacgcttagtgatcttcggcgaggcaatccacgtgcccttcaccatcaccgctgaaacattaccagtttccgtcaacgtcagcttacccttcgcctcacgcaacatcgccttttgccctttgcccatttcagacaaggttgagacacgcgtcgcaccggttccaacattatgcttttccaaataggccataatccactttgttgacggatgttgtggcttcttattcgcaccttcatgcaaataagggtcggccattggtccaagcgcacctgcttggccctcctcatcatcgtcatccacacgcgttgccgcatatgaatcgtagaccaacttaaagttcaacttaataggtagattgaaggccgttttaaagttgggataatcctgcaattcagctgtgacgtggtcatacacgtaatcttcagccaacatcgccaaatagttctttgccaacacttcgtaaatcgccatggcactgtcgccgtacttctttaagctctgcacatcagctggcacgttggtacccggacggtttgcaccgtgggctccttgcgccttaacgtgggttggtcgtggctgacgatgcgttaacaaactcttatccaccccaaccaggtccgcaatgcaatccactaatggcagcaactcattgaattgttccggtgtcaccgtcttgtcttctgtacgtgggtacgacacgacttgggcttcgtacatcttttgatacgttgccaatacttcctttgacgcataaccacgtggcgccaacacagccgccaaaccagccaaatcaagcaatcgacctggggcttgcgtacgcgtctggtgcttttcgttcaccaccgcactgctgtggtattgcgccatatcagcttgtccctcatccttggtcgcaaagcgccatggaatcacgtcaccgtccttggtcacgcgaccaaatacgtgaccggccgggtccttaaacttcacttcataatatggtgtgcggacgtagtttttaatcgcttcaagttgctcataaatcttccaaacaatcaccgacttcaaacggccttcacgcgccactaccttgtagcccgccttcttagctgaagtcgtcgcaatacgagttaattgcattgacgcgaaatcccaacgattacgactttcacccttcaggtaggcaccgtgttgatttttatccgtgacatcagtcaaatcacgcatggccaccttaatactcttcggtgattcatccatgaaattggcacgcaatacttggcctttccagccaatcgcatcaatcgcttcccatgccaacaaatctccttcaccagacggatccgtatcagtcgcaatgaccaacgcgtcataacccttcttactttcggctttcagttcatcaagtaatttctttgaggattcagacttaccagtgcgcagattacggctacgaatataagttcgttgccacttaaaatcggccaagttccatggcatgtacttcaacgtccatgatttgtatgccttctgcaaatccggcgccaccatttcttccggctccttaagcgtcatcacgtgaccgcgcaggtttgtgatattgaagttattgccttcaaagctaccaactttaccgcccaacgctttcacgaagttctgcgccgctgatggcttttccgtaataatcaaataattagccatacggacctcctcttgtttagcatgagttctattatacgtgatatgaggttagttttaaattaacattttaagtttgtgtgtcgtcgctaacccaccgaaatagactagacccgccgcatttgcttcgtgcgtaagcacgaacacaaaccacaaattaaaaagcaccagaacccaaattgagttccagtgcttactgttttacttcttaattagcttcgttgcaacgtagtaaatcaatcccgtcaatgccatcgccacgaaagttacaccaatcgtttggctaatgatgttcactgacttcaaaccgaagtacaatccaattccaacggcccatgaggcaatcgcaatccagttcaaaccaccgttgtaccagtacttaccatccaccttcgtgaattgatcaagtgagtattgtcccttacggatgaagaagaaatcaaccaagaagacggcgatttctggtcccaagaacataccgatgtagtccaagaacaagatgaaggcatccaagaatgtggcgaaccacaatggaatgaatgacacaagcgttgcggcaatcgttacaatccacaaggctggcgttagctttaccttgtgccacatgtttgtcaaagcagatccggcggccatcaagttaaccgcgttggccgtcgttgacgtaatcacgataaccaacaaagcgataattcccaagcccaactttgaggcaatcgttgatgggtctgaatcgtttggatcaaaagcgttgttcatcaaggccgtcgcaatcgtagctgtcaaaccgatgaaggcgaaccagaacaatccgatgttcgcacccaagaatgaccaaccagtcgcacctgacttacgcttcgtgaaacgtgagaagtctgatgacgccgttacccaggccaagttgaaggcggccaagatatcaatggcggcacctgatgagatacgcacctttgctggtgggttccaagcgaagatgtcagccaatgacacgtgttggaacaccacgattgattcccaaagcacgaagatgaaaaccaacacgattccgatacgctcaatcattcgaaatgaacgctcacccaatgagattgatgccaagtgcaacaatgacatgatgatgattccgatgaccaaaccagccttaccaccagctgtgtaggcttgccaaccgaacaagtccttgaagataaccgaaatcgagatagcggcgataaatgtatttgcggcggcccaaccaataaattgcacaatgttaatgattgatggaataaatgaaccacgcaaaccaaacgacgcacgcgttaatgccatcattggcaatcccgtcttgtaacccatgaatgatgccaatgccaacaaagcatatgacaccaatccagaaataatcaatgtcgttgacgctgtgtacatacctgcggcggcaatcacacctccgatgtaccacgttccgttattggcatttgcacccacccatgtggcaaacatatcccaatttgacatcgtacgcttgtcggctgaaatcacttcaacgcgaccgaactgcttttccatattcccctccttgcaccttggttaaccgttttattaaaaatgggccactccgtaacaaaaaatgtacagagcggcccgttaaagtctacagttatccttagtgacgcgctctttggccagctctcggctgacagttaaaagaactattcaaaattttcaactttgtctactatacggggtcatatagttcatgtcaacagctcatcaactagatttgttcccaagtaattgactccaacgatgggaaaatgtgaatcatgcgttcgacttgttcgtcatccaacccaagttcaaccgccggcaatagcgtaccaatcacttgctcagcgtagtcactcatttcagttgcgccgaccaaatgatgttgctcatcaaaaatcaattcgttttcaccaaactgctcattcatgacgttacggtaccagttctttaagacatcatgcgtttcaatctggtacttatccggagtcgtaatttgatcagcttgcaaaccaacttttgcaattcgtggcgacgtgaaaaccactgacggaataaccggataatcaattggtgccgttgtatcgcccgcaaacaaatgcatcaaatacttcgactcgaaaatcgctgtcggtgtcagcttaggttgtgttttatcaatcacatcccccgccgcataaatattatcaaccgtcgtttgcaaatgatcattcaccacaataccgtttttgttgtaagccacaccgacctcatccaatccgaagccttctacgtttggaatacggcccgtcgcgtccaacacccaatcagccgtaactgtcacatcagcgccatcagtgacaacaacttgattatcaaccttctctgcttttttcaagctaacattgcgcaagaaagttaccccacgcttcgttaaatcagcgataatttgctcaacatagtcttgcttaaatcctttcaacgcttggtcaccatgcatgattaccgttacctttgcgccagccgcatttgcttgcgtcgcaaattccatcccgatataacccgccccaatcacaacgaccgaggccggcatttcttctaacgccaaaaagtctttcgaaacatgtaatagctccgtcccctcaatcggcaaatgatgtgaccgcaaaccagtcgccaccacaattttgtcagttgatagctgacgatcaccaaccttgactgtgtggcggtcctgtaaaatgccgtagccattaataatttcaatgccgacagcttccatgcggctgacctttaagtcgggaataccgccaattacggcttgcttatgcttctgattggctgcccaatcaatgtgtgcatcattcaccggcaacacatcacgcatattctccaacgaacggagcattgcaactggtgcatctaatgtgattttcggattgcagccatagttggaacacgtcccgccgataatgccatcctcaataactgcaatgcgcttgccacgctttgctagtggtattacaccatcaaacgttccgtgaccagtccccaaatacacaacgtcataatcgtattctgccatttaatcgtcccccaaattaaacaattagcatctcttaaacgactacatcgtaccgcgtttactccctgaataccaacaaaaggccaagcacgcaaaacgcacttgaccttcgtcattttttctattaatccacaactggacgccattggtgatcaattggcatttcagttgaccaaccaatgtattcaacatcgccactgccacgtagccatgccaaaacttcatcaaccgaatggaacgtgatgtgtccattgcttgatccagttgaaagaaattctttcttgtatccatcccaaatcacaacgtgaccaacgctaccgtgagcttgatccacaaagcggaagaaaaccggtacataaacgttttctgggaaatcttgattgttgtacataactggcgcatcgtcagcggccattgcagccgttgcataccctgacgcacccccaaaggcacctgccacatacgccaagcacatccaagcttcagccggtgcatcaagatttggctgaataacttgcttgtatgtcttagtcgtttgttgacttggcgctgcggtacccggcacgtagttaatctgcttgatcttcattgtctttcccccgaccgaagcagctaccgccttatttactgctgctgatgagacagcatttgtttttgtgtcagatgctgtgaccgtcacaccacccaacgagcttaaagttgcaaccaaaagcgcaaccgcaacctgattcatctttaatccctgtttactcatagtaattactatacgtcattcacagttcaatacaatatcaatcagattttaagttttttacaaaattacaacaaaacaagttttaatagttgactaaatgcttcccttaagaatgcccatcgcagccaaaagcatcactacaaacgttgccactgatccaaatagcgctagccacgtaatgacacgcgcaactgtccaaacacggtaaccttcatagcctgacgtttccttacgaccttggtacgtaaagaaaacaatcaccgcaaaaattgacaacacagcctgaccaatgacgcttaaccattggacaaacccttgtggcaatacggaaaacaacatgtagttacccaaggctgctaacccaactacgattgctaaaagtacagatgccatcacaattctctctttcttatgccttagcagttggcgtatccacgccggctgatagttgaatatcgtgttctgctaagatacgaataatcttcatgttaatatcagcacgcgtaccagcccaatccgcgccgtcgaccatcttaaattgggccgttgccataaactcgtgaccgcgcgtcgtaacttggttgatgtaggctttttgactacccgtttcaaagcgatcatcttcagctagcatcgcttcaacatccgtcatcgctgccatcatgtcctttgtctttgttgcgatgtccaagtagaacgtcaacgccaacttacgcgtatccatacgtgaccagtttgtaatcggctcgtttgacagcgtcgcattcggcacaatcaccaacgcaccatcaaatgtacggaccaacgttgaacggaacgtaatatcttcagcgattccttcaacagatggtgacttaatccaatcaccgatttggaatggcttctcagtaataatgatgataccaccaagcaagttcttgattggatcttgggcagccatagaaatagccaatccagctaaccccagtccagcgaacacaccgtttacattgatgccccagtcagacaaaatcatcgtcacagtcaacgccatcacaacaaattgcaaactacgcgtcaagaatggcatcacaattgaatcaagttcaaagttaatgcgtgaacccaagtggcccaatagtaccgtcaatgaacccatcaacttgtacaaaccatacccgatgctgaacataagcactgagcggtaaatcgcgtgtgcaaaatgcgtcaccaaatgtggggcgtgagctgtatgcaaggcaattagtaaccctgtaaacaaaacaataacacgcgctggattttcaaacgccatcaaaacatcagtccaaccggcaaatcggtcggggatgcgcttctcaatttggtggaaaattccacgcacaataccgttaaccaaaacgattgaaatcacaacaatcaacaaagccaagcctagtgacttccagtcaaagctatagtgtagccaatgctcaaataatttcacgttaatctcctaaaaatatctattcattatctctcaattacaaaaaacaagtatatcaaaaaagccggcatcatgccggctctctgaacaaatattaatatgaatcaccgttaacaattgagttcttaacaattacgtagtcaacgtaacgtaagtccatcaattcacggccaccagcataagaaatcgctgattgcaaatcttgttccatttcattcaacgtatcgtcgatgtagccacggtatggtaccaatagcttcttaccttcaacgttcttgtactcgcccttttggaattgagacgctgaaccaaagtatgtcttgtacttggctccgtccatctcaataatttcacccggcgtttccgcgtgacccgcgaacaatgacccaatcatcaccattgttgctccgaagcgaattgacttggcaatatcaccgttataacggataccaccgtcagcgatgattggcttcttagcagccttcgcgcacaaacgcaacgcagccaattgccatcccccagtaccaaacccagtcttcaactttgttatgcaggccttacctggtccaacgcccaacttagtcgcatcggcaccagcgttttccaaatcacgaacagcttcaggtgtcgcaacgttaccagcaatcacaaaggcagctggcaagttcaacttgatgtattgaatcatcttaatcacagcatctgagtggccatgcgcgatatcaattgtgatgtattcaggcgttaaacctgccgtcttcaattgatcaataaagtcatactcttcttgcttaataccaactgaaattgatgcaaatgcgccagcttcttggaaacggcggacaaagtccaaacgcgtctccggtgcaaaacggtgcatgacatagaagtaaccttccttggccaacttcatggccaagtcatcattgataaccgtggccatgtttgcaggcactaccggaatcttaaaccgacgcccaccaagttcaaccgacgtatccgcctctgagcggctttcgatgatgcacttgtttggaatgagctgaatatcctcgtaatcaaatacagttgaaaagtccattttattatcccctcgataaaacaatgttcggaatttggtttatttaccggtagtttccttacccaagaaataattataaccgaacttattcgtaaatcaagttgataattgttaatgttttgtgcccttgttcggctttagtggctctacttagtgaattcaccgtacccaagagccttttgggcagccaaattcaacgatgaccattgacgatcaaagccaggttggaagaagaaatcagcttccgccaaatcagtcagtgtcaaacgttgtgcaattgccaaggccaacgtattaccatgtgcggtcacatcgtaatgctttgccatcaccgccccgccaacaatcgtttgtgtttcaggtgtgtaggccaggcgcacaataatctcaccattcccgcttacgtcaggcacaaatgccggacgacgagtgtcaacaagtgtaacggatgcaatctcaacgccggaacgttgggcagtaacctcattcaaccctgcactagcaaagctgtactcaaatacagatagcgccgaagcaccaaccacacctttgaacggtgccttggcttcgccattaataatggtgtgcgcaacatattgggcttcacgacgcgccgttgatgccaacgcaacgggttgttgcttaccagatggcatataaaatggcttaattgcatccccaatcgcatacacatttggtaaattcgtgcgcaggtaacggtcagtttcaatccagccacgttgatcaagttgcaaaacatccgcaaactcgcttgtattggcctttactccaattccttcaataacaacatcggctggatattcaccagcatctgtcacgacggcagttacacgcccgttatcatcgcccttgtaacgcttgatggcttcaccgacgtgcacagcgacaccatgttcaatcaatgcgtcagtaatacgagtcgtcatatcagcatcgagataggcacccaatactcgtggcaacaaatccaatactgtcacgtgcttaccagcttcaaccatcgcttcaaccgcttcaataccgatgtatcctgccccaatcaccgcaatattttccacactgtcatcatcgatgtaggtcttcaattgttttgctgattcataaccacgcatcggcacaatattggcattttctgagcctggtagcgctaaacgggccggtgtcaccccgacactcaaaatcaatttatcgtaagcaaattgcgccttagtatccccatttagtgtaagtacttgcttatccgcatcaatccccgtgacctttgtgttatttaaaacgtgaccaccaagtgattcaatatcagctggtttaaagtttcgaactgcctcagcttctggcactcgaccagttaaatacaacgtcatcccacatgacataaatgacacgaagtctcccgcctcaaaaatcgtcacctcaaagttatccgattgtgtcagcaattccaacgcagcttcgtgaccaccgtgtgatgccccgataatcgctactttttccttcgtcataatatcccccttctgtgtccttatacggtaggacacgctcagcaacagtttcggaccccatgttcgtgttgtttttcactcaaaaaagtaacagtaaacactgtgtttcatttatcggaaatacattttatgtgaagtccgtaatttaaccctaccatttatgaaatgtccttaactattcatcttttgaaacgatctcaaatatcattagcatctccatttagccccccgatggattgtgcatcgcccttgttattgctatactaaacactgttagtaaaactttcggggtcgttacggaatcgactggcattgttcgtgctagcactgcgtttaggggttgtggccctataatccactcagaagaattaactgcaaacaattcacaaaacacttacgcagtagctgcctaaaaaccagcctgcgttgcctatgcacagctttgattacgggttgcgctaggttctaaaactaagtaatctgcgccaaccgttcgccacctgagggcggttggaagaggataatcaggctggtctagctgatcgccgcgcggaatggcgtgcactagatgagacttaaattattcagctatgaacgtagacgtgttagtaacgagatggtaggacaggggttcaactcccctcggctccatagaaaaaacgcatgacatcaagcatctgcttgtgtcatgcgttttctttttgcttataaagctgccatcatttcgcgcaacattgattggcggtaaattgggcggttgttaaacttgcgacgttctacttccacttccttctcggcacgatcagaagctgccttggcgattgcttgcgtttcagttgggccaaccttgccttgcgcttgttgcatttgcgtaaacaacgcaataaaggcgtagtatgcacccaagaaccagccgttgaagtatggcattaccacattggcttgaccaatcttgtcgtgattgtggtgcgtaatctcgtgatactcttcagacaacatgctcttaatttgcgcatacaaatcagaactgttcttgcgagcaaccttgtccaacgtaccaaagttatccaatgcaaacttctccgcacggtcaacccattctgccgtttgctcttctggattaatgttttctacttcagcgaatacttccaagtgcgcatccacgtaaccacgcttcatgccggccaacaaaaccggcttcaagatgtcatcaacctttgctaagttcaagttgtcattcaacttagcaaccgcttgttcaaactcttcttcaatcatctcggtgtctcccaaaacttaaaaatcatgtacccaactataacataataaaaacgctgctacgaaccgtaacagcgtttcttgttattcatggtttggcggtccgcctctccaggcgatcgcgattatatgagataggtgtgtgagtattatattgtgagagatgccaaaccacgcgccgaacttactattcataagttcgtgatacctgtattttagactaaaactgccccattttcaatgtgatagttttaacaagtgttctattagtggaacacaattcctccgtcgacaaccaacgtttgacctgtcatgtagtttgaatccttaccagccaagaaagcaaccgctgatgcgacctcttctggttctgacaagcgacccaatgcgatgccgtcagagaattgtgccattccccaatcgtcatccttacctgcattttgaccaacttcgtgggcaatatcaaacatcattggcgtcttaacaattccaggtgcaaaggcgttaaccgtgatgcccaatggcgccaattccttggccgtcgtttgcgtaataccacgaatagcaaactttgatgcaccgtaaaccgtcaaatctggatttccttccacaccggcttgtgatgtggcgttaataatcttacccccgtgtccagccttcttaaaggcttccaccgcagcttgcgttccccacactgtaccgttgatattcgtatcaaacgtccagcgcattgtctcttcgtcaacttccatgattggcgttgttggtgcaacaccggcgttgttaatcacaactgttaggtccccaaaatgatcaactgtcttttgtacaccagcaaatacgtcatcacgctttgctacatccgcagcgactgccaaagcagcgtcagggtgaacagcgttaatctcattcgcaacgcgttctacctttgacaaggtgcggcccactaccgccaccttgaagccatcatctgccaaacgcttagcgattgcctcgccgattccttgtcctgctcctgtgataaatgcaacatcagccatgatatttacctctcaattaattctatttattatctcttgctcacttctacacaaattagtttacttcttttttagaagtttgtaaatgtgattttattcacatttagttctatgagtgaaacaaattgttatgtacacccattgtgtgtacaattaaacacatggaggcatatggatatgaaagaacaatcaactgatagactttcgattcgtattaattcggaagttaaacaacaagcatcagagatcctagaagaattagggttagatttgtcatcagcagtcaacgtcttttgacgccaagttattcacgataatgggttgccattccaacccaatctcgagacaaagcaaatggtggctgttgattcattattggatatgattgctgaggcaaaagccgaaggtggcaatcatacactggatgaaattaagaaacgttatttgaagtaatttgtgggggaaattacatgcctggggagtacgaagttaacatcactaacgcctttcaaaacgatctagacgaaatacatgaatatctgtcttccaatttttcataggaagtcacacaacgagtcatggctcgtttaattgcagatattgagcgcttggaaactagcccaagacttggtattccattgcgcaactttcatcctgagttaaacaccaatgcgatgcgtattgtaagcggaaagcacatcatcatttacgaaattgacgaacaccgtttcgttatcgacctactgcccttaattcgtggcgaacgcaactatattcaagagctatttagcaagtgaactaatcgaattcaggcattgaaaaagcgaggaatctttctcctaagatttcctcgctttttcgtgtttcttcaaatatctaaattacttcatgaatgtgactagaattccagcaacaaccagaatcaaggcaccaccgattcgattacccatttgcgcaaacgcaatcaagttcatgcgttctgatgcggccaatacggcaacgtttccagtaccacccatcgagttgttggccaaccctgctgtaatagcggcttcaaccggatacaatccaaacaactttccaagcgttgcactgatcaaagagattgcgacaatacttaccaagcacaagacaacaaattgccatgacaaagctgccaacaaaacgtgcatatcaagcaaagacagtccaacaccagcaagcaatgcgtgcgtcatgttcttaacgataacttgaccgaacataattacactgtcttcatagtactttggcaacaagccaaatgcctttgtcaaaacgatgctcaaaataataaatgcatatgcgttgatgccagggaacaccttattcaacatcgtaccaatcataaagaacataaccgcaatgatcaatccaacacctagttgcatgtaatcaggcttaatctcctcagcagtagcggcttcctcgcgttcaccacgtagaatttcaccgtgaccatttcccttactgtccttgaagatacgtgagataagtccagcactaataattgctagcagatttccgaggataaccgtcgggaatagcttagacaaaattcctgcggatccaacgcccatcgcgtgtgcatagataccagaaagcggcacaatgccggcaccaactccaccagccatgattggcatagcaatgtacaaaatagcgtagttaaaaccgacaccaataataacaccaacaattccaattacaaccgccgtcaatgccatcgaaatgaatgcgactggcaagaatcgaactgcagccttcaacaacatcttacgatccattttaaacaaagatgaggcaatcaaagaaacgatataaagacccaaaaagtccatgccattaataaatcctgaagctgtcgtaacaacatattttggcatcacattcgttgcaaccaaaatggctgttaacaaaatggtgaaaaccgatccaccacccaaatatgagcggaagattggcaagtgagcaccaaggtagtaaaacacgtgtcccattagaaccaatgcaaaaattgcaccaatcattgtatttggcagcgtccttgttgaaatcgcaataatcaacaaaactgccataaatgcgtaagcaatcaatccgattccgctaatgcgaatacgatcgaacttcccaatttcttctttcacgttagtcatccccacatgacttgaatgcgcgtgattcatcataattctatctccatttatatctgtcttatattcctagtttgtgttgaataaaatccaacgttatttcattaaatttttcaggtacttctatctgtggcatgtgaccaacctgattaatggtgacgacccgagattcgtcattgataactttttcacaatagcgacaaaaatcatgctgccagattggagaccgttctcccgtcacaattaattgtgggatagaaagatctgcgagcgtttgtctccaatctgacagcgcatgattcgccaacaaaggcgcgtttaatgttgcatcaaagaaatgactttcatgctgttgtgctaatagttgtcttaattttgaatcgattggttgcatgcacatttgttgattcatcatggttggtaaaacgaagtccatcgtttgggcatttaaatttcgcacgccactttgccactccgaatcatttgttaatttaggagattcatcaattgtgattattatggcgatgtgcgtttcaccatactgggattgataggcccagataacacttgctcccatcgagtgtccaattaagataactttatcaagcttcaagtacatgattaatgcgttcacatcagcagccaattgttttattgttagatttttacccgttcgggccgattcaccatgatttcgccaatcaactgtgatgacacgataaccgtgattcacataaaagttgcgctggaagtaccattcttcttttatgccggaatacccggtcaaaaaaatgattggttgtccatcacctttgtctgtataaaccagcttcacatgatcatccgttaaaaattgcattttaaagcagccccgttagttgaccaataaatatcgtcaaaatcagcgtatcagccgaaccgccaatgcttaagtttcgttcgataaataatcgatccaaatcgcacaagtatttcataccttgctcagtgtgactaccacctagcttgaaatatatacttgtccattctttcatctcagccaaaacatcaggtgttttggcgcgcttgatcaaggtcgaatcttcaagtgtcgctgcaattttcatcaaagtatccaatagccgttgggtcattgtgccaaacgttgcttgcaaaaacggtactgcaacttcagcaacacccggaaaaccattaactgcttctcctcgaatccccgtcaattgataggtttggaattgttgctcacctgcggtcgtggccactctgttcgaagccaaatccttctcaataaggccttcaaccattcgttgtatcacacgacgaacttccgtcattgttgctgatccatcctttgtagaatacgcaattgcagtaacccaaattcctaacgaaaaaatggcacctttgtgtgtattgacgttattagtcgcgttaaacatggttcgctcagcgaggacaccttcagctcttaaagcgttaaacaacaacttcaaatcgcttccttcaaaatttcgacccagcttgaaggctttgtctaaataacttttcaaagacagactgctgtcaatgaacgtaaacatattcatatcagtgtgtgaacccattgaaaccggatcaaccaaaccaggtttaggattcaaagacacctcataaagcaatccttttagagcgttatttacgacagtttcttgggactctttttcaaagattagctctttgctggttgctccttggtacatttgattaatcacttcatacccttcatcaagcgtgtgattttgctccttggcgcacacctttgctggcttgccacaaatcaagcataaccgtggtccaaagcctaaatcctcacgagacaattgataatcagcttgaccattagtcatcacatcaatgtcaaacagtcttcctaaggcgtaggtttcttcaaataaaatagcggtctttttaacggcagctaaattgccatccactgttataaaggcttctgggcctgtaacgcgctcagcaaacagcatttcatactgactgttgcattcaagccctgcaacaaatgtctgccatccgtccatgaaaactttctgtaggatatcgttattcttgataggaccaggtatatttaattttgcactgataacaattttgtcagaattggtcactttcaacttatcttgtaagcgactgcgccattcacggttatcaagtaccgtcagcaaatcaaccgcttcacctatatcaaaaatactcattatctaactcacatttcccttttggatggcattccaaaagtcatttaatctttaatttccttgatgacatcaatcaagctaccatcacggtattcaaccaacgctacgacgcgatccgtaaactcaagtggctttggcgtaccaacgattgcagctgccttttgttgcaactctgcgatggtgtaaataggcaaccctggcaccttactcaaaacatcaatcaaatcttgacgcttagggttgatggcaataccgacttcagtaaccaacacatcaatagaatcacccggtgtaataaccgtcgttacatcaggtaccactgtcgcaatacgtccacgaacaagtggtgctgaaataatggtcaacttagccgtagcggcatcttggtgtccaccgatagcaccacgaataatgccatcagaaccagacataacattgacgttgaacttagtatcaatttccaaagctgacaagataacaacatccaagttatcaacaacagcacccttattagctggatctgcataccatgacgcgtcaatttcttgttgattacggttacccttcattgatgaagcggcccccttgtcaaagtcctgaacatccattacgcggtcaatcaaaccttcttcaagcaagtcaactgttggcttagtgataccaccaagtgcaaatgatgctttcacattcttttcaatcattgattgacgcaagaaacgcgtaacagctagagccgctccaccagtacccgtttggaatgagaaaccaggcttgaagtatggtgagttcacaatgacgtcgtgcaccatttgtgcaatttgcaattctttaggatccttagtaaagcgcgttgcaccagacccaatcttgtctggatcacccacagcatcaacctttacgacgtaatcgacttgcgtttgcttgattgatgcaggtgtgtttggataaggcttgattgtatccgtaaccaaaaccaatgtatcggcatattgcgcatccataagggcgtaacccaatgacccgaaggcagcatcgccatccataccattggcatttcccatttcatcggcatttggtacaccaaggaaggcaacgtcaatcttgatatcaccagcctcaattgcacgtgcgcgattaccgtgtgaacggaaaataactgggttcttcaacgcaccgtgtgagacggcatcccccaacgtaccacgcataccagatgacgtgatattcgtaacaacacccttttcaatcgcttcaaccacgatatcgttcatcacatttgttagtgatgatggtgccaacgtcaaatctttaacgccgtggtcaataatgctgcgcattaccatgttgaatacaaagtccccctcgcggaagtggtggtggaatgaaatcgtcatgccatcgcggactgtttttgaaacaacttcatcaattgaatcaatcatcttatcatcgcccgtggtagcacgaaccttaggcgccacgcgatcgataaccgggtgaccgaattcaacagtttcaaatgcgttataattcttatcttgcaaaatttcgtctggaatctcgcgatttacactattcttcaatgtagtttccctccaaatctaccaagtggtttgccttagccaaacgcataacacgctctgcacgcatcacaacgggacgatcaaccatttgtccgttcatggcaataacacctgaacccttttgcttagctgcttcaattgctgccatcacgttttgggcattcaaaatttccttcttcgttggacgataaacatcattaacccaactgatttgacgtgggttaatcaaagacttgccatcaaatccaagttggtgaatcaattccgtctcacgcttaaatccttcttcgtcatccatgttcgtaaacacagtgtcaaaagctgcaataccggctgcacgggctgcatgcaaaatcacattgcgggcgtacaacaattcttgaccatcaggataacggtgcgtcttcatgtccgttgtgtagtcctcagcagacaatgcaattccaatcatgcgatcagaagcgcttgcaatttcgtaagcattaacaacaccctttgctgactcgatcgccgccatcaaatttgtctcaccaactgtgcgtccaaactctttttcggcattttcaaccaactcttccagggtatgaatcatctctgctgattccacttttggtaaacgaataacgtccaccccagccttgaccatcgccttaatatcattttcgaaatatggcgtgtccaagccgttaatacgaacaaccaattcagcatcaccatagtcaaccgtcttaagcgcttcgtatactaggtagcgtgccgcatccttttcaggcatagacaccgcatcttccaagtcaaacatgattgaatctgcaccgtagataccagcatccttgatcattgccgggttgtttccaggcacaaacatcattgttcgacgtaaacgttcctcagtattagccatcttaaagcacctcccagtttggcgtatctacaatatcgagtgctcgttgtacaacagcgattgctcgtgcacgaatcaccatatcgagcgctcccttatctacaacactaactgcagcatccgttacgccataagtgttcaatacatcagtaattgtttccttgattgcatcaccaaactgctttgcaacatcggaaaccagctcaaattcgatgccgttatttccagcactcaacataatttgtacgtcggatgattctagtgtgccggcgactgcacttttcttaatttccattaaccttttttcctccttcaatacgctcctgcaacaggcccaaatgcttatcaataaactgtttggtcgttggtggcaccaattgttgataaagcatttcgtcccctcgttcgattgctgaacgtactgttgttgctgaaataacacgcgtcatttcaaattgttttctatcgatttctatcaactgaacgcttggttgcagctcagtttgcaacgtttcattgtaaatggctgttgtatgtgacaaaggctctgtcccaacgtatcgtttcgtgatgttaagcggttttgctatgccctccctgaacagacgcgcatccaaggttgtttgatacttaatcacatcgtctgcattcttaatgaagtaagacggaaagcttagataactcaccatgtactcttgaccgttaatcacgtcgacgttatctaaatctgcgacaccttgtttaaccaaattgaaacgctcagctgtcgtaaacagcgatacgtcctgatttacaacaaagatataaacatgatcattttctttacttgcttgctcgactaagtatctatgtcccaacgtgaatgggtttgcattcatgacaatcgccgctttagtcccaccataatgtggtacgttttctacaaacgtttggatatttggcgttcctttttcaagcaatgcaccgtactcagaagtcgccaaaggcttaaaccctacgtaactgaagctagcgacatattctggcttcgtaaatacgaaataatggctttgaccttttctaattaggcgtccttctagttctgaaataatccgattaaaacgagcacctttcgaatcggtgcctttgtcacaaacagcaacatatttgataacgtgatttgttatcgaccctgttcctaccagctcatcttcatcattgaaaagaccaaccgtttcttcaatgacatcaatttcattggcgttaaagttggggatgcctcgctcggtcacaaaccgttgccaagtgcgtcgttgttgtttattcaatagatagagatctcttaattcatcagtcatattatgtctgtgttatgccttagcgtatgcaattactgcatttgaaacggcatcgacgacaccatcatcaaatacgcgtggcacaatgtggtctgccgttggcgtagttatcatttgtgctaacccttccgccaatttaacttgcagacttagttctaccttcttaatgtccgttgctaacaatcccttgaacaatcctgggaacaccaacacattgttaacttggtttgcccattgtgatgagccagttgccgtaatggcagcgccaccttcatgcgcttcttctggcaaaatttcaggaactgggttcgccagagcaaagacaatcgcatcttgagccatacgggcaacttgttccttagacaaaacatttgcgtctgacaatccgatgaaaacatcttgattatcgatgacatcatccaaactttgaccgtctacttggttaactgccgttgctagttcgcgttgatactcgttgtagtcattatcgtccgcgcggataacaccgtgaatatcaactagagtcaagttcttcatgccactcgctaataagattttggcagttgccactccagctgctcccataccattaataactaccttcaagtctttcaaaggcttgttaacaactttggctgcattgataagtgctgctaagacgacaactgccgttccggtttgatcatcgtgataaacggggatgtccagttcttcattcaatcgcttttcaatttcaaatacgcgcggagccgcgatatcttccaaatgaattcctgcaaatgacggcgccattgtcttaatagtttcgacaaactcatcgacgtccacttgattcaacgccatcggaatggcatttacacctgaaaactctttgtaaataagtgcctttccttcaacgattggtaacccagccgccggtccaatatttcccaatccaagtactgcagaaccatcagtgatgattggaatcaacttcccactcatcgtataaacgtttttcaacgcttcgtcctccgcaatcatcttggcgagccctgcaacacctggggtgtatgcttcacttaaatcatctggtgttttaatactaatatcggctttaagatccaatacaccagtgtgggctttgtgcatcttcaaaacacgattcatatcaaccacaatattttgcctccttctatgttcaacaattcacataagattacgtgtatgagtatatgttggcgataaacaggcgtaaatagacaaaataaaaaaacttcgaatttccagtttaaagctcgcagttttttgaaatttttaaaatgcacttacgctttttcaattgaattttttaaaatagattcaattttttgtagactagttcaaatttttaaaaaggtgtatgatgatgttacaacattcacattcaaaggaaaacaacaatggatgaagaacaactagctagaattgccgaagattattatctgaataaattaacctttggcgacatttcggataagtataaaatcagccgttacaaaatcaacaaagctctagatcaagccgtgaaagatggcgttataaaaattgaaattagaaattcaaaccaacgtaattcccgtcttgaacgcttgctatcagaacagtatccagggacacactttttcgttatccaagatgatgaaaacgtgattggcacttccgaacgcgttaccctttacgctgccgaaaaattaaacgcagacattaaaggtggcaacaaaacagttggtatttcgtggggcgaaaccattaatgccatgattgaatatgccccaactgccacattggaaaacgtcaaatttgtccaattcttaggtgaaaatttaaaatacaattcagcggctgattctacgcatattgtcgaacgactatcgcgtaagttttccggcgaattttttacgttgcctgctcccttgtacattttgaacgacctcgttcgcaagggattatatgccgagccttctatgcagcgagcgctcaccgttgcgcgcaatatggattttttagtcactgcgctcgggacgccagcttcgcttgattcaatacctatctggaataataactggcatagcattttcccaactacacgtcgcgaagatattgctggttatatatacggtcgcccttacgacgaaaacggcaatatactcaatatccagaatgacaaaatcgttggattatcactagaagaaattatgtctgtaccaaggcgtgtcgcgttagcacaagacaaatcaaaatcattggctatccgtggcgccttacgaggccatctcatcactgaactcatcatgagtgagtcggttgcttttagagtgttaagcgagagtaaagctgatgttctaattgaacaactgaaacagctgtagcatgccaaaaagaacccgcaaattcataaccgaatttgcgggttctttcgtcataaaattattgagctgtgtatccaccgtcgatgacgaactctgcaccagtggcgaactttgattcgtctgatgccaagtatacgcagatccaagcgatgtcatcaggctcacccatgcgtcccattggcgtcttcaaacgttgcgtaacgtatggtgcaactgagtcaccctcacctgatccatcagtcattggcgttgcgatgtaaccagggtgcactgtgttaacacgaatgttcaagtcgttttgcgctgcataaacagcggctgactttgagaacaaacgaacagcaccctttgatgcgttgtatgaagccgtcatcgtatcaccaaccaaaccaaggattgatgacatgttgatgattgatccaccaccgtgctccttcatggcacggaagccgtattgcgtacccaagtacataccgtcagcgttgatactcatcaacttacggtaagcttcgaacgtgtcgtgctcaatatcattcgttgcaccaattccggcgttgtttaccaacacatttagtggtccaaacgcttcttcagtataagcaatcaagtccttccaaccttgctcatcagctgagtcatgttgttggaaacgaatcacatcatccccaccaagttcagcagccgttgcttcaccgacgtttgcacgacgtcctgtgatgacaacctttgcgccttcatcaataaagcgttgtgcaatagcctttcccaaaccagttgttccaccagtaacgatagcaaccttgcccttcaaacgatctaccatgataagtaatacctcactattattttttctttgattacttaggatggtacgtatcaaatatgaagatttttaacatgagcccttggattctgaattgttcgattttaggtcataattagccgttaaatgacatccaccacactcaacaattcgagcaatgcggtagcaacttcgccacccttgttaccggcttttccaccggcacggtgttgggcttgttccaaagtatccgctgtcaacacaccgaatacagttggcacgccagtcttcaacccaatttgcgcaatcccgttcattgacccattaatcaccaaatcatagtgatcagtctcaccacggatcaccgcacccaaggtgacaatgccgtcatacttttgcgtcaaagctaccttttcagccaccaacggaatttcaaacgcacccggcacgtaataaacatcaatattgttctctacaacaccatgcatcagcaacgcttcttttgctcctgccagcaaagcatccgtaatcaacgtattgaaacgactcatcacaattgcaatgtgtcgttgctcgtggttggttaatgttcccgcataaattgtcatgttattccccttttaaatcatgtgcgcaaacttatcgcgctttgtgtccatgtacccttgattcacgttattcacacccgtaatgagcggtacccgttcgacaacctcaatgccatgggcctcgagttgggcaattttggctggattattcgtcaacaaacggactttatcatagccggcgtccttcagaatttgggcggcatgcgcgtagtcgcgttcatcaggttggtgacccaagtgaacattagcttggtacgtatcatagccattttcttgcaacacataggtacggagcttttcggctagtccgataccacgaccttcttgacgcaaataaaccactgccccaccttgagcatcaatttgtcgcaaggcctcgtggagctgcggtccacactcacatcggaatgaaccaagcacttcaccagtcagacactctgaatgcaatcgaaccaatggcaccgcgccatcagtcgtcgctttttcaaccaacaaatctggttcacgattatctgacagataatccgtcaccgcaaacgtcccatatgcacttggtaatttaatggtaggacccaccgcgtaatcacgcgccatttgcgcctcacgatacgcgattaactccgcaattgttaacgtgactaacccttcacgttcagcaatctcagccaacgctgtttcgcgtgccatttgcccatcatctgccaaaatctcgataatgtaagccaccggtgttacaccagccagctttgctaaatcaaccgctgcttctgtgtgacctggtcgtgccaacaccccatcagcttcagcgactaatgggaaaatatgcccaggtcgatcaaaatcgcttgccttcgcagacatattggccagctcccgaatggtaaacgcgcgttccactgccgataccccagtggtattctcacgatgatcaacactaaccgtaaacttggtaccaaacttttcagtattatgcgcaaccatttgagataaggccagtgcttctgcacgttcagtggccattggtgcacacaacacaccgcgaccaatccgcaacgcatcgttcacactttgagttgtcgcaaacgaagccaagccaaccaggtcaccttcatgttcacgttggctatcatcacttagaataataagctcgccacgcttcaacgcttgcagtgccgcttctacacgtactcgaatttcctgattcatcttatccacgctcctttgctagatacttggccagaatgtcagtctctaaattaacgtcatccccaacttgcacatcctgcaacatcgtatgcgtcaatgtatgcggaatcagtcccaccgtgaacgtcgtggctgttgtttcaatcaccgtcaggctcacgccgttcattgcaatcgaccctttcggcacaatttgttgcatcaaggcttggtgctggggctgcactgtaaagtagaccgtttcgtcgatcatgtgaacgtcggtcacttgttccgttccatccacatgtcctaaaacaaagtgaccatcaaaccgatcagtggctagcatggccttttccaaattgacgcgggttccaggttgatactgacctattttcgtcgtcatcacagttggaaccatcacatcaaacgtcgcctctgtcgccgtcttcgtggtaatcgttaagcacaccccgtcaatcatgatgctatcgcctaacttggcatctgcaaaatagtctgtcgccgtcttaacagtcagacgacgctcttgttcatgtcgttttgtaagctcagtcacttgcccaacggttgatacaattcctgtaaacattaatttttctcccggtaataaatatgatgcatcgtgttaccgatacgctctgagacgctcgcgctaattgttggcatctgaataccagccacccccgttccaaagaccgttgtggtttggtaaatatccaactgttgccacaaatccgtggctaggaacgcccgtagcacagcgccaccgccttccactagtaccgattgcacacctctgtggccgaggtcatccagcattgactgcagacggccatcaaataaaatagcctgttcggtggcccccgcaaacgcctcattcatggtgtaaatcagcgtgcgatcatcgaagaattgggattcactttgcagccgtccacgtcggtcaagaatcacacgtaatggctggggatgtgtcatcgatgtatgtcgcaccgtcaaacttggcgtgtcagttaatgccgtttcactaccgacgataattgcaccaacctgagcgcgttgttcatgggttgcaacatcagcactggcatctgtaattttcgttgattgcccaactaccttagtaatatatccatcagcactctgcgccactttcaacatgacgtacggatgaccagtttcaaaaaagtgatgaaaactaggattcaatttttcactgaccgattggtttaacacatcaacggcaatcccagcatctcgcaacttgctaatcccttgtccatgtaccaacggattcgggtcaccttggccaaccacaacccgaccaatcccagctgccacaatcgcatcggcgcacgcgccaactttaccaatgtgggcacaaggctcgagcgtgacgtacattgtggcgtcctttaaatcagctgagttgggcacctgctgcatggcatccacttccgcatgcgcctggccaaattggtgatgatagcccgtcgctaacaccacaccatttttgacaatcaccgcgccaacccgcgggttagtccatgtctccttgggtgtggctttttcagcttctgccaccgccaattgcatcattgttaaatcatccatatcttcccctaactactccgggaataaaaaaccggcatgatggtgaccatcatgccggagcgtagttattgtttgaggtatcgcaaaaaagcgtactaggccactgaaaaaagtgtgcactaatacaaagattgatatcttctcccatccagactttactgtcggttgcagattcacactgcatcaaccgcatcgctaaactagctttgcgggtcacggactgaggcatacgccatcaccgtcggtcgggaatttcaccctgccccgaagatttattcatgatttatttaacaagctcagtctaacgttagacaaacggatttgtaaatctcgaatattttatggactggcaaaaaataaaacatctcagtgtttcaccaagatgtttcgtccgactatttgttgttattctgcgcctcagatagtccgacaacaatcaaaaccgccgccataaacgctgatgatcccagcaagaccatgtaaatctgtagcatatcaaaggttggctgccacacataagcaatcggtgcaatgtatatcgccccggtaaaccaccctaacatatgacgccaaccatcatttttctgtgcgattctatcagtgatgttgtatttctttcgataacggttaatgtccaatgtaaacaagaagaatacgacacccaaaccaattgcaaccatcgctacttttaggccgtcttggaatttattactgtacatcagccaccagccaatggcgtaagcaatcaacattgctaacgcataacccgaccaatcaatatctgaccgggctacattcgcaaaccaaccagatttcggttgtggcttttgctctggtttcttaactgcatcaaggtcaccgggcatgaagtacgatgttggcaccttacgattgtagtttggctcgtaatgtagctgcgataaatcttcgcgatcaaatacaaccgtttcgccaggaatttcaaatgcaacccccaccaattgtgggttgacgttcatcatatacgaaatccaatcagcacgacgtatcgtcaaaatttcccggtcagctttaattgcatctctggtttttaagtacagatgcaaatacaaattaccttcaccatcaccgataaactcgttaatccaaggttcatcgtcagctaaatatggccggcctagaacatctcgttcaatgacgtgcccctcagaaaatattggttgcacaaacaaggcttttttcaactgcttatcaatctcacccagcagatattccttttcatctggctcagtcgcggcgctgaagtaacccagcagtcgcaccaagtttgtgttgcgcacatcctgattaatgtaatccaagtcatcggtgccataatcagctgaatcatctagtttcgaagtagcatcctcatcaaacgataagcgcgcaatttcgtcttccagggcaatcatgcgtaccaacgcacgttctttctcatacacccggattttggccttctgtcgggttgttgcactgacggggatgatgcgtccgacaatcaaagccaacacaatcaaaatgattgttggcaataagccacgcctccccaatgcaggaacagccatcaaggctaacgttactaacacaacgactgcgacaaagttccatgtctgacgcgcatatcgatcaatgcggcgttcagtcttcgaacggaacgtttccaattcttcgttcaagcgacttaactcgttcaaacgcaacccaacagctacgacaccaattggtggtgccacttgttctggggcttgaattggtaggtcatccgccacggtcccagttacggcacccgtgtcactgccgtctaactcttctgccaacaatgatttgggcagaacaacatcatccgtacctggattcaaaataacgccggccaaatttttggcattgcccaatttctgcaaaacaaacggcatctgaacttgcatcgtattaggttcacgatgcccagcgcgacttttagccaaatccgtatacagcaccaagtagcgtccatcatcacgtactgtgtaaccctgttgtcgttgcacatcaggggtgccgatcacatacgtataccctgatgacgatgtccgtcggtcaggctcgatcactgcgacaggcactagcaatgtcacatcggtcaacacacgggccaacacacgtaaatcacggacctgcccacggaccgtttgttgcttgagatactgcttaattttgcgatttaattctcgattcgtctggttaatatttaaaaagacgcgttccatacgactccctcttctgcattctcttcatttcataataggacgaatacaaaatcggcgcttcattttggttttgaaatcattagcaaataaaaacggcacccactacaggtaccgttcctaaacaatctattatgccaaggcacccattggatcccatggtgccaattcatatggcgttgtgttctcgtaaatatcacgcaactcagctggcaagtgttccttcttgatcacaacttggtacgtgaattcgtcaaaccattcgtctgacatcgtgaagtaacccttgtggccgttcttgtcgccccatgagttttcgaccttccacttcgttggcttgccatcaaacaaatcaacacccgtcaaaaccatggcgtgggtcatcaatgaatcaccaaactccaaacgttcagccttcgtcatgctgaagtcgacatcaaacaaatcatcttcgttgtacaacttcgtatccatcaaaccagccgtgcggtccaacttaggtcccatgtcgacaccgaaccaaacgttttcgccagccaacaattgcttaaccgccaagtccttgaacgttgccaagtccaagttcaagtgctttacttcgcgtccgccgaccactgaaccaagcatcttcacaccgtaagtttggttgaatggcttgtcagctgttggggcgttgatgactgaaacgtattcgctcaaatcccaaccaatgtacttcgcatagaaatcctttggcgaaatgttggcatcgctgtggaaattgttgtccttgtcacggtatgagaagttgaacgttactggtggctcaccgaacgtcaatgacaagatgtggtagttctcacgaccaaattgggcaacttgttgcgcgatttgctcttcggttgcgtgctccgttaccatgcgacgcaacgtgatggcatccttgcgcaacttcgcattgtacaaacggttgaagtcagctgagtgtgatgatgcttgtgattctgggtaagcagattgtggcacgacaccgtacttttcaatcaaaccgaccatcatgtcccattggccaccatcttgctgtggcatttgtaacaggaacgctacttcacgatcagtcgttggttgctcagccgtagcgacgatgttgttgtagaagtagttcgctttctccaacttgtcccagaagaacgtatagctttgtgacaactcgaagtctccaggcaaaccgtacaatgccttcatatcgtgacgcatcgtgttcaatgcggcgaacatccagcaacgaccagattgtaattggttcgcaactggtgagctttctaggtcaacgctaaagacaggcgtcaattcaccggcgcgacggttatcgcgcgctgcttgcaaaataccgttcgtcgttaccgcgttgcgtagcgcatcagcctttggactaaccgccactgcttctttgaaatacgctaattgtttttgtgtgatttcactcatatcattttcacctttttctaatttaagtctagtatagccttttagatagcggtttacaatggtaaaaaataagcacttaaaaaccaccgaatcggtttgattcagtggtttggtgtttaataatgcttcattgccatcatcgtctcttcaaagaacgtgaagaaagcgtcgtggttaacgtggtacacaaattcaatttcgcgtccctctggtgtttcgaacgtacggccacggctctggccagttggaatcacgtcaacgttcatcatcttcgtttccactaactcaggcttttgtgcatatgccgtcgtcaacacgtcccacaagaagtacgttgagttcgtctcaaagtgggtcaatactggcaccgttgcgtatgcttggccgacgaagtccatcactgggtgtgaacgcaacttcgcccaacgcaaacggtcagctggcgtcaacggtacttcgtgggtactctccaacccaaccatttgaatcttgatgtctgaatcaaagacaatcttgaaagcttgtggatcccaaaagacgttccactcggccgtaccgtcttgctctggttcagcgatgtttccaacgccaaatgtaccagccatcacaaccaatcggtcgatcctcgctgacaaacttgggtcgcgttgtaggacagctcccaagtcactcactggaccggtgaagaccaacgtgattggttctgtcgcttccgccaagattgaggccaagtcatcggccgcagtgttgtatgacaactcagtatccccttcaccaaattcattcaagattggcaatgcatcaaccgtgaatgaatccatgcgccactcctttgggaatggatcgctcgacttcgcatcagatgaactcaccaacaagtcgtggtgcgttgagaaacggttgataatcttgcgcgttgctgcaacagcaggctccaagtatgaatcagccggcacaacccctacaccaactagttcaattaggccttgctcctcgtatgacaacagcatcaacaaagatgccaaatcatcaacaccaccatcatggctaaagtacactttttcagtcatttcattctccccttaacaaataacgttcgtcttttaattcgtttcgtctatattaacatagctaaatcatgattaaaacgaacaaaaagtaaaagcaggctccaaaacggaacctgctttcaatcattattaaacttcaaccaaattacgtgacgtccccgtcgttaggacatcgttaaagttctcaaagctgatggaaatcatgtccatcaacgcttcttctgtgtatgagcccatgtgtggtgtcacaatgacttgcggatacaaggccatcatcttatcaaccgtcgcattaccagtcgattcaccttggaagttcttaccaaagtagtgacgctcatcagcaatcacgtcagtcgcaaagccacgtaacttcccaacttcaacagcagccagaatcgcatcttgatctgtgatttctgcgcgcgccgtattgaccaacacagccccgtctttcatcttcgcaacgtatgatgcgtcaaagtaggcatcgttcttgcctggaaaatgtggcacgtgaagtgagacaatgtcagacttcgctaacagctcatcctcagacacgtatgttagtagatccttggccttgtcgttttgataaacatcataaccaagtactgttgcgccaaccccacgccacaattctgcttcggtttgcccgatacggccagtaccaataataccaaccgttaagtcatgtagctccgtcgcaaacatttgtggtagcacttggaattgtcctttggctgcattcgcaaccgctaaagttgtttgacgttgttgcatcaaagctagcgtaaatgccaactcagccaccgcatatggtgagtagctaggcacgtaagccactgtgataccgtattccttggcaacatgcaaatcaatgtgattgtgcccaaccgttcgtgtaaagacatacttaatgccatgttctgacagcttttgcaacatgtcagcctgcaaggcacagtttgcacgcgccaacacagcatcatgcccatccaccttatccacgttggccaaagacaaattctccggcaccaacgttaggtcatagttgtacttgtttaagtcatggaagtacggcacctcattgtcgcgcaccccaaatacggcaatcttaaaagccatgctagctcccccgagttagttttcttgataccgcagtatacagaaggtggtcggggtggtcaatggtggaaagtaagtagaattcccgaaatctaaattcttaaattaaatcataaaaagaatatatattaacaaatacaaagcgctataatttatcataatgatgaattttgtcatcttaaatttagttaaggaagttaatcatatgacaaatatttttgacaattatcttcaaacactcaatctagatatccgtgtaagcggcaatggtcgatggatggatcaaaaagtcactcctgatgttctaagtcttgttgctcaaacaatacttgactactcaacaacgaataaaaagtctttctccaatagagacctctttcagtctactgaatttcttgacacagttgcccagttttttggaaagccaagacgggcttctgatgaaatggagaatgaatacaataaatttactggacaatctttaaagactctttcttacgctggacttcttcatgaagacacaaaaaaacgtccatatctgtacaccattttacgcgaggacttgcttgaaataattgctcagagcgatattaaatctttatcgtttttacagtcctatattagaaagtgtttgagcgatagtgactttaaaaacatcgatgagtttctaacgctttcttcacagacggaagcagatttcatgcacacacgtgatgctttcgtgacgttcgaaaaaacgtacacatctattaacaaagatcttgaaccacgtcgaattttagcgaaggttatcaatcccctagcattcgatttaaaaaagcatggcgcaaaatccggacacatcagcaaaagcatcatacgaaaaaacgatttaacttatgacgccgacaacaggcaagattcaaagaagagcaaagatcaaagccgtaaagagtattcccaggaacatggaaacaagtacacaatcgcgtatcgcgttgaaaaagccattcgtgcggtaaaggagtataacattcgtttcaattcaggtctttctgaattggggactggtgaagtcgcttcgcaaggtcaccacatgttgcctaagtcactatatcccgaatttgctgactaccccgaaaacattatccaactttcgccaaacgaacactacttgggcgcccacacgggaaataacacccagcaaattgattccgtgatgcaatcgaaattattactgacaaaaataaagaacatcgtgaacgcacaaaaaaaccaccccgacgaatcaccatatgatctaggcaatttagtcgagctggttcaaaaatacaatgctaataacggcgatcctaaggtcataaaactactcgataaatacgtgaagtacaattaagcaatcactcctttaggtacccaaagaagtaacttgacaaattatcaatattcaaggatctagtaccgtaattccgagcaatcttgtaaaatttccgaaattcggtcgatgaaaaataacgaagctggctttgtgttggcttctttttttttggaataagcaaagcaagtgacccgtcaactaacatatttttaggcaacttcatacttcttggtttatatgtgagattaggcatcatatagacgtcctgatttacgtacttactaatttgcaattcattaagtacatcccttgacacatacatatcataaccgtcgatgtctacaatatcatggcttccatctggaaaatttcgtgacttaagaactctgattgaattatcagacttcggaacagacatttttttagtaatttgtctgtcacgaaaagaatcaaactgaccaaaattcattttttcagcaacgcgatcaaaaaaattattccgatagagcaaccaataaggataacgatcagacattacatattgtttagaaaccttgcgctcatcgcctgttataaacgacttcactaatatctcttcagacgtttcgttatctgaaacattgtcaatcatcatattaattgtttcaatcttaacgcccttaaatccattttctccaaagtcaacaatcgactttacagaataattgtataaataatccctgaattcagaaaatgatggggctgaaattacagattttggaagcaccagagaaataaaggacttggtttctaatagtttttccaaaaactgagtggccaagttactcgatatatatcctggcttctttttcgtaccaccgaatggtgggtttcctacaactaaatcaacatcctcatcaatcagttcgacatcaaaaaagtctgattctatgaacctaaagtctgcgttagatattggaaatcgttttaataactcttttacgagcgctaaactgttcgagttaatatcaattaatagaaaatggattcttttctcccgatatttattagccaaagcccaaataaaagatcctgtaccaactgacggttcaagaattgttaggctttcttcttcactaaaatcaggtaggtcgttgacaatatcactaactaattcagggttcgtgtaaaacgctttggtttcttcacgcctagtattcataagctccagctcgcgttgaacttctactaaactcttctctgaattccaaataacttgaaattcagcatcacttattttgttgttctccggaaaaagatccatttgctgaaacatcatctatcaactcactcgctttcctaccgatttgctcaaagatactagtcggtaccgcttcacctaatgattggcgaatattaatttcgttcttcttaagccatgcgattttttcttctagtggtaatttgtttaactcagtgtactcatcaggtgtccatttaaacgagtctggaacattcatcatccgcatcaattctctaatactaaagacgcgatcatcttctggatgaactgtattttgactagctaatatatcatttcgtgtatgaacagcaggcgcaactttttcccagctttgacgcttgtacttatcgccattcttgttagcgttctgaacaatttttccatcaattattcgatgcggtctctttagcggatcggcattatcaaatgcactttctccttgcttaagatcatgaatccaagcttgcatatcactgcggtatggcttgaattcatgcaaaatatctttttctgatatttgtcccattgtagtcaacggctctaaatcaccaataacttggcgcaagtttcgaacatcagtcttgtcaggcatcaaaattttcggatcaacatcaccaaagatatcttttcgcaatgcaataactaacgtacgtggacgactagaattagcaccatagtctttaaaattaatttccgtgccataaatgttgtagtcttctgctaaatggtgatggataacatcattaatttcgtacgtttccccatttacgtccgtgcaagctgtagttaagaaacgctttatattttcaaaaacaatgaccttaggttgcgttttctccgccactaatatcgactgcaatactaatgaatttcggactaaatcagagtctttcttataatgattcgcaagtgaaattccttggcaaggcggagttgctaccattaaatcaaggccctcttgttcgttttcgcgtaaccacttatcaatttgacgatagatagcatttttagtctcttcaagttgaatgtcacctgttatataagcttgcggatcgggacttacagcattggaacgctgtacgttcattctgcgttcaatcaattcatttgacgccaccaaattaaatccagcttcgtgaaagccaaagtctcctattcctgctgaactaaataacgtaacatatgattttttattaatatacttttccatttgtctattatattgctattttcattctttgtgaaggtcagacatgttacgaattgaaactatgtttgatacaaaacttttcacattgcttataccaaaacatttttcatttccatacacctttaccgtaagttacattacatcaaaaagtctagctttatcattttaaattatcacccattccttctagaagtaggcttaaaaattctcggttttaactattacatcaggtcgtttctacaatcgagcaggaggactgtcaccattccgacctctcacaccaccgtacgtactgttccgtatacggcggttctatttgcaatggtgtcacaaagttcaatttgtaaaagtataaggcttagggggcggccttactattacaaattggtaggcagtttgtaacgtaagcccgtaaacaccatacggatattaaactcataatttttcaactgaactggtatcacactcagatatcaaaaacagtcaagcgaagctagtggtagctctgattgataagttattcatgattaaaagaggaatctccaatttcacagccgcggagcggttagttacgcgtatcaaggagtcgaatcccatacttgatgaattctgggtgtggatcgaacagacttacgcccttgcgaaaaccaaactggaaatcgccattgagcacgctgcaaagctgcgtgatggcctaatggattttatgactgacgggcggattatgatttcaaataatattgctaagcgcagagttcgccccgtgaccatcggccataagaactatccgttctcaaccagcgaagcttgagcaatcgcgattgaaaatggtctcgacgcccagaaatatcttgcgcacctatttactcatctacctgagcttgatttgacagacaaattggcactggtaggttatttatcatgggcggaaaatattcaacaaaattaccgataaatagcaatagccaccaggcgactgatcttttcagtttacctggtggcctattttccgcactacacccttgcggtgtttactggcttactttatttgagcaaaataaaagagcgacccaatatgaagccgcccaactaaagtggtccatttaactgtttgaccaagaaaaacttataattagtttctcactgttcttccttcaagttttttagctcttcccacaattctcgactgttaatacgtccaaaaatacctgatactcccgccgtcatgttacgttttaaagagtccggtattccctcttcacttttaaaaagtatgcgtttttcaggtccccaagctccttggtcttggttattttcatggacgaattttacatttggtgatgttaacaaatactcaaaagcctcttgcttttctgcctcgttttcaaaacggacttgaccctttttaccataaacaagcttactcatatgaatccccctagacttaaaacatatagaacaaacaatactttttataagtatatcaaaaaaaacatcacttttgtacagatgaattttatagttcttaacgaaagcgacatcctcaagcaaaccattacaaacagccgtttttatatcttaacggggcggccctcctatataaatttccatccctcttgaactattccattcttgtatcttttcataaatttgcacgcaaaataaaaaatcccccataagaagcaagttcaaaagttcccagttggtgtggtttacaagcaatttgttgttgtacccattccttatcggcaatatcagtaatattaatgtactgactcgtaatacttgttcaagttcagtagacctcgtgtttcgagtcttttgtttgtgagtttacttgcgacttcccatgtatcagctagatgccaatattcctttcgcgagtagctaattcgcttggattcgtcacttgtaggtcctaacttcatcaacactttaattctcgttttgcggtttcttccactgttttcggatatacattccgattcttctacacaaccatgcatcggtaacttgtacgaaatttttaaattttcgcgacaccgtaataatttatccagccccgcatgctcactttgatgtcgtccagaaccttatccaggccaacgcctcgacttagcttagtgatttccttcaactttgcgattattcgggggttggcggtccggtgaattcgaagcaccgttacatccgactacctacccaatgtaaagcctaaaaaattcaactcgcaaggcgatccaccctttgatttctcttgattaaccaccagtttcattttctcctctaggaagaccgtcatcgattgaagtactcgctactcgctctccagcccgaagactgtggatggagatattcatatcgcacaagcttgtgcccatgccgaacgcactaaaagagcaccatactatgtgatgctctttttactgtattcgcgtaataaaccaattcataatcgagttaactgaactagctcggcgtggtactgtgctaccgccaatgtcaggtcgatgcagtcgaatcaattcttcaacgatgtttttctccggcaaatgtcctgttgcaatccacacttcaatcattgcccggaatattggtcgttgaattaattgctttgcaaacagccccagctttgtattgtaatcgcacttgataaacatgctacccaattcagaaactttaaaatagccatccttcttctgcgctaatccgaagtactccgctgcgttggcataaaaatcggactgccgaatatcgaacttaaacgattctgccagatactctttcgttccaacagaaaagatatctccttgctcgctttgaatcgacttaccactcaatacaactggaatttcaaatattttctccggatcgttagcctgaataaagggtactaactcaccatcttctcgccttggttccatcgagttcggctcctgcgctaataacattttcaacgtatcgcgcgtaactggcttcgattcttcctcaaacacgaattcatattctcgaattttcttaagcgagttaaagtcattgatatcagtaaactgataaacgtggaacgaaaatacatcatctgtgtaagtgaagtatgccgaatatatttccttcggaaacttcatttggtcatgataaatccgagttggaatatacaactggcgaatattgaaatcctctggtcgcttcttctttgattcgataatcaaaactcgacttggcgattcataaactccatcgatctcagattgccagccatcaatcacgaattttgtttgtccatccctaaaatgactaatctggaaatcaattagtccggttccttttttaccactaagtgttgcaacaacatcagcatctaaatcattcatgacatacttcaacatgccactcatttcagcaacggattgtgcaaccgcctcactatttatcgtttctggactctccggtcgaataccagaaatccatttgggaaacgtcatgcgtaccggttcaagcacttcatatttcagattttcaaaagtcttgaagtctgaaatttcatagcgatctttccctttaggcatcaatgagaattgtgccttcttaccaaatacttccttattaactgactctttaaacacttccggtaaatcgctactgaagtcgaactttaacagatttcgagcatccggtgcattatcaggtcgattagcgtaatactctcgaacgtatttattaatatcgctactcgtgatttcaaacccaccatacttttcaatttggttaggaatgtcaaagcggtcaaataaatattgccatgcgatatcctgctttctacttcttactttggccatgatcgtttacccccaactacgtaccagtacctcagaaacttttgcacgactacttgcctttgcagctacaaatcggtgtgcttcaaccgtctcaattacaccgattccttcatataattcatgaagcaatggcacatcattgttagacaacaatacataaacgccacgatccttcaacgtcttaaacaagtcacgcagtcgtacctgttcgtcgtaaccaaattcgcttgagtaacttgtaaaactagccgtatcgcttgctgggatatatggcggatcaaaatacacaaagtccccggtctgtgctttttcaactgctttctcaaaatctcccgtcaaaatgtcgatatctgcattattcaaatattccgacacgcggtggatcgtcacctcgtcagcgatcttcggattcttatatttgccgtatggtacgttgttttgccccttactattaacgcgccacaaaccgttgaatccgactttaatcatgtagataaaacgcgctgctcgctcaatttctgtcatctgttctaggcgcccatcacgatctgttaaacgcaaatcaagataataatccttggaattgttagcctgatgttcaactagcttagccaacaattcatccggttggtcgcgtaccacacgccatacgttcgccaactctggattgaaatcattaacaaccgccttatttggttctaaagacagcaaaaaggcacccccacccagaaacggctcaaagtatgttccaaatttttcaggaatatacttggccagttccggaaggagctgcctttttccacctacccacttaataaatgggcggatctcacctagttggttggttggttggttggttggttggttggttggttggttggttggttggttgcttagcttgatgaccctacacatttgtttcatcgaaacgatattcagttttcaatgacctacgtcgtcgccttgacgacttaatctataatacagaagtcataatcaattgtcaacaactaatttcactttctgttcacatgttgttcacatgcgtcgtacctgttatttggtacttgaataatatacccctaaatggaatgttcgtcaactgctaagatttacgaatattttccgaacaatacaaaagggactcccatcactgagagtcccttgttttatatctatatatagtagtttctattagaacaaagccagttggttttcatccggcatccccgcaagcacaccgttttcatcaagataatccatcaacgtcttagaaacaccaccacgttgggcaagatcttcctttgacaagaattcacgttccgcacgcgcagcaataatacgcttggcaacgttatctcccaaacctggtacggcgttaaatggtgcaatcaacgtatcaccgtccaacaaccactgttctgaatcagacttataaagatcaaccatgctgaacttaataccacgttcaagcgcttcattagctagctctagcacggtcatcaaatccttatccttagccgatgcttcatttcccatcttacgaatctcttgaatacgtgctttggtcgtgttcaatccacgagacatcgccacgatatcaaagttgcttgcacgcacagagaagtaggctgcgtagtacaacgttgggaagtacaccttaaagtaggcgatacgcaacgccatcaagacatacgctgccgcgtgggcacgcgggaacatatacttaatcttcaaaccagattcgatataccactccggtacaccagcagcacgcatttctgcttggtactcatctgagattcccttacccttacgcaccttttccatgatttggaatgatgattcaggttgtacaccgtagttaatcaagtcggtcatgatcttgtcacgcgttccgataactgtaccgattgtggccacaccacgttgaatcaactcatcagcgttaccacgccaaacgtcagtaccgtgagacagaccagaaatctgtagcagttctgagtaattcttagggtgcgtctcttccaacataccgcgaacaaaggcggtaccaaattcaggcacacccaacgttcccgtcttagagaatatttggtcctcttcaacacccaacgactctggtgatgagaacaagctcataacacccggatcgttcatcggaattgtttgtgggtcaattcctgacatatcctgtagggcacgaatcatcgtcggatcatcgtgtcccagaatatccatcttcaagatattatcgtgaattgagtggaaatcgaagtgcgtcgtgcgccaagtagctgacaaatcatcagccgggaactgaattggtgtgaagtcatagatttccatgtcgtccggcacaatcaaaataccagccgggtgttgcccagtcgtacgcttaacaccggttgctcccatcgccaaacgttcaacttcagcaccacggaaactaatatcgtggtcacgctcataagccttcacatatccaaacgctgtcttatcggcaaccgtcgcaattgttccagcacggaatacgttattctcaccaaacagtgacttcatatagttgtgggcaaatggttggtagtcacctgagaaattcaaatcgatatcgggaaccttgtttcccttaaatcccaagaaagtctcaaacggaatattgtgcccatccccaatcaacttcgtcccatcaattgggctgagcttttccggcaaatcataaccagattcatattcacgtgggtcaacgaactcaacatagtcaccactctcactacgatagtgtggtggcaacgcgttaacttccgtaattcccgcaagcaaagcaatcaatgatgatccaacagaaccacgtgatccaaccaagtacccgtccttattagacttagccaccaaacgttgggcaactaggtaaataaccgagaacccattggaaatgattgaacgtagctcctgctcaatacgcgcctcaatgatttcaggcagcggattaccatacatacgataggccgttgcatatgacttttcacgaatttcatcgtcggctgttggcatgttaggtggatagtttccacccttaatcgcctcgacctcatcaagcatgtccgcaacaacgtgcgtattatcaatgaccaacttcttagctaggtcttcacccatccaagcgaagtcatccaacaattcttgtgtcgtacggaaatgcatatccggcaaactataacggttcaacggattagcaccaccttgggaactaatcaaaatcttacggtagatggcatcctcagggttgaggtagtgaacatccccagtcacaacaactggcttgcctaattcatccccaatcttcaccgcttgcatcatcaaatcacgcaaacgagcctcatcttggatcaattcaccttccaaagccggcacataattagctgatggctgaatttcgatgtaatcgtagtattctgccttagccttagctgcagcataccccttctgcatcaaagcttcccagaactcaccagtactatcaccagttccaagaagcaatccttcacggtacttgttcaacaaagaacgcggtacacgtggcacacgctgcaagtacttcgtgtttgattcagaaatcatcttatacaggttcttaacaccttcttgcttttgaaccaacacaaccgcgtgattagggcgaccatgcttccacgcatcgttatccatcatgtggtcattcaattggtcagcatattcaatgccatattcttcacgtgcttgttccaagaagacacggttcaaatgtccggtcgtctcagagtcaaagatggcacggtggtgttgctccagcacaataccgaagtgcttagccagcgtgttcaaacggtatgaacgcatatttggatataggaaacgggccaaaatcaacgtatcaataactgggtttgaaattgggtctaacccgtgacgggcataaccttcttgcatgaaccccatatcaaatgtgacgttgtgcccaaccagaatcgcatccccatagaattcacggaactcttcgaagacctgcttctctgatttagaaccacgcaccatatcatccgtgattgacgtcaaatcaaccgtggtttgacttagtgggaacccagggtcgatgaactcagagaattcggcaaccacgtttcccttaaccatgcggacggctgacaattcaatgacccgatcataggcagctgaaagaccagtcgtctcgacgtcgaatactacaaattcggcttcatcaagcttcgtgtgatttgggtggaaaatgattggctcaccatcttcaaccaagttaacttcaacaccataaatcatcttgatgtcattcttagctgcagaggatgctgcttctgggaatccttgggcaccagctgtatcagtcacagcaatggcgtccatgccccacttggcagcttgcttcacgtagtcaccaatcccgttagtggcatccattgtcgacataacggagtgcgtgtgcaattcaatgcgcttcttctccccttcataaggatcgatgcgtggcgcatgcttaataacctcgatgtcgtaggccgtcatcgtcaagtcacgcacaaaatcatcttgttggattggaccgcgggcacgaatccacgtacctggcttcaagtcagcaaagaaggcttcgtcattttcatcacgtgagaacttcttcaagataaatgaactcgtgtaatcagtcaccttcatcgtcaacagttgacgttcagacttcaaaacacgtacttcagcgtcaaagacatatccttcaacgataacagaacgttcttcagtctcgatgtccgccatcttagtgatttctgcatcagaagcaatcttgcgaccaagggtacctggcgcaccgctaccaccaccattacgtggtgcagattgacgttgcttagctgcttgttcaatttgcaccttggccatttcggctagttgttggtcttgagcagcacgttgcgccatgacttgtgcgtgtgattcagcggccaattgttcatcaacttgaatgttaaatggtaattgatagccaaccccaagattcttatatgtgccttcaataattggcaaaccagtttgacgagcataattcgcccaaactgctgtatcgaacgtcaaacgcaattggttgtcagcgatttgtggcaacacatgggcaaacgcctgacggaaagcacccggttcattttgatgttgctgcaacacccacgtccaataatcaacgatttgttgggcatctggttgtgtcgtcaaatgcaattggtaagtggtctgcgcaatgttagcaaaagccgtttgcatacgtgccaccaaagcggccatatcttgcaccggtggtagagcgggcatttccaagtggaactgccagactttagactgtttgtgcacggctagcttggtcaacgcagtttgttgcaaactagcagggacttcctcgtattgcaattgctgcaatagcgtttggaattgttcttgtgcggtcaacgccatgttaggtgctcccttctctcatttttcaatatgcgtttaattataccttgttctagttacaacaacgtatcgaattaacatacaaacaaaaaacgccatccaacttaatggatagcgtttagcggatcaagccgaacgggcaattcggcgatctattcttatgacatgtctcagcacatcataaatttttaaggagtaggtttcaggttggttagacctgtaggttatgagtagtatttatgggttgtcgaatgaatatccctgtatcccttatcgacatccttaatattacgcacgcaaacttaaaccaacaataaacacctattaaaaatgcgtaaatgccaatacagttagcacagcaatgacggcccacaagaacttgcgcatacggtcgccctccttcacttatctttgatacttactagtatcgcatgcaaatgtgtccattttatgaaagcgttaccaacctcgatcaataaaaaagctacccagccctagccgagtagctttctagttatctgtcattaagcttgcgcatcaacttcagggtgcaacaagatttgtagcgttgcaaccaattcttcagcacgtacttcgatggcttcgtcagccttacgcaacttaacttcaacgataccttcaccggccttcttaccaaccgtgacacggactggcaaaccaatcaagtctgaatcgttaaacttaacaccggcacgttcgtttcgatcatcaaccaaaacttcgtaacctgctgcaaccaacgtgtcgttcaaatcgtcagtcaatgccttttgcgtttcatctgagtacttcattggtaccaagtgaacatcccatggtgcaactgatgttggccatgccaaaccattttcgtcagcgttttgctcagcaattgctgccaacaaacgtgacacaccaataccgtatgaacccatgatgacatcagcttgacgaccgttagcgtccaaaacttgtgcgcccatcgtctttgagtagcgtgtacccaacttgaagatgtgaccaatttcgatacccttagtaaattgcaagtgacccttaccgtcaattgccaaatcaccttcacgagccgtacgaacgtcagccacttcatcgatgcggaagtcgcgatcaacgttggcgttcaagtagtggaagccagcttcgttaccaccaaccgtaatgttaaccatgtcagttacccattcgtcggcgataatcttaacgtcttcaccaacaccaactggtcccaatgaaccaaatggtgcacccaagatttcttgcgcttcttcttcagttgccatacgcaactcgtcagcgtgcaagaagttttgtaccttaacttcgttcacttcaaagtcaccacgaaccaaaaccaaaacaggttggtcatcagcgtacatgaacaacgtcttaaccaattggtcaggtgtcgtttgcaagtattctgccaattcttcaatcgtcttaacttcaggcgtggcaatcttttccaagtcagccatttgtgcgtgtgacttgttaggtgtgtacaaatccttcgccatttccaagttagctgcgtaatctgactcatctgagtaagcgatgatatcttcaccagcttcagcaggagctgagaactcctttgagtctgaaccacccatggcacccgcgtcaccaacaattacacggtagtccaaaccgatacgatcaaaaatgttgatgtaggctgattccatgttcttgtatgactcatccaaaccttcttggtccactgagaatgagtaggcatccttcataatgaattcgcgaccacgcaaaacaccaaagcgtggtcggttttcatcacggaacttcgtttggatttggtaaaccgtcaatggcaaacgcttgtatgacttaatgtcatcgcgaatcaacgtcgtcatcgtctcttcgtgagtaggtcccaaaatcatgtcgcggtcgtgacggttcttcaacttaaacaagttcggaccgtacgtgtcataacgacctgactcttgccacatttctgctggcaaaagcatcggtgctgacatttcaatcgcgtcaatcttctccatctcttcacgaataatcgtgttgatcttgttcaaaacgcgttgtgccaatggcaagtatgcgtaaacaccggctgaaaccggacgcatgtaaccagcacgcaacatcatttggtgcgagataacttcagcatcggctggcgtttcacgcaaagttggaataaaaacctttgattgtttcatggaaaacttccctcgtccctaatcttgacgacataacgtcactaaaaattcttttactagtttaccacagttacccaagaactaccctacccattcgcacaaagtatagaaaaagggatgccaaattggcatcccttactcacttacttaaaaaaataacgcaaaatatcgtttccggtaactgccaccattaggagcaccaagaacaacacaccagccaacgtgactgtcgtttcaatcttctccggcaccggacggcgaataaccgcctcaaccgcgttcaatagcaacttaccaccatccaaaccaggaattggtagcaagttcatcatccccaagttaactgacagccatgccgcaaatgacacaatcgccaagaaaccatatgaactaacctgctccgtattcttgtagatggcaactgggccacccaacttattcagtgagaacccttgaaccaaattctggattgcgcggaagatttgcgtcatcgcttgtcccgtggcacggaacgcatacgccacacgcggaccagccgctttggttgtggttggtgtcacgccgatttgaccaatcgtcataccaccattcttaaccgacttaggcgtcacctttgtggtcaattgcttaccatcacgttcatacaccacggtcgtcttcttacctggcaaagcttgaatcgtatcttgcatcttttgccaagatgtcattttaacgccggcaattttttcaatcgtgtcacccttcttcaaaccagcacttgctgctggtgaatcttgtgcgattgactgcaatgtcgtcgttgttacacctggcatcgcaaacgccaaaccaaggaacagtaccaacgtcaaaatgaagttgttcatcggaccggcgaagttaatcaaggcacgttgccacaacttagctgattcaatgtgcgtatcacgtggcgcaactaggacttcggtgccgtcagcttcaatcactgacgcatcgtgatcaacagccaacttaaccagcgttgactcatccccatcccagtaaccttcaataaacatgtcatcaactaggtcaatgcggttaaccgttaaggcacgaccacctactaactcagtttgctctgacaaattcaaacgggttacaacgccatctgtctcaacgacaacgactgtcatacccgggcgaatactttcttcttcagcttctgcacgtccagccatacgcacgtaaccaccaacaggtaagatacgaattgtataggttgtaccgttgcgtcgtgtctgtagcaacttgggccccatcccaattgcaaactcacggacacgaacaccggacttctttgcaaaataaaaatgtccaaattcgtgcacgaccaccaacaggccgaacaccaaaataaacgtaataattgttgtcatcagttaaactctccacgtgttcccattatgctaggccttagtatacaacaaaagcctgaaggaaactttaatttcccccaggcttacgaatcttttagtttagtggaacaaaccaatcaagtacatcaatggcaaaacaatcaacattgagtcgaaacgatccaagataccaccgtgaccaggcaacacgtttcctgagtccttaaccttgtagaaacgcttcaaaccagattcaatcaaatcaccaaattgaccggctacagaaagcacgatgctgatgataatcatgactggccagctgtacgcttgtgggaagaagtacgtgtaaactgccgctgcgataaccgcaaccaccgttccaccgattgaaccttcccaagtcttgtttggtgaaatcttcgttagcttgtgcttaccaagcttgcgaccaatcatgtaggcccctgaatcagtcaaccaaacaatcaaaaaggcaaacattagtgtatctagcccagcgttacgggcagccaccatcatgccaaatcccataccaacatacatcatcgtcaatgtgaatacaccagcatcttcgaagctaaacttgttcttagcaattaccgtgtgcaacaacatcaagataacaaagatgtacaacaatgatgagcggtgcaagacaaccggtgcttggatggcatcccacaaaccaactggtaacgtcattatcaaggcaccaaccatcgtcaaaattgctccaaaatcaactaacaacgtcttgcgcatcaagacgacttcggcagccgcaatcactgcgagtactgatgctgccacttgaatccaaataccgcccacgtacaagattggcaagaaaatcgccaatgcgacaatggccgtaatgacacgtgtcttcatagtcctaaacttcctctattttttatcacttttattttctgcaatcccaccaaaacgacgatctcgtgcttggtaagttgcaatggccccttcgaaaacagattgtgtcatctcaggccagtgttcgtcgacaaagacgaattcagcatatgccaattgccacaacaagaaattagacaaacgcatttcaccactagtacgaatcaacaaatctgggtctgcgtattcgccaagtggtgctgtcatcattgcgttgctaatcgtcgcttcatcaatctcttctggcttaagttcaccagccgcgacttgttgggccaacgtttgcacgcccgtcacgatttctgcacgaccaccataattcaaggcaaagttcaaaaccatccctgtattattagcagtttgcgcaatcgcatcattaacggcacgttgcgtatcggcgggtagttgatcgacataccccatcacgttgacacggacgttgtttgcaatcaactcaggtacgaaggtatcaaaaaactttccaggcaatttcatcaagaacccgacttcagtctcaggacgcttccagttttcagttgaaaatgcgtacagtgtcagtaccttaacgcccaaatcactggccgtcttggtaatgtccttaaccacttccataccacgttggtgaccggcaacacgaggcaagttttgtcgcttagcccagcgtccgtttccatccataataatcgcaatatggttaggaatacgcgtcttatctaattgtgtcgttgtttctgaatcgatgactcgtcgctttttgaaaaacacaacgtttcctccgcctctataaatctaaaatgcgcaaccaatagttagttacgcatgtcaatcctatccattatagcagtttattagaccgcgtataggcttttagtacaacgataacgcttacttagtaaaaactgactcatcatcgtcatcaaacgcaccgcccaacaaggcttcgattgtgtccaaaaccccgttgtggttattatcgtttacggccaaattattaatacgaaccttcataaagtcctcagcgtttggcataacgaatggatacttcacatagcgaagcatctccaaatcattaccattgtcaccaaaggctgccatctcttcaggcttgatatcccacttggccgctagttgctcaaggccagtacgcttgtttacgcctggtgccaagatatcaactgatccaaaccctgaacctgtggtgtgtagctcttcgccaaagacatcacgcaattgttgcacgtgatgatgtacatcaacatcttggtcccaaacaagtgagaatcggaaaatgctatcttccacatccataaacttctcaacttggtgaaccgttggatagaatgtcttcacagctgcaatcatttcaggggtggcgtggtttgagacgtacgccccatttgtacctgacaaaataatcaaattatccatgtgtgcatgtgtctcagcattccattgcaacacacgagaaatttggtctggtgacaatgctgattcagccaataccgtattctcgtgggtaatcaacgcaccgttatctgacacatacgtgatgcggtcagggttaaccggctcaaaataagaacgcaattgcttatattggttcccacttgctgcgacaaagcggatgccacgttcgtccatttgatctaacaatgcctccattcgtgcatagtcaaatgtgcgatcatcacgtagcaatgtaccgtccatatcggttgcaattaacttaatcgtcattgttctgcttccctttcacaattaattcactcttttacctaaaagtcattataacaaactgtccgagactgcgccgaatttgctacaattataaggttagtttagttaattacatttatatgaaaaatatcatgataaaggaggccgttcatgaatgacgattatcaagccagtttaaatcgacttaaccaattggatggaccccaagcgactgtctcatcagcagagccgcttcaccgcggaccacaacggcgaccacagcgtgttgataaccgaccacaatggcaacaaatccaatggttttcaattctatttgctgtcgtctcacaattggcaatttggtgggtttatccgctcatttattcaaaaaatttaacgagtggtcaatggcaacacaatcctctcttaatgacctatagcctaattttggcattagcaattttcctaaccttcaaccgtggtttctcacgctggctgaattttgcggtcatcttgattccgattgtgttcttgtacttcctatacaagcaagtcacgattcaacagattattttgttaggactacttccccttgcgctattgctcattaacgttaagtggttaaacctgcaaaacatcctgggcttaattatgtattctggggttgcaacactcgcaatgccggttgtcatcttctatcaacaaaatacattcttaacattgccctttattctaagtttgttgccgttgctattcagttacttgtactacatgagtagtattttcgtaccaaccggtcgtaataagcgtgctacatctttggcatttggtatcattcttttgttggatgtcttaaccttgccatggaacttatggacactattggcgattgtcatcatcgtcttcacgtggatggttctgattaacctcgacttgaagccaaaatatcgcatggggatcttctccttgctacaagcggtcacggttctagtgattttcttacaacaaaaatagcaaaacgccctcgcacgaaattagtgcgagggcgttttttagatttctgttgtaactgggcggcgcttaacgcgataaacaaagacagctgatgcattaccaatgactaacatcattagcaaaaagacaattgggtggttcttagccatgcgaactggccaaacaccttcttccgtacggccggcgttcacatcacgggcccaacggcggttctctaggtctggtgtatcaactgctccgacaatcacgggctctgattttgcattttcagaaactgaaatatccgttacttgcgttggcttcatttcaccatctggtgattcaataatcggctcgttatagtcggattctgtgtgcccactgaacttgtccttaacaccttgaatcatctcatcaaacttttcaatcaaagatgattgtgcaaccaccgggcggacagcatctgcgtttactgctccctgtgtcgctaaattcattgccatgaaggtgacaaaacataaaattgctgatcgttttttcattgtttaactcctctaaaaagaaagtgccctttctccgtccaataccctgaaaaaacttttcatgagccaccacagttcacaatgttgttccaagttatttacagtctaccctatataatcttctaattttaggcgattgtttgaataagtcatgtccttgaaatcgcattcattgttttaattgtgtcctttttccgggttttctgtgcgctatccacaattttggacgttgttgaaatacaaagtcccacggattgacaaattttgcaccaaaaaagacccgtaaaaatttttacaggtctttggtcattaagccttaaattgtagcttggcatcagcaactgcataccaatccttcacacgatcggcaacttctccctcagggaagtaagttgggtaccagtagtcgataaagttcaactcatcaacgtgagtttgctcatcattgcgccaagcgtcacgtacggtcgtgtcaccagtctctaggttcaccttgaaacgaacgacgaactgttgcccatcaatgtggacatataattgacgtagaccagcttcgcctgggaatggttctgatgtaatttccgcattcgtctcagacaacacatcaacggcatgttgtcccatgtaaccattatctgccatcatacgcaaaaccatggcaaccgtataatcacgcatggtgcgttccttgaaatatgccttgtagtcaaacatttgttgttgccccctaaaacgttgctgctagcaactttacctgttccaaaatacttagtaactctcggtgtgcctcatcataagcaaccatttgatccccaaattgctcatcgaagccctccaaaccacctgcgataaacgcgtattcaaatgctgtcaccttttcaaaggcatccgtaaaggtttgccagatatcgtcatcgctttcttgcgtttccaagaagaattgaatgaaacgggcatccgaataccccatttcgaattgcaccgctagttggcgcttgaactcgtgttgattcttaatatgcaagaagtggtgttctgtgttccaagttacacgttctactgcttttaatactgtttgattcatcactaataagcctcgtttcttttcaacacctaaatggtaacactttgatttcctgcgggcacaaaaaaggcactcgaatttcgagtgccaattctgattacaattcggccaacgttgctgaatgacgttccccattaaagtagaaatctaatccttcagcaaatggtaccttgttgtctgcgactgcttcaaataatgtccatgatgcttgcaacttgcgcgcatcaacatccccgaagacatcaacaatgttagcagccttcaagtccaaaacaatctttgtcacatggagcaagcgctcagctagcgtttcattcgccaaataagcacgcgcctcttccgcatctgctagaccataataaaccgcacgttcgcttgaacctagtgaacgtaattgtgggaatacccaccacatccagtgtgaatccttcttgccagccatcaattcgtcaaccgccgtttgaaagctgtttgcgttttcttgtgccaaaacaaatcgttgcacatcatttgccaatgcttcatccatgacctatcacctcattcatattgataagttaattctagcatgatgtgttgttttcaccttggttcaacgttcagtttggaacgtctcgatatgcgttaactgatttgtcgaaacatcatctgcttttggtgacagcatcgcactcataatattatggccatctgtcgtatgccctaatccaagcgcgtggccgagctcatgcgccagcgttttcgttagggtgttttgattcgacaatgacaatacatcgccagaaacccgtagttcaccagttgatggattcatccaagccaacgcatgcgtaccagcatcggtgccttcatcacccatcgcacctgctcgcacaagcacatctggactttgacgttgttgcacttccttgatattaattttaccgtgggacttcacccgccaaaacttaatggcccccttgagtgcgcgctggacattcggcgtcgttgtttgaaaatccgattgcacaattgcgacggttaactcaccatttttaccggtgtacatccccagtgaatcacttgtgggtccaaaaccaccatttcggagtaatttttcattgccagtctcagcttgtttaattgtcaaattattcaactgtcgacgctgcgagctatagttaatcgcactcataattggctcgaagctactcccgaccgacccgaacaccaacaataaaatgatgctggtgtaaataattttgcgccggtgccgcggtttgcgaggggccggctttggttcatctgattctggctcaacaatgccataagtatcataaattagttgatccagctctttatctttttcatccaaatttgccaccccctttgcccttatcatactgggtcaatttgaatttttacagaaaaaaagagctggaaaaccagctcaacatcattgattcaatttcggttgtacattgtttgctgcgcgatagcaatttgctctgacaacgcttgtgaatccacttgcgtcaggacgtgataatccactttaatttccttaaacaacgcaaccaatgtgttttgcgcctgttccaactgttcatcagcaaattgtgacaccgccgtctgcttttgcaccgtcatatacatacggataattttcaacgcattcggcacgtggttataaagaaactcatcagccagtaccaaacgttccggcttctcagccaaggttgccattatgttatctgtgaatagttcgaactggtatcgatcagcgattgcttggagttgcgcatcggctttaaccaggtcattaataatttggatatcgttataacccgtggcaaacgctgtctggaaggcttgcttatccttacgcgataacccagtcaggtcataagtatacttggtgggcaaggttgcgctctgcacaaccggcttatcttgtaacaagccaaaccgtgctagcaaaacaacgaccgcaaaaatacctttcatttgccaggttggctgcgttaaaaacaaaacaccgactaataaagtcgccggcatcaaccatagcactgccaccttatcattcggcaaaattcccgccatgacagcaccaactaaaatgacaacgctagctcgcggtgcaacggtcgttaactccaaaccaagcgcacccatcaaaaaaacggcaatcagtttattgcgacgcaattcaaccgccgttagcgttctaagatttaacaacatcagcttccctcgttttctacgtcagtcactagtcgtcccttttaaactaggtgtatactgtttaaaaaacaggagccgaatgatgactaaattaacccgtcaaatcttaatactcgtgattttcagcggattattacttggcttctatgttatcgctatttatggaccaaaagcaaccagatataccagccctagtttcagtgaaccgtcggcaccattgacctcatcgtcatccaactcaagttcatcagcaattgattactcacgggcgccagccaataaccaccaagactatcaatcaacgttcttggataaagacttgcatacgatgtctgtcacggctaacaacttaaaattcaccgtgtcacatatcaacattttggataccaccaacgttgaatcgctcttttcgccagctgaaaaggcgtttgttaaagctgacgtgtcattaccatacgagttttatcgcgtcacacttgatgtcacaatcagtaattacggcacccagcccattaaccttttgaacaccaatgtcgccgggtggactttaattgatggcaacgggcaatcctttacgcattctgatatgcgagttggtcattacatgtatgatcaattcaacaccggtattcttgaacccggtgattcaaagtctggtgactttattgtgctaaccgattcaaatgatttcaactatcaaaagttgcaatttatcgctgccggtatcacgccggacaaaggtactaatatcacacctgctgctttctacctttcaactaccgaataacacaaaacgcgcttatcacaacatcgtgataagcgcgttttttcatgcaatttagtatggcatcttaatcgcatccaagagttgcatatccgctggactgatttcaaaatcaacatccgcattctgagcaacatactccgggtggttagcctttggtagtggcaacgtgcccttggccaatgcataacggatggctaattgggccactgagcgatcgtagtgggcagcaatttcttgcaactctggcatgcgcaacaaacgtcccgtgccaattgggctgtacgcctcaactagcaaaccatttgcttcatcgaatggttggttcacatcttgcgtcatcccaatgtgataaataatttggttaaccgcaggtgtaatcgacccgttgtccaaaatatttttcacatcttcattattgaagttcgacacaccgatactcttcaccttaccagcttgtaccgcttcttccatggcttgccaaaccgccaagttttcctcgtagtagttattaccacgacttggacgtacgtttggcacttccatttgattccaaggacgtggcgcgtgaatcaacaacaagtcaatgtagtccatgttcaacgctgccaatgactcatcaatcgaggtagccgcgtgacggtaatccttaatgctggcgtcaatcttcgttgaaatcgtcaatgtgtcgcgatcgatgccagattctgcaatcgcagcccccaccgcatcttcgttttgatacatctgcgccgtatcaacatacaagtagccagccgccaaagcagccgcaactgaatcatgagcttgttgcttggtttgttgccaagttcccaagccaatctttggcatcaacatgccgttatttagtgtgtatgtttcgtgtaaaaatgacatcgttctgacctcttttcaacttcatacgcaatatgatacgaccacttcgccaaggtgtttagaaaaagggtattagttttcagctaacatctttttaatcgccgccaccgtcgtttcagtcgtcaccttttgttcaaccttggctagttccgctggcgtggccattggattcacttctcgataagccatgacttgttcagccaccacctgctgcaacgcttgttgttgtgctgtatcttgggcgccttgcaactttgttagctgctttgcctgcttgtcagttactactaaccagctcgactttggcatcgtgaccactgaactttgcttggcaactgtaccaccctcaccaccaaaaccaaggaggaattcaaagaccttgtttcgccattcccagcgcgtcgttgttgtcgtaacggtcgcttgtgaaacattggcttctcggtatgttgcactctttttgactgcttggaccatatgtttggtgtcaggtacaaaatgcggggtggctttagcgtctttcttatcagcatataccagtacatagttatctgccttagtccccaactctttggtcactaatacgccaattggtagcttatcaccaaccgctgaataaatctgatgcgtctcagtcttggttaccttttccataccgtaatgacgatcaaagttaacgagcaataacatcaccaatgccacgaaaactgtcccgctaatcaaccctaatggcacacgccaagctaacggttcaatacgaatccacgctagatatgtcagaatggcaaccactgctaaaatcggaataatcatgctgcatcctcctcattcgttgctgccactggcacaattttaccgcccttcaagaagagcgcgacgataataccgataatcgcgaaactcaagccgattgcaaacgacacatggaaccccttcatcgacgcttccaaataatcagccccatattgcaatgggttggtcgtctccaaatgcttggtcggttcgtgatgcgcaataacgttttgtgttaccgacgacagtaaggccaccacaattgctgacgccacttgacgagcagtattattagctgccgttgcgtgcggtgcttcatttttcggcaacaccgccatggccatcgccgtcaatggcaccaatgccgtcgcaattccaaacatacgtaccgcataaagtgtcgtgatgaaatgcgtcggtgtcgttggtgacaagaataggaatggtaacgtcccgattgcaacgaacgtaaagccggtaatcgtcaagcgcttagccccaatccgatcataatcacgtcctgccagcaccgccataataccaatcatcaatgcacccggcatcaacgttaagccggattgcaacggtgttagcaagtgcacgttctgcaagtacgttgggagcatcatttcaacccccatcatggcactcatcgacatcatcacacagatggtcgtcaacgtgaattgccggtttttaaacacacgcacgtccacaaacggctcatccaaacgcaactgtcgtagcacgaatagcacaataattaaggcacctataatcattggtgcgataaccgtcttcacattgccccagccgtcggttgcaacattggtaaatgcccacaagaacgaaccaaatccgaccgttgagataaccagtgatggcaaatcaagtttcatgcgttcattcttaatgacgtttttaatacagaatggcgccgcaatgatgaccaatgctagcacagccattggcaagtggaaaattaaacgccatgaaccgtttaagttcaagcccatcaccgtgccgtgtttttggagcaaccagccggacaacgtcggcccaatcgccggtgccaatccgataacgataccgttcaagcccatggccgtaccacgcgcttcagccgggaagatattcaccataacgacttgcattaacggcattgaaataccgacggcaattgcggcaatgattcgaccagccaggaacatccaccacatatcgtgctgggctggtgtcagtgacgtaatcgtcataccgatgaatagcagtaaatacgctgtgatgtacaacaccttcgttggtatgcgagttgataagaacgctgacactggcatcataatgccgttcgccaacataaaccaggtggttgactgctgtgcagttgccaacgtaatatcaaaatctcgcattagcgttggaatggcggtcccgagtgatgtctgcatcaaggctccggcaaacgttccaatcaacagcaccgcaaccattgcattacggttgaacggtttaccattgatgtccgtaaactgttttttgaccatagttaccccctcaataactttatttaccctatcttacggagcgaatttgaatattgtggggatgaagccctgcctttcatgcaaaaaacactgaacagttgacccgctcagtgttttcagaatatttatacttgtgatgctggataaacaatccaggcgtaatgttgcgttgtgtcaaatagcgacggcaacgtgtatttctcgttttgaatgaaagccgtggtgtcaccatacggtccaccagttcccaaccacatacggaacgtagcgtcgtcccgattaactttctgaccgggcaaataaatcgtgatggcatcatttagaccaatgccgtatggttcggctgtgacttcacgcacaccatcaacaatcgtcgtcgcatttgctggaacataatcgagttgtgacactgtcattgtgtaagccgtatcggacaccttttggacattatctaaacggcctgtgaattctgaaattttcatgcttcccttgggataatccgcccctacgtcacccatatctgaatccgaaaacttaccagaaaatgtaccatcttcattaatggtcatgaccgtgcgccagccccccgctccagacgtgaaccaaaagtcgcgaccagcaatttgttgaaaaatcgttttctgttgcttaggtttctcagcctcattctcactggctgattgttgcttggcgttcactgtgaccttgtttgttgaatggtcatcgctaatcatccccatccccacatagccaaccccaaccgctacagcaacacctaaagcaccaattccccactgtactaattttttcatgtgcccctccactagaattgcatggcgttctttgaattcagcataccagaattgatcagattggctcgttcaaaagctcaatcggtaataaataaaaaaggattccgtcccacagaatccttttcaataaatttaaatgttaaccaacttgccctttttgtccttagcaatcataaagaatacaactgccgcaatcgaccatgcccacacaatgtggccgaagaattctgagaagtgctcatcaaatggttggttccaaggagctggcacagtccccattgctggcatcaaaacgatgtgccaagcgaaccataggaagataccgtaagcagcaccttgccacaacccaacctttgaccagtattgtgaaataaatacataggccatggcaaagaatacagaaaatgagaagtgcaaaatcaatgtaaaccaaaagaccttttgatcatgtgaatagtatacgtatgcgtgtgtcaaactgtgtggcacaccaaactgttccatcattgtttgtggtggattcgtcaaattacgcgcaattgtacgcggtggcaacaaattctcccaaccaatcttaaccatgccggaaatcattccagcaacaaagccgtaccacacactcttaaggataatttccttcaagctagcgaccggcttatccaacttaaacatctctatacctccataagtcgtcttacgcacatttcctatacgcataccaactaattaacattgataaatttatcacaaggcacttacaatgtcaaagcaatttaaaaaataccgtttagcatagcagccaaacggtatttcgtattatttttcttcaattgttttcgtgaccaggtcacgcgcctgcttaatggctggctctgataagcaatattgttgcatagtggcatcgataatcgcttcatcataaccagaattagcggccactaacttcactaactttgcgactcccactggaatatcaatctcacgttggtataacaaaccatggtacatcacttcagtaaaaccaccccacgcatcgatcaaattaatgtccagcttcgccggctcaacaaccttgtgcgcagataacaactctaacgaccaattgatttgttggaacatggcagcatcagctaaccgacgattttcaagaatatctaaattgaattgacgcatctcttttgaatggaaaaacgtgtaaaaataaatctgaatggctaggtaataacgtgacaatttatcaacgtcaggatacagttcatcaaccgctgccatgatcgtttctgatacttgcgcgttaacaattgtggcgaaatcttccttctttgagaagtagtactgaacaattgatcgttgcagtcccgcgcgttgggcaactgccgaaaaactcgttttcgcatagccctgctcaacaaacaacccccaaatcgcacggcggatatcggcaattgtttgttcattacgttgtcgtcccatgtaaccccagcctcctaaaaagaacttcattcattttcgcccatattcaacagaataacaagcaactgctgtgattaaaaaaataccgacggcttaacaaccatcggtatttaggtttattcaattaattaagcgtagttcttcaagtaagaaatacccattgcacctgggccagcgtgcgttgattcaattggcgttgtttccgcaatatccacaaccgcgtctgggaacaattcacgggcacgcgctgccaatttttcggcatcttcggctgcatcagcgtgtgaaataccgataacagcaataccgttttcttccgcctgcatgcgctcaaaaatcaagtcttggtaggccttgattgtcttcttaccacggcccttaacttccatcgtgatttggccaagcggcacgtgcgcaccaaccttgatatccaacaatgaaccaatcaagccagccgtctttgacaaacggccacctgcgactaggttcttcagcgtgctaactgttaggtatagttccgtattatcttcgacgcgttgcaattctgccaaaatttcatcacgcgttgcaccagcttcagccatgcgaccagccaccaaaacttgcatggccaaggcacgatcgatgtagtttgaatcacggacaaccacatcatgtggcaccatgcgtgatgcttgttcagccgcttgcaccgttcctgataacttgttcgtcaaatgcaatgacaagatttcaacatcttccggcatcgtttcataaacttccgtaaacgcacccaatgatggttgtgatgtcattggcaatgccttagcttccgccatcttttcaataaattcgcttggtgtaattgataccccatcgtggtaaaccacaccatcaatcatcaccgttagaggcacaaccgcaatatcatatgcagccacttcttccggcgtcaaacgcgctgttgagtcagttacaatttttactttagccatttcaaattccccctcgaccttctggttaaaatacttatgtttaataactaaaccatctagtatctaaaactatatcatatataggacgattttaaaacataggtcagtgtttcaatagcgcaaaaaaatactcccaactagcatggcgctaattaggagtttcactgtcatttaaataggcgtttcaagcgtcattcgctcagcgatatctaacaagtattgtgacacttgctggtcttgcattgttttaatgagtcggacaaattcatcgaaacgcggcttagttaattctgctaaagcacgtgagttatcaaggaaggcgatgatgatttgtaacccgaaataagcttggcgcattgttaacacgccaaacaattcactacttaacagtttcgtgaattcctcatctgatagcttttgtagtggcatttgccattggccaccagccgtttccgtgagattatcaagtatttcttcagctaaacgaacttgatcagcttctaacacatcccccaattgaatctgtagcttctcaataaagatatcgacttggttatgatttgcctcacgcaactcagccggcgttgtcgccatcaataccggtaactttgccaattcagttgggtgtaattcctcctgaactgctcgcaataaacgttctttatcatcaaagactacttggttacggtcattcaattgcaaaactggacccagtaaatcattaatttgttgcaaccaagtctgaacctggtgctggacttcatccgatgactggtggccaaacgccatcgcgatatgcttaatcatctgcaccttcgttcgaccgtatagtgtatctagcactgccaactgtgtattgtgggcgattgtcttttgccaacgttcaaagtcataatcagcttcccaatccggatccaaactttgaatatagaacggttccatgtattggtagaataagcgcgcatcttgactcttcaacttgatatcttggaacaaacgttcattttccaagtaatcccatagaccaccaaatcctcggccaattgcgccaaacttctcttgtcccgccttgctagcccaataatcatctgcgaattcatccaatgcctgttggtcatttaaactgatgccggcttcagttgcgaccgtcgccacccgcttatctgctgaataatagcctgggtatgacgcctcatgttcaaactgccaagccaattgttgggcagtcgtcataaaggtcggcgcatcaactgtcacggccggattagcatccacaaacatcgcaatcacatcaggtaagtgttgttgttgctcaaccgtcaaaactaccgttggtacaaaataattgaataggatacgcttcaggccagtcgtcgtccacttacccaatggttcatgtgcaatttcacgcatcatatcagcaaacaacggcagcatggtcgtcaccattgactcttgtatcgtaccgtccaatgtttcaaattgtggctggcttgccaacttagtcaacaacggcttaatactgtccgtcgtttgtgatgtttcatcggccagcgtctcattcgctaagttatctcgataagctgctaattcatcaatcacccattgttcagcaagacccggcgctaaatcaacttgtgccatgccattcagtgccaagaattggagcaaatctgttgtgaacgcaattatcgtttcatcatccaacgcttgaaattggtcatgcgacccaatcgtaaaggtcaatcccaacaacacatcttcgacatcccatgcaatcgttggcttgttagttaccaaatacacatcatccaaaattgctacgctcatttgttgggcattcacccactccgtttgcttggcgaacgatgccgttaagtctctaaattgttggcgattacgcttcaacgtccgcttgttgattggtcccaacgccgttccggccgttgataaaccagcccgtacgtcatccacaagcacttcatcaataaaaccatcttgatctaatttgagttgcatgattttatccctctcaactactttaattaagagtagtatacagcaaacgctcccggctaacagttagctagtcaggagcattcatttttattatcgcgtgaaaacaatcttgccgtgcaaaccgcctcgcttaatccggtcataagcagttttaacgtttgacgcattcaatggcaatgtctggtcaatgattgttcgcaatgacccatcagccaatcccgcaaataaatgtgccagattttcaccagctggcttgttaatcaaactgataaagcgtggatcatctgcttggtgcgcaacaattgagactagcttaccagttgatgtcagaattttagcagagtcggctaatactttttccgagccaaccgtgtctaatgcggcatcgaaatcatgaagcacagttgtaaaatcgtcttgcttatagtcaaacacttgtacctttgggaactgttgacgtaacatatcagcgccccagcccgatgctgtcgtcgcaacttcggctccctttgccaaagccagttgtaaggccacataaccaaccgcaccagaaccgccgttaatcaatactttttgtcctgcttgcaagttgaagccacgctcaatcacctgataagccgtttgtccgccaagtaccaccgataccgcatcttcatatgaaactgttgctggaataatagccgctaaatgaactggaaccgcaacttgttcggcatagttcgcgccaccgcgaacttgcgctgccactcggtcaccaacgttaacggacgtcacgtcttcgccaaccgcgatgacttcaccagcaaccgttgatccgagaatcatcggcacttggccacctaacataccttccgcaattttatagtcgactggatctaccgcctgagcctgcgcttgaacgagcacttcgtcacgtccaatcaccggcgttggcacttcttcatctgttaatgagtccaaatcattaaaacgatgcaaaacaacagccttcatgatgatgcctccaatgtgtttaataccttagttataccacttcaacgcacaaaacgcccagactagaaagcctagtccgagcgtcttttgattacttcttcaattcaagcaccgcaacatacggcaagttgcggtgatggttattatagtccatgccataaccaaccaagaattcgtttggtactttcgctcccacaaagtcaggtgtaatacccccggcggacacatcatcacgcttgtcgaccgctaccgccaccaacacttgatcagcccctcgcttctcaaagtcagcttttagataacgcaacgtcaatcccgtatcaatcacttcatctaggataacgacggtacggccggctaggtcaaccttcaaatcacgttgaatcgtaatgtgaccagttgacgaatcccccacgtaactcgacacatcgatataatccgtttcaacgtcacggccaaccgcacgcagcaaatcagccatccaaatgtaggcacccttcatgactcccacaaaaacaggtcggtcaacatgtgccgttgcatcgttgatttcagctgcgacgcgttcaaccatcgcagcgatttcttcagttcccaaaacagtccgttgcaacgtcattgtttccatgtttttacccctcgttccagatatcgaatagaataatcgtttgctcgtttgaaggaccaactgcgaatgtgtacaatggcacaccaatcaattcttcaacgcgcttcaagtacgcttctgcattagctggcaattcttcacgtgactttaccccagtaatgtcatcatcccagcctggcaactcttcatagattggcgttacgcgacgcacatctcccaagcttgctgggtaatgctcaatgcgttgaccgtccaactcataagccaccgcaatcttcaacgtcttcaaacctgacaacacatcaagtgagttcaatgacaagtgcgtgaagccaccaatgcgggcagcgtgacgcaaaaccactgtatccaaccaaccgatacgacgtggacgcttcgtcactacgccgtattcgtgaccgatttcgcgaatgcgatcaccaacttcatcaaacaattccgttgggaaaggtccatccccaactcgtgacgtataagccttagcgacaccaacaacacgatcaatattcgttgggccaataccagcaccaatcgttgcgccaccaccaactggtgaagatgacgttacgtatgggtatgtcccgtggtcaatgtccaacatggctccctgcgccccttcaagcaagacacgcttattgctatctaggtattcgttgacaatcactgttgtatccgtaatgtatggcttcaattgttgaccgtaatcagtaaattcggctaccaattcatccaaatcaagtggttcatgattataaatcttttccaacaactcgttcttttcagccaaaaccgtcgtcaaacgctcacgcaacacagcttcgtccagcaagtccacaacacgaataccagtacgtgcagccttatccatataagttggtccgataccacgtccagtcgtcccaatcttgccatcacccttacgtgcatcagccaattgatcaatcaaaatgtggtaagggaaaataacgtgcgcacgatctgagatacgcaaattatcagtcgttacacccttctcttgaataccgcgcaactcttccaacaatgccttagggttaaccactgacccgttaccaatcactgccaaacggttagggttgaaaatccctgaaggaatagctgacaactcaaacttctgtccgtcaacataaatcgtgtggccggcattgttaccaccttggtaacgcactaccatatccgagtgctgtgcgatgaagtttgtaatctttccctttccttcatctccccattgactaccaacaactacgattcctgccatgatggcccccttaatttactggaacgttcgcaaaacacgaacatttcaaaacgttttatcacaaaatctattttatcaacaaacatttgaagtttcaacactaattagcgttaaagttcgatttttgacgactacttttaattcacactgttgattattcgtgttttcgtaacattcattacattttgtgcataataaaaagcgatacaccgaagtatatcgctttaacattaatggttattgcggttgacaatcttaatgatttcccaggcaatattcggaatcactgataagattgcagtgataatccattgtgcagtcgtcaaggcgtggaagtggaaaatctcttgcgtcaccggtaccgtcacaaccaacaaactcaatactgctgccaaaatggccatcattaccaaactgcgatttgctgaaaacttgatgcggaacatcgacttttcactacggatattaaagacgtgcaagattgacgtcatcgacaagacaacgaacgccattgtgtgaccagcttcaacgttacccgtccagacaccgtacccttgggctaacagcgtaatcacggcgaacatgatggcattaaaggcaatgcgaatacccaatccatgcgcaaatacgctggcctttgggttgattggcttctcattcatcacatcaccgtgcgctggctccttagccaaggcgaatcctggcaaaccatcagataccaagttaatgaacaacaactgggctgccataaacgggctgccccagccgaagatcatcgccatgacaatcacgataatttctgacatgttagcactcatcaggaagttaattgtcttacggatgttgccgtaaatgccacggccttcttcaaccgcatgcacgattgtcgcgaagttatcgtcggtcaagacgatatcagccgcttcccgggcaacatcggttccagtctgacccatggcgattccggcattagcagcattcaaggctggcgcatcgttcacaccatccccagtcatcgcaaccacatcaccacgcttctgccaggctttaacaattcgaatcttatcctctggcgtaacacgggcatatacggcatagtcttggactgttgcatccaactgctcatctgacatggcgtgcaattcagcacccgttaatgccttatcagttggcaacaaaatgccaatttcacgggcaatcgcacttgctgtcgccacgtggtcaccggtaatcattaccgtcttaataccagccgcacgggcttccgcaacggcttgcgctgactctggacgtggcggatcaataatcccaaccagtccgagcaactgtaggttttgctccaactcttcggctgtcggttcttcagaaatcgtcgccaacttagtcatcgcaaccgtaatcacacgcaatgcttgatcaccaaattgctggttgatttctgttgcgcgactttgaacatctgctggtaactttggtaacaagacatcgaaggcgcccttggtaactgccaagtaaccatccgccaccttgtgtaccgtggtcatacgcttacgagttgagttaaacggaatttcataaacctttggatactcagcttgcaagtcacgataagcatcaacgccaccgataccagccaccaaggcgatttcagttggcaaaccgcttagttgcccatcttgcaccgtcacattagttgataatgcaccaaagcgaagtgcatctggtacggtatcaacttggtcgactggcacaacttcatctttggttgcatcccaaacttgacgcgctgtcatcttgttttgcgtcaacgtccccgtcttatccgatgcaatcacgctcgctgatcccaacgtttcaacggctggcaaacgacgcacaatcgcgtggcgggcagccattcgttgcacacccagtgccaacgtaatcgtcacgataaccatcagcgtctcaggtaccaccgcgacggccaatgagacggctgtcatgaacagctccatgattgggtctccttgcatgatacccaataccaagacaatcaacgctgcgacaatggccacaaccgttaattgacgacccaattgcgccaaacgcttttgcattggtgtcatttcacgttcttcggcaccaagcaaaccggcaatcttacccatttcggtttccataccagttgccacaacaaccgcttcggcacgcccattaacaatggttgtcccgcggtaaaccatgtttaagcgatcgcccaacggcacgctctcaccagtaataaaatcttcgtccttttcaattggttggctttcaccagtcaacgcagattcttcgacacgtaaatcagacgtcttcagcaaacgcgcatcggctggaatcttcaccccattttcaagaaccaaaatatccccaacaaccacatcagtcattggtacaaatatgactttaccattacggcgaaccttagcttcttcgcgctctaagcccttcaatgaatccaaagccttctcggcacgtccctcttgcacaatcgacaagacggaattaataacaacaatggcaataatcaagaaactctcaaagtaatcgccgtgcccttgaataacagttgtcaccaatgaaatgaccgctgctatgatcaaaataattgttgtaatatcacttaaactccgaataaccttcttaaccagcccctcttttggcggttctacaaaacggttatccccatatttttcacgcgcctcttgaacttgagcgtcggttaaccccgtatcgggttgaacccgcatcttttcaatgacttgcgttaacatctcctgatatatcatatgtcggccctcctcttcgtcggcatatctcttctcagttacattttaacaatttccgttacttagacctaataatgtgctcaaattttgaaaacgttcgtattttgcgaaagattacacttacatttcgtcatttgttcgtgaatttcgttgacaacgaacgtttcatcgcctaaactatgaaattgttacgaaagaacttattttattctatctatttgaggagatacagatgaactctgttgcaaaatatttccgttttggcgaactcggaacaaacttccgtactgagctaattgccggattgacgacttttgtctcaatggcctacattttgttcgttaacccaacggttttgggagccgctgggatggacaagggtgccgtcttcaccgctactggtgttgctgccgctatcgcaacaatcttcatgggattagttgcccgttacccaatcgctatcgcacctggacttggtgtgaacgccttcttcgcttactctgttgtaatcgggatgaaggtgccttggcaaactgcgatggctggtgttttgattgctgccatcatcttcttgttgctaacattcttcaagattcgtgaaaccatcatcaacatgattccacaagacttgaaggttgccatcgcagctggtatcggtttgttcatcgctttcatcggcttggctaacgctggtttgattgttgctaacgaatcaacaatggtctcacttggtcacttgacgtcaggtacatcattgcttgcaatcttcgggattattgtgacgttcatcttgattgccacacgcgtcccagctgccatctttatcggtatggtgctaactgcaatcgtgggaatcatttcaggtttgattgacttgccaacgcacattgtttcagccgcaccttcattggcaccaacgttcggtgaatcaatcttacacatcacggacatcaacacattccaattgtggacagttgttttgacgttcttgattgtgacattctttgacactgctggtacaatgattggcttggcaacccaagctggcttcatgaaggatggcaagatgccacgtgctggtcgcgctttgatggccgacgctgttggtatgacggcaggtgctattcttggaacgtcacctacttcagcctacgttgagtcttcatcaggtatggccgttggtggtcgttcaggtttgacgtcaatcacaactggtatcttgttcatcttcgctttgatgttctcaccacttttgacagtggtaacgtcacaagtaacagcaccagctttggttgttgttggtgtattgatggccgagaacttgcgtaacatcgattgggatgacttcgcaatcgcagcaccttcattcttgattgtcattggtatgccattgacgtactcaatctctgacggtattgcattgggattcatcttgtacccaatcatgatgattgctacgaagcgcgctggtaaggttcacccattgatgtatgccctagcattcatcttcatgttgttcctattcatcgtcgcccactaaacttgataaaaaataacgcccctagatgagttctgttactcatctgggggcgtttttatctgttattagtgtagttcaccttgaacggcgtttgtgtgcttgcctggaattgccaaaccgtagcgcgtgttacccaacgcttgatccaccgtcatccccgcaaatgtatcgttaaatgcagccaccgcggcaaccaaatcatcagcatcaacaaaggcgtcgatagcagcagcaccgtaaacacccatgcggacaatgtccttcaaacgggcaacagtgataccacccattgcgacaacaggcaaatcactgttttgaacaaccgtcgtcaaccctgccaagtgctcaattggtgattcttccgtcacgtgacggcttgggtacactgggctaacactgtagaatgccaaaccagctggctcttcttccaacaactcagtacgattgttaattgaaacacccgtgtacaagtcagccgcttgtgcttgcgcagtcaattcgttcacttggtgacgatcggtaatgtacacaccgtcagctccaacagcggccgcgagtgcaacatcgtcggcaatcatgaaggcaacatctgcagtacgcgttacatcgcgaatgtactcagccaagttttgcttttccaccccagtcaattgtgcttcgttcaaaattaccattgaaacgccagccttaaccgcttgcgcaacgaagccagccacatcgtccacatattgtgatccaatcaccaatgtacttgctaattgttctgccttaaatgtcatgatacacctccgaaaatccgttattctttacatttgtaagtataaagtttttaaattatcgcgacaaagaaaaaggaccgttttgcaacgatccgcttctgattatttcgtttgtttggtgcttgctcgccactcagttaacttcgtttgcagaatggctgccaacgccagatacaacaaagaaaatgcaccactatgtgtcactaactgatcgctttcaacatgcaacaaaattgatgcaatccagaaaaccacggtgcccacggttgcatgatgcgcaacatccccctcatcagtcacccacatttcctcagataacgtgcgtgcaatcgatagcaaccccactgatacaacggctatcaaaccgataatcagccacccagcagcgtttggattcacccaatcgttttggacagctgttccagcaataatcactccgatggctaaaatcaacgcatccaacttatatgacgccgtcaccaaccgcggttgccattgacgccaaacgatatatcccacatagataatcggtaatacccaattcaacattattatcatctcacacctcattttccaaaaaacggtcatccgataactcatcagatgaccgtttagattggactattgttgttctgcaaattccgcttgcaaagttgcttgctcttggcggtatgcattcacaagacgagctgtagcgccttgctcttgttgatcaatgaccgcacccaacgtgttcatcgcacgtgtgtagtcaaaatcagtttcgtagtagtaacgcgcttgttgcgttgcttgcacaacatctgcattatcacgatatgacaacgccttgcgtaccaaacgttctgtcactgacgcagcctcaattagtgcatcggtgttttcttgcaacgtatccaaatcagccgtcacaatgcttagctgacgcaaaacatcatcaacattaatacgtgacaacccaagctgttgcttcaaacggcctaactcatcgttcaccgcgtagaagaaactcatgtacgtatcgggcaaaccaggcaacccctgacgttcaaccgcacgttggatttggcgcaacttgtccgacaacaacgtcacgcggttacgcgattgttgcaccaactgtggtagctccttcaagccttcccacattgaaacttgttccttttcaatgcgctcaagctcttcgcgcaaaccgttttgcgtttctagcaagtgtgagaagacaacttcgtgttgtgaaattgatgccttcaattcttccaagctaactgaaacatttgaaagttggatttcccaactacgtacttgaccaacttcatccttagtaaagacaaaatcttgattcaggcggtccaactcaatgtacaattcgtgattttgacgcttgttgtgaacaacgtaagcagttaactgctcattgttctcccaaacctcttgcgctgaactagcttccttttcaaatgtttcgtacaacacttctgtacgggcttccatttgcgcaatcgtttcagtaacttgcttcaacgttaagtcagccagcaaatccaatgcgttgttgcgttgggtttcaagctcttcaagctcttctggaatatccgtttcaaacttgaatccttcagcggccatcttgtcatacgcgtcgtgcaattctgctaattgccctggcaacgtatcatccaatgacttgaacaaccctgggatttgttcaatgcgttgttcaagttggttcgtttccatccccaacgtctcgtagataccggcggccgttgcgtgatcaccagcttccgtcaaacgggcaaactcagcaaagtcatcttccaatgatcccaaaatttcttccaacttatcgattgctggtccgaaactaaagttttgtgacaacaacgtcttacgtaggtcttgatacttaacttcaagttccttcacggctgccttgtgcgcttcgtctagcttttccaaatcagacaaaccttgatttacaacatcaatcgtcatttcagcatcacgaatcaattgttgcaattgcttcaattcttgcgctgtcttcacgaagttcaagccttgtgattcgaatagaacactgttggcttggttttcaatttcattgaagccttgcgtttcaagtgtgccgtatttattctccaacaattggaattgcttaagtgattgacccgtcaaactcaattgacgtcctttcaccaagcgatcacgcattggaatttcagctaattgttccttcttctgaagcaacttagctaccttgcgtgcagtcaatcgttgagagacaaagataatcaagtaaatggctgctacgacaactatcaagccaattacgatatgtccaatctgtgtcatactctacctacctttggcgacgcctaatcgtcaccaagctccttactattcgggaattatctacatattagattatcacgccatcggttttacaaccgctttttttgccccgacttaggttttacttggcgttctttaaccttttttaatcgcgtttacagattatttgcgggcaaatatatatctcatgacattttccacaaaaaaaccatcattaaccactaaaagttttccacattatccacaagtgccaaatgaaacatccattctcttgtggataacctgtggatagttttgttagaaaatgagattttgatgataacaattaaactagttttccacagagtttccacaacgcgtccacaaacttatcaacaagttatccacagttgttaatttagatggggaacaaaaggtcagtattctttaaaagagttggtaaaaaataaagcactgacaatagtcagtgctttgatttaacgtctaaaacagcgccccatctgcgatttcgcccagtgtatcacgcgatgggataaagaatagttgacctgattggatggttgagaacgtcaacaaaaagtcggacatatccaccatttgttgcaacatcgccttcgtcactgaccagtaacgtgaataaccaataaagtaggtccccgtttttccggttgctggatcagaaaacggcacgttcatacggacaattttttgctcttcaccatcaacttcaatcttagcagcgacattatgtgcattatgaaacttttcatcatcctctagttccaaatcatcaaacttatgacgacctaccgctttttcctgttcttctgttttcattttgccccagaagtccatgtcatgcagccacttttgggcaaaggcgtacgacccattaatatactccgggtcctcctcccctaccagcgcataatcggctgcttcaaattcagccggtgcttcggtaccatcaataaagccaataatggcgcgtccttcaaaataacggaaaccctttgtctcatcaagcacggttgcgattggctctagaaagaccatgaactgacggacgacttcgtacaccaccgcctcatctcctgcgcgaacgtgcaagaaaatgtcgccttcagatgccggcatactatattctggtcccgtcaatgttgtgtaggtttctagttgcttaggtaccgcagcattcgggaacagataatcccatgccgttcgactgaacccaatcgatactttcaaattcgcatccgctgcccgaatcatcatcgagcgttcaatagcttgcgaccgatcagcaaactcagcaatcgcttcttggtctgctgccaaattctcgcgctttaatttcaatacgacgaaagacacattctttcccacgtctttccatacatcttgcgccttagttggtgttactggcatgatattatcccccaaaattatatcgttctgaattcattataatccgggcgcatgctaattactgtttccaacacttccgctgcaaacaaaaacagacccggcaatctaattgattaccgagtccgttttcgtcatcgcctacttagcgtagaatcttgttggataaaagataaatgccactaacttcaatttctttgacagccactcgccaaacaaactaactgccatcgcaaccataaagacaagtaccaagtcgatcaacagattgttacctagcaccttcatcaccacaatacgagcaattgatacaaccggtgggtgaatcaaataaatgacaagtgaaatcttaccaaagtaacgcaccacatttgaaaccttgtctgtcatttcaccaagccacatgaatattgcaaagaagactggaatcgtcaaaagcttaatcataaaattagccggtgtaatgaagttcgtatcataaaaccaagttgacgcaccttgcaaaatccacaaagcaataatcagccccaatgacacaacacccagcacagccatctggccacgctgcaactttgaacgtagcaagtaaccaactaagaatgttgcgccccaaagtaccgtttggttaatcgcatacaacgttggcaagaaacccaaaattgccaatgcaaacagtacggtgtataccaccagcagcacagctttgcgcttaatcaccaaaatcaacgcaccgaagagaaccaagataaagaagtatacatacaagtaccatagatacccaactggcttgatgccaatgtacaacaaatcaccgattgcgtatcgatcatgcactgtagatgatgatagattttgcaggatgacgtagacaaccgaaaagacaacatacggtacgcccagcattaccaacttctttcccaaccctgttatgtattgacgccagtcagtcgaaggtttgaacaagtaccctgaaatagcaaaaaataccggcataacgaacataaatagtacgcgttgcgacatttctagctccatagctgctgctggaaattggccggttttatatagtgaaccaatcgtatgaactagcacaacactcaaaatcaggatacctttcccgtaatcaagccagcccacccgcttctttttcgcgacagatttttccatatttttctcccaagcgttggataaagcagcgtggtcacgtcggatgtttagaccaacagctgctgtgataaatttaattgtaccatctgacgcaattcagattatgcctgcttcgaaccctcagaatgccacaaaaaaagcacgaaacataatcgtttcgtgcttctttgttgtacaacaagtacgaataataaaattatcccaacttgttgtagtattcaacgataaggttttcgttgtaatcgtggtccaattctgaacgctctggcaagcgaaccaatgaacccttcatctcgtccttgttgaactcaacgaatggcaacgttccagccgtagcttccaatgaagcttggatgtaaacgttcttttgtgacttctcacgaactgagatctcttgacctacagtaacttcgtatgaaggaatgtcaacacgcttaccatcaaccaagatgtggccgtggttaaccaattgacgtgcttgttgacgcgttgaagccaagcccaaacggtaaacaatgttgtccaaacgacgctccaacaatacgatgaagttttcaccgtgcgtacccttacggatcttaccagccttgttaaacaagttgtggaattggcgctcagtcaaaccgtacgtgaaacgtaccttttgcttttcagccaattgcataccgtaatcagaaatctttgcgcgacggccggcaccgtgatctccaggggcgtagttacgacgagcaatttccttaccagtacctgacaaagaaacacccaaacgacgtgaaacacggaacttaggtccagtataacgtgacatattaaatgtcctccagaatttatttttgttgaattctagagaattgcctcacattcgtgcaattcacccaaactttcaccgctgcagcgcgggtactggtgtgttctccgccataattgaaacgggtcggtgaattgttgacgagcttgcggacaatccgctgcagttttcaacacttcaattagtttaacaaaaaggaagaacaactacaagcattcttcctaactttatctctttagttttgctttgaaagcgcatcaacaatgatgcgacccaaaacaccaacaatgaaaataccagccaacatagcaccggcaatttgcaacggcatcgtaccaaacttagcaggaccgccattcaagctcaaaataatgattgaaatggcccaaccagtcaaccaagctgctgtatccacccagttacgaataccaggcataccagaaatcaaaacagccaatgcacctaggacgaacaaggtcacaaacagcgttgtcttaggccaaccagtcaatcctgggaacgtgacagccatcattccccaaggaattccgagccacataccaaatagctcacgccacttgttcttaggatcgttacctgatgccacaaagaaaccacctgtaatcaaggcagcagctccaaccgtcacaccaacaaacggcgctgcaaccgcccaaagtgatggaatggttgccacaaacaatgccaaagcaattgttggatttaacttatgcatttctctatctcctacgcaaacaatgaataataattactaacggtaagtaattatacacgctttcggagattgtgcacaaaaaacggttttagctaaaaaacgcctacatgtaggcgttttgcttgtgattatttttccaaaaagaattcgaaacgagacccaacatattgggtacgaacgtactcgaatgggcgattgtttgtgtcaaacgtaatttgtcgcatgactagtaccggatcgccacgtttaatgcctaaatattcagaaatacgttccgtaacagccgccgcggtcaccgtttgttgtgcgcgaccaatctttagaccacgctcttcagagagtgtacgatacagtgaattcgtaagactttcacgtgccaaaccgtcaaccaaagttgctggaattgaggcaacttcaaacgcaattggctcatcgttaccgtaacggacacgctccatgcgaagcacttggccatcctcacctagttgtagttgctcttgttcagagtttgatgccttcccgatatggaaagaaatcgtgcgtgatgttgcaaccttaccagctgctgccatcatttcagtgaatgacgtaacgccgttcagttgttcttgcaccttgcgttcagcaacataagttcctgacccaactcggcgttccaagacaccttcgtctaccagcatcatcaccgcttgacgcaatgtcatgcgtgagacaccaaattgttcagccaactcacgttcagccggaatcttgtcgcctggtacccaacggccagcttcaatagcttcactgatttcatcgtgaatttgaatatatacgggtgcgcccatattagtcctccgcagtcggagcgtcagcctttgagaagtgacgacccaaactataagttgcttccaaagatgtcaaatctgcgctaaacacgttcaaatccgcatccttgccaatcgtcaacgttcccttgtttgtcaaaccaaactcaatggcttggttaactgatgccatttgaatcgcttcctcaattgacgcacccgtaaaggccatcacattgcggaaggcatcatcaaattcaagcacagatccagccaaagtaccgtcttcaaggcgagcttgcttgtccttaacccaaaccttttgaccacctagctctgattcaccgtctccaagtcccttggcacgcattgaatccgtaatcaaatcaatacggttagccgtcttcaacttgtaggccacgttaaccatgtcagggtacacgtggaaaccatccacaatcaactctgtgcggatgttatcttccagcatagcgtgtcccgttacaccaggttcgcggtgtgacattggacgttgtgcgttgtacaagtgggtgatgtggcttgccttagaattgtgttgcaagaaatcacgtgttgcatttgagtgaccgattgaaccgataatgttgttatcagctaggtaatcctcaaaggcacgcacgtcttcagcttgctcgggtgcgtacgtgatcaaacgtacacggttacctgacaattcgttccacttctttaccaagtcaatgcttggtgcaatgatgtgttcctctggttgggcacccttgaagtgagggttgataaatggtccttccaagtgcacaccaacgattgctggttcttgcttggcagcttcatttaccgcttccattgactttgagatattgtccacagcttgtgtcattgtcgttggaaagactgacgtaattccttctgaaatttggccgtgaaccatcttgatgatatcttctgtgacaccgtccatcgtatcaaaaccgtacgcaccgtgtgtgtgtacgtcgatgaaaccaggaacaatcaccttacgatccgcgcggacgacattatccgctgacgtcacaaccaattcactcattggtcccatcgcttcgatttgcttgtcgaaacggatgtaagcatccttaattactggcacttcttgttcgccggtatagatagttgcgtgtgtcaaaactgtactcatgatgaactccccttgtttatagaaaaactaaattggtacaggcggttaaccaccgtctctatcatgttctaatcgcttacaagtttacacggtctagttgatttttaaaagtcataactcgaaatatagcagattgtttccattccaaataaaaacaaccatcactcatatcagctgatggttgtttacaattttcacttcaagaattcaggtgccaagtaagcggggttagggtacttatagaacccttctcccgattcaacaccaatatgtccagcatcaatcattgtcttgaccttcttggcaatttcttggtgtgatgtgtctgggttcatgatgttaatcgcataaactgtattcaagccaaccgtatccatgatggcaaatggtccagccggagcaccagtagcaatcatccaagtcttgtcgattgtctctggatccgcaatttcatttgcccacagttgtgaaccagcatccaacaacggcactagcaacgagttcaaaacataacccggttgttccttcttaaccataattggcaccatgccaatttcacgtgagtattcctcaaacgttgctggcaattcaggtgcagtgcctgggtgtggcatgatttcagccgtgttgttcttccaaatttcgttagcaaagtggtaagccaaaaacttttctggacgaccagtcgcctcagcgaaggctgatggtagcaacgttgaagagttagttgccacgactgtttgtggatctgccaacttcgcaaacttttcgtagaactcagtcttggtggcaggtgcttctggcaacgcttcaatcaccaaatcagcgccagcaagtgcctcgcccaaatcagtgacatacgttaaatgctcgcgggcagctgcgatttgttcgtcagttgcttgcaagtcgcgacgtacaccgtcttcccaacgcgcaacacgcgcttgtgccttttccagtgaagagtcagaacggccccacaccgtgacatccttaccgtggaatgctgatacgtaggcaatttgtgatccaagtgttccaccaccgacgattgttactttttgatatgacatgtgataatcccccatcatttttgattaactacaccatatcatgtaagcggtttctcatgccaaagaaaactatcgaaaacaaaaaagcatccccacaaattgtgagaacgcttctgaaaatctatctattagtctgcagacaatgcatcgattgggttcaactttgctgcgcgacgagctggcaacaaagcggccaagaatgagatgaccaatgccaaaatcaacgtcatgaccacatttccaactgaaatttgaatcatgtcaaacttcgcaatgctgtacaaagctgaattcaacaatgagccaattccgaaggccaaaattagggccaaaacgaaacttgccaaaccgattagcaaagattctgacgtaaacaagttacgcacatccttcttgctttcacccaaggcgcggagaattccgatttccttcgtacgctctgaaactgacatgaacatcgtcacgataatcatcaaagcagatacgaccaatgagataccagcaatggcagccaagacattcgttgccaatgagacaattgtgttaatagtgtccaagattgacccaaccgttaccgcttggaacaaacgcttgccatcatcacccttcatcttgttgatgtccttttggaaggccttaacatcgtcagtgttcttaacacgaaccgttacgaacaacgcacgggtatcggcaccagcttccttgtaggcatcttcaatcgtgcttgctgtcgttacgtttgccgttccagcttgaccagcgtcgataacacctgcaatcttgaacgtcttgttaatttcaactggcgtcataccgtctgacttaactgccatccacttaaccgtcatcgtcttaccaacaactgacttccagtccttagtatcgaacttcttggcaaccgtcttcttatcaaccaagatttcgttcttgccaggtacatgacccgccttaatcaacttcttttgataagttgctgaccaagtttgcactgtcccaagtgagtaatccttaccttcaagatttgcttggacattgccggcttggtaacccttttgcaacgtcttcacgtacttgttagccttaattttcttgatttgatcatctgaaatggtcgtcttgtccatatcgacaccggctgtcgcaccagacgtttggccaacgccaccgttttcaccttggtgacgggctaccgtaacagccgttgggtttgccaatgagttaacttggtcgttaatgtaggccttaaccccatttcccaaaccggtgaacaacatcacagcaaacaacccgatcgctgttccaatcataatcaatgagttacgccagaagttatacgttaagtgcttgaacgcattacggaatgacgcagctgctggtaatggacgatctgccaaacgcgtatcatcagctggcaactcgtatgctggcttcaaacgtgtgtcggcgtcgatttgaccatcagccaagtgaacgatacgcgttccgtggtcagccacttcttgtgagtgagtaaccgcgataactagcttaccttcttgagcaatttcgtccaagatttccaagacttcagccgtattctttgaatccaaagcaccagttggctcatcggcaatgataatcttggggtcagaagccaacgcacgcgcgattgcgacacgttgcttttgtccaccagacaattggtttgggtgcttcttaatttgatccttaagaccaaccttctccaacaattcggttgcgcgcgcagtcttatccttttgactcaacgtcgtcatttccaatgaaaccaagacgttctctaggacagtcaagtgactaatcaagttgtaagcctggtagatgtaaccaatcgtgccacgacggtaagcatctaattgcttttccttcttgtggtccaagacttggccatcaatcgtgaccttgccttcaaactcgcggtccaaaccaccgatgatgttcatcagcgttgacttaccaccaccagattctccaaggattgaaacaaactcacccaattcaaaatccaagtcaattcccttcaaaacaggaaactcttccttacccaggtagtatgacttgcgaatatcttttaactctaaaaatgccattgtctctcctccggctctctacgctttttgtcatgataattgtaattaagtttaccgccgtattgaaatggcgtcaagaaaagtttaatcaaaatgcttttgattaaactttttatgttatagtaattttataactactagcggaaaggtggcacaccatgaatcgtgaagaaaaaaaggcgctcacacggcgacaaatcattgacgttgcgacgcgtttattccgacaacacggcatccataataccgatttaaaaacaatcgctaccgaggctggcgtgtccgtggtcaccttttacaagtacttcgatagcaaggatgccttgattggcaccatcgcggccgagcaactcaatacgttgttcgatcagattatggcgattaccaaccaaaccgatttacgctttatcgaaaagattaaagccttcgcccaactgtcccaacaaaagcagcaagaaattgcgaatacatttggggatgaaatgatgcaactgcttgaaaaagacgattcagccgttcgcgcagttgccgagtcacgccgcgatgaatttttcgaagcaatcatcgagcaaggccgtgacgaaggtttctttaccaccaacgttagcacaaccgctattcgcgtgtacattgatatgtttgtgacttacccaaatgttcaagctagtttggcttcaaacagtgatttaacccggcgtgagttggatgcccaattggaagaacttttcttcttcggcttgatgggatcagtagacgccgcccaccgcgaccaactaaatgaaatccgtaaacaacaaaagggatgagcaactgctcatcccttttttgcgattgtctgcaacacaccatcatgattgttatccgcaactgccacagcatacccatatgcaaataggcgcttatcagcgttgggcataatcaccggttgaccggctactgacaacatttcctggtcattcataccatccccgaacgccattaagtcagccggttgaccgcccaaatgtgccaacatccgttccaagctcactgccttattgacaccagttgccatcacatccaccaccccattaccaggtgtcgtagcgtgaacgtcaataccactctgcttaacttgattaacaaacgtttcactttcagctaacgtccaaaataccgtcactttaacaaccggtacgtgcacttcgcgtagtgacacgacttcacgcggttgcccgtataattcagccatcatcgccacaaacgccggtggtacttggccgtagtcacgcacaaccagtaattcatctgggctaaaaatcatcaccccaccatgtggttttccaggcatcaggtcgatttggtcttgcaaatctgctaattgttcaggcgtcatcgtcaagcggtctgataactgttggtcagcagaaagcaacgttgcgccattatcagccacaatgttgaccttatccaaaaaaccaccgaataacatctgaacgtgtcgcaaatcacgaccgcttgccacaatgaattgaccaccctcagccgtataagcgttaataacctgcgcaaataaatcacgattgtattgctttttgtcgtttaaaaacgtgccatctaagtctgtcgccacaaattttgccattatgccacctcacttcatgtcatctagcttaatcctatttattgaatattacgttcgaaatctatcaacttttgtttccaattttgaccagctcggtactgtcccagtgtcccatcactgcgaacaatacgatggcaccccacaaatactagcaatggatttttacccaccgccgatgcgacagcacgtacagccgttggtcggccaatctgattcgctaatgtcgcatacgtcatcgtctcgccaaaattcgtctcaactaaagcgcgccaaacttcacgctgtaattctgttcctcgcccctgccagtcaggtgtgaaatcaaccctgcgaccagctaaatagtcagacacaaccgacccataatggcgttcctgacttggcttgaccgtcatttcaccaaaccaagcttgatagtcagctaccggatcttcagccaaggacacaaacgtcatccccttctttgaataaaagattgtcaagtgaccgcctaaaaagtcgtacgtttcatattgcatatcatcatctctttcaaatgaaaaaagctactcgtaatcatcgtttacgagtagcttaccaaattatttaaatgatttcttctagcttagccaatacaccatcatgttcgttgtccaagtcagccatgccgaacccgcgattaaacaaacgctcatccgcatttggcatcacataaacttgtccagccaattccatcatttccaaatcattcatgccatcaccgaagacggtcaattgctctggtgccaatgatagcttgttgatgagtgccgacaaactcgttgccttattcacaccttcagccaaaatatcaaccgcaccatatcctgacgtcgttgggtgcaacggcatccctgatgcgttaatacggcgaatagcttcatttgaacttggcacgtcaaagatagctgtcacactggccaacggttgcggaatatccgttaagtgatcaaccaagtgaattgtaccgtacacatgcgtcatatagtcttgcaagtctggtcgcaattcgccgtatcctgacaaacggtacatgttgtcttcagagaaagcaataatgccatcctttggtgaaacatcaactaagatacgttccaactcagccaacgttgatgcatcaagtgtacgtaagtctgtttccgcagtaccacgaacgtgccaggcagcaccgttatttgttaccaagtggacgcggtcagctaatacgccaaacttgctacgtacccactttgcttcgcgaccagttgcaatagcaaattgatcaccgttttcatcgagttgatccaaaatcttagcaaatcgttctgcatcaaaggtcttatcttcgtgcaaaaatgtttggtccaaatccgttacaaacaagcgtgtcatgataaccgcctccactttccttatgtcagtaataagtgtatcaaatcgtctgcctttgtagctgcctaaaaggaacaaaaaaggcgattgctttcgcaatcgcctttcgcgtatagcccatcagggagtcgaaccctggatgccggtgtgaaaaaccggagtcttaaccgcttgaccaatgggccatgatgttttaacaacctgtctcaacaacaaaattaatattaccagaataacctgaccagtgcaacccctaattttaaaactcgcaaactttcttccatagacttccgaccatacggtataattactgcagaggaaattaggatgactgacaaacaacttgcccacccaaagtggttgctctttttcgaaacgttaacagccatcggcgttatcgtagccttattacgtttctttgcatcacttatcaatggtatttatcatcactttaccggtcacacgtttgcattcgttgaggcagtcaaacaaaacacgtggcaaaattatttgaccctagcgatattgattattggtattttaggcacccgctatttgaagacaaagtttaagtaaaaaggacgaccaatcggtcgtccttttgctttagttattcgaattcagcattcttcttcattgtggcgttaattgtatcagccactaattggttaagatgtccatcttccagaacttgccatccagcagccgttgaaccacccggcgtcataacttcgtgcgccaatgtcattgggtccttcttgaattcttccatgtgacgagccgtaccaataaccgtttgctgtgccaatcgttctgccgtttctggattgataccagcttgcacaccagcttgaatcatcgcttcagcaaacgccgcaacgaacgctggaccagaaccagccaaggcactgacagcaccaaattgctcttcaggtaattcgtctgtacgaccaaagtccaagaacaaagctgcgatagcccccttgatatcagcgtccatcgtgtcatcaaacgccaaagctgtataaccatacttaagcgccacgttcacatttggcaacgtgcgtgcaatcagaacattaggccccaacgcagcgtgcaattgtgccaatgacacaccaccaagaactgacgccacaataacacccggcttcatcatcaatccgagttgtagttccttggcaacgtcagtcaattgtgcaggtggcattgccaaaacaaccatgtccgactcagcccaaacatccaaagcagactgcttagcctctaatcctaattcagctgcaactttttcacctgaatgtggtgaaaaaagcacttggcgaatttcggcgtttccttgccagccttgcatcatcgctttagccatattaccagcgccgataaatccaattgttaacatctcacacctcgttcatctcgtttgtaatgacctaatcatatcatacctagatgatataagaagcgacccaccgttttgtttttggttgtcattcaaaataaaaagacctcgaaccaaatcgaggtcttcatgttcattatgagaacccttggcgttcagataatgagaatgctttattgtgatagcgcatcgacataatcaaaccgatacccaacatatttccaaccaaggcggaaccaccctgtgaaataaatggcaacggaataccagtcaatggcaccaatccgatattcataccaatgttttcaaaaatgtggaacaacaacatcattaccacaccagatgcaatgtatgcatagaattgatttgacgtatcattaacaacttggaagatttggtaaatcaacaagaagtaaagaaccagtagcaagacacttccgacgaacccgaaattttcaccaataactgagaaaatcatatccgattcacgaactggcaccgcaacgtgcgaaacgttgaagccagttccggtgataccacctgatccaatagccttcattgcttgccataactgataaccactatttgacgtatcccctgaaggattcatccaagcgtccacacgggcaaattgataagcttcaaatccaaccttttccagaatgtggcgtccccatgtttgggtaacaaacaggatagttgttgttcccaaaactgcggcagctccaacaatcggccctaaaattgaccaactcaaaccagataccagcgtcattccgaaaacaattgccacgaacaccagtgttgttccaaagtcgtgttgtgctagaacaagtacgacaattggtgccgtccaagcgataatcttcaacaacaagaacttatcagaattccaagtgtgctctgggttttccaaattatgctgtgaaatcacacgagccaacataataatgaatgctggcttcataacttcggaaggttggaacgtcaatggtccaatagcaaaccatgactttccaccagtgttagcgtagtaggcacgtgagtaaaaaatcaaaacggcaaccatcaagaagacacctaacccaaaaatataaggggctactcgccaaagttgctctgaatcgaatctcataatcaccatgactgcaatgattcctacgatatagtaagcaccttgcataatcaccatgcgccaaacgttaacaccaacagtatcatgtactcccgcaacatataatgatgctaaaccaatcaacgcaagcatcatcacaacgaagatgattgaccaatcaatcacaccaccttcgctcgagaaaaagcgtttgatcatgttttaacctctttattgattagtgatgcaagttaaattctgcaatcaacaattccattgcgtcatcaaatgacttagccgtaaccgtacgattatcagcgaagcggaccgtcaaaggtgacgttgactcatcaatcgtacccaaacgaaccttgttcactttcacttctgaaaggttatctcccaaatcattaatttcaactgaaacaggcttattattacgtgacataattactttccttgtactccgtgcatgtgttctagcaacttaccagctccaacggcaacattgtccaatgggctttctgaaatcataacaggtacaccaaggtgtcctgaaatcaacttatccattccgcgtagcaacgcaccaccaccggtcaaaacaacaccgcggtcgataatgtcagcagccaattctggttggataactgacaaaacttggtgagcagcattcacaatttgtgccaatgtgtcgtgcattgctgcctcgacttcgttagcattcaatgtaatcgtgcgaggcattccagtgaagttatcacgtccacgcacttccatctcttctggatcatccaatggcgttgccgtaccgattttaatcttgatttgttcagctgtacgctcaccaatttgcaaaccgtgctcacgcttaacgtagccagcgatgtcagcgttcatcttatcaccggcaacacggattgattctgacgccacgatatcacccaatgacaaaacggcaatatctgacgttccaccacccatgtcgatgaccattgaggcaattggtgagaagatatccaatccagcaccgatagccgcaacctttggctcgtattcaagatacaccttaccaccaccagacttttcagcggcaccaataatggccttacgctcaatctccgtgatatttgttggtgcgcacaccatgatgtttggtcgtgacatcacacccttggcgttcaacttagccatgaagtatgacaacattgcttccgtcatatcaaagtctgagataaccccatccttcaatggacgaacagcgcgaatgttaccaggcgtacgaccaaccatttgataggcttcggtaccaactgccaaaaccttatccgtcttggtatcgattgcaacgactgatggctcgttcaatacgataccttttccttcaacataaatcagaacgttagccgttcccaaatcaatgccgatttccttggccatgattttcacctcttaattttttaccgagcaagctcgtttacattcttttacgtatctataatagtatacaacaaaaaccgacgtcatttgcccttagtttctacatcagggtaaaatagacagaaagacaataaaaggacgatattcaaaatgaaattaacccttaaagaaatggttacagccctaaccgccagtgtttcaaccgaggcggatgtcactgtaaccagcacgacatttgattctcgcaaagcaaccgctggcagcctattcatcccactagttgccgagaacgacggtcacgattatatcgctagtgccatcgcaaatggcgcaaccgctactttgtggcaggcagatcatggtaacgtgccaacagatattcccgctatcattgttccagatacgctagatgcctttcaaaagctagctgcttactatctaaagaagatcgccccaaagattgttgccatttcaggctcaaacggaaagacaacgacgaaagactttattgcggctatcggtgccagcactttcaagactgtcaagacacctgctaacttcaacaacgaaatcggtgtccctacaaccattctttcaatggctgaagacactgaattattagttgttgagttcggcatggatcgtcctggcgacttgacgctactatcagaattggtcaacccagatattgccgtgttgacaatgatcggtgaagcccacatcgaattcttcaaaactcgcgaccgaattgcagatggcaaaatggaaattatcagcggtttgaagcccaatgggttgtttgtctacaacggtgacgagccactacttcgtgaacgcgctgcacaacacgaaaacctccagacggcgactttcggactagcacctgagaatgatttattcgcttcaaccattgaaatgaacccggtcgaagcaactttccaaacgaatcaaacggatgaagccttccgcattccactaaccggccgttacaacgtttcaaatgccctagcagccatttcagttggtcgtgcattgggaattgcatatgacaaaatccgcgatgcgttggccaatgcgccaatcaccgaaaaccgtaccgaatggttagatggtcaatttggtggcaagattttgtctgatgtctataactcaaatccaactgctgctaaggaagtgttgcacttcttcgctgagacaccaacacaaggtcgtcgcattgctgtacttggtgatatgttggagcttggtgaagccggtccaactttgcacgctagcctagctgatagccttgaaccatcagctatccaacgcgtttacctcgttggtgatatcatggccagccttgaagaagcgctaactgctagctacccagcaggagctgtgattcgttacgctaaagataacttgccaacactgatcgatgatctaaagtctgagttaaccgccgatgacatcatcatgcttaagggttctcacggtatccaccttgagaacgtggtctcagctttgatttaaaactcaattgcataacacaaaaaggactatcgcgagatgtgcgatagtccttttctttttaactgaatacttactcaacttcgggttgtcgttgcatcatcactgggaacgagttcttcatcccccacaatgcaactgcaccaccgataattccaaagacaaccaatgcgattgtcgccgcccacacactcatatatggcgtgtgattaattaaagcatcgtaaccttgagctgcatacgtcgttggtagaaacctagcgatcgtcgctaacgttgcattcaagaattcactcggcacaatttgacctgacaaaacaatttgcgccatagccacaataactgaaattagcaaaccaaccgtgccaaacaaaacatccaacagtagcgttacgagcatgaatgccgtcgcaacgatgaacgtaaacaagaacgttgctaacaagttagcatcaatcttgaaaatcgcaataaccccggtcatcaagacagcttgcaatactggcaaaataaacaacgtacgcaaaccagcaatcgcggatacctcagcagtcatacgacgacggcgctcattcatctgaattagcaacgcgccaataaacaatgcaaaggccaacaacgctggaccgaaaactgccttgtaatcagcaaccgtcatttggcgatcaacttgctttgaggcaactgggcttacaaagtgattaattgtcttcgaaccaagatggattggttgtagctgcttcacaccagcttgtaacccatcattcaacgtcttagttcctgtcacagcagtcttaacaccatcatttaacttatcatccccagttgccaattgttgggcacctgaacttgccgtatgcaacgcatcaagtaacgttggcaccttgccagccaacgtgttcacaccggctgacaattgactagcaccacccgctaattgttgggcgccatttgaaagtgccggtgtatttgcctgcaattgatttaacccatcagacaattgaccaaccccagcaacaaggttcggcgtcttattagccaattgttcattaccagttgcgacttgactggcgccactagcaagttgggcaaccgcgacattagcttgtcccaatcctgtgtacaaagacggcatcttcgcggccaattgttgttgtccgccagacaaagtgaccaatcccgtttgcacttgcaacgcaccggcagacaattgttctgctgatgaggctagtttatcagcccccgcaacagctccgtcaagctgtgatgcaatttggttgacttgcgttgaaaacttatcaatcgcttgtaatgcaccagaagttgccaattgaccgtttgttcccatttgttgtaacgacggcaatagcgctgacaactgtggtagcaatggcactaatggtgttagtgcatccccaacttgttgcgcttgtgtctctgcatccgtcacggtgcctacttgttgcaacgctgtcatgtacttgcctttgaactctgcattatggctgtcattcaagaatgtttgaaattgcggatcatccaccagatccttaaaagccccagcaccagcaccaactgtggtcaaatccgttttcaggttagccatgttcgtcgcgaagtcgaccttaccggcatcgccaaggctaagccctttcgtttctttcgaaatttgacccaatccgtcgtttaattggttcaaaccggccgtcaacttttgcaagtcagccgcattagttgcttggccttgtttgattgttgttaaaccagctgacagttgcgttgacagttgctgtgcaccagccgctagttgttggttacctgaagcaacttttgtagccccagcagtgaggctttttgcaccatcacccaaagccacgacaccatcgctggcagccttagcccccgcaacaagcgccggtgtatttgaagctaattgattcaatcccatcgcaacttggcttgaaccgctcgccaattgttgcgtcgctgctggtaacgcgccaacgctatcacgcaattggttaccgccatcggccaagcgatcaataccagttgacgcttggtcaatcccgtcggccaacgtactagcaccagtggccaatcgatttgaaccaccttgcaattgcgaaaccccatccggcaatgcgtttgcgccagtttggatttctcccaaaccactggctagcgtgtgcaaattacgattgacttcaccagacccggaagctagttggcccatgccatcattcagttgctttgtcccagcagccgccttggcggtaccgtctgacaattgcttaatcgaccctaacaattctttgttgtaggtcttttggatttcggcagtcacttgcgacttcagctgttccgtaactgtatcggccaaaataccaccaatgtaatttgtgtgctttgacacttcatacttgatgtttgacgtctttggttgcgcactgagcgccgtcaacgtgttggccgtaaaatccttaggtaacgtcactgtcatcaatgtatcaccgtcagctagtgcacgtttagcttgtgggccagacataaattcccaagcaacactatcattatgacgtagcttatcaacaactttttggccaacggccaacttcgcaccattatgcttcaccggttgatccgcattaacaaccgccaccttcaaagaagacggcccaccagcttgtgttgcatccagcaactgaaacaaaccaaaagcaacaccggctggcacaacgactgccaacccagcaatcgtcatgtagcgtgtcttgctactcatcttatcgaataacattacagttattctcctcctaaactcgaaacacccaatggcccttatcatcgggcaaaattagttaacagtagttaataattgcatagtgttaacaaataagtaagggcgttaacaaatgaacactatagcatggtttgtttaactttggaatagtaagtaaaaaataagcgtccgaactttattgttcagacgcttattgttaataacaaattatattaaactgacttgatgtagttcacaccatcagcggctggggcctttgacttagcaaagaacacaaccaagattagtaccgtaaagacgtaaggtgcaacttgtaggtaaaccgatggtacttggttcaagactggcagttgtgccccaacgatggccattgattgtgagaaaccaaagaacaacgctgccgccatggcaccaactgggttccaacgaccaaaaatcatagcggccattgacatgaatccttgtccaacaattgttgaagctgagaagttaccggcgattgattgtgcgaacaacgcaccaccaattccaccaagcacaccagaaatcaaaacgcctgtgtaacgcaaggcgtaaacattcaatcccaacgtatcagcagcttgtgggttttcaccaacggaacgcaaacgcaatccgaaacgtgtcttaaacaaaacccatgatgcaacaaaggcaataatgattgcaacccaggccgttgaagacgtcttcgtaaagaagatcgttccaataactggaatctttgacaagactggcacgttccagtaaccaaagttttcagcaatcattgatgtttgacccttaccgtacatcaacttgatcaagtaaacacccaaagctggcgccatcaagttcataactgtacctgacacgatgtggtcggcacgcaacgtcaccgttgcaaccgcgtgcaacaatgagaaaatcaacccaataaccgctccagctagcaaaccaagccatggcgtcaaaccaccaaattgaccagcgaacgtcaagttaaagacaacaccggcgaaggctcccataatcatggttccttccaatccaacgttaacaacaccggcacgttctgagaacgtaccacccaatgcagtgaaaatcaaaggcgctgagtaaaccaacgtacttgaaatcaccaattgcaagatcgtttccaaactcatgattactctgcctcctctactttcttctcaggttccttaggacccttcatcttcttggctttttgctttgcatcgtcttcgtcaatcttaaccaagatcaaacgaatcaagtagttagcaccaataaagaagatgattgaggccgttacaacagaaaccaattcagttggcacacctgaggccaatggcattcccaaaccaccaactgacaaaattgagaacaacaaagcggcaaagaagattcctaggaatgatcctgatgccaacaaagcaacggccataccatcgtaaccaacttgtggggcagctgtttgagagaagatgtttaggtacgttcccaaaccttctgttgcaccagccaaaccagccaacaaacctgaaatcgtcatggccgtcacagccgtacgcttagctgacataccagcgtagcgcgctgcgtctgggttcaacccaacggcacgaatttcaaaaccaagcgtcgtgcgcttcatgatgaaccaaacggctaccaacgcaacaatggcgatgatgaagccgatgttcaaacgtgaaccacccgtcaagtttgacaagaagtcccaacgcaatgaatcgctggcgtgcaaggtgttcgtcatatcagttgtcgccatcaacttctttggcaatccttgcacaaaggcatttccaccatacaaagcgatgtagttcaacatgattgttgtgataacttctgacgcaccgaattgggcacgcaaccaaccaggcaaagcacccatcaaagcacccgcaagtgctccgatgataacagccaacggaattgacaaccaaggcgtcattgattggttaaccaagacgaaccatgttgaagcaatccacccaacccaaacttgaccagcaagtccgatgttgaagaatccagctgattgggcaaccaagaatccagcagccgtcaaaatcaacggcgtcattgaacgaagcacttcaccaatgttcaatgatgagcccaacgctgattgcaccaagctaatgtaaccagtaacagggttaaatcctgataccaacatgatgatcgcaccgaccatcaatccaaagaagacagccaagcctgctacgagacctgtgccgtatgaattaatcttattcaccagtctactcccccgctaattgcgcacgcgcttctgccaatgacataccggccatcaacaaaccaagctcgttctttgacgtctcgtttgcattaacgacaccagtaatctcaccgtgtgagataacagcaatacggtcagcgacgttcaaaatttcatccaattcgaaacttaccaacataacagccttacctgcatcacgttgattgatcaattgttggtgaatatattcaattgcaccaacgtccagtccacgcgttggttgcgcagcaatcacaaagtcggcatcacggtccaactcacgcgcgataatcgccttttgttggttaccaccagacaaagcacttgccggtaccaattcgttaactgtacgaacgtcgaacttctcaatcaattcacgggcgtgtgagttgatttgctcatagtccaatacgccagcctttgacattggggccttgtagtatgtttgcaaagcaatattctcagccaacgtcatatccaattccaacccaaagcggtgacgatcttcaggaatgtgaccaacacctgattcagtaatttgacgtggcttcttgttcgtgatgtccttgcccttcaacgtgaccttacctgatgcagttggcatcaaaccagtcaacgctgagatgaattctgattgaccattaccgtcaattccggcaatacccacgacttcaccagcacggaaatccaagctcaagttcttcacaacttcaacaccgcgagcgtccttaaccgtcaaatccgacacagacaaaactgtgtcagttgggtgagcaggctccttttcggtagagaatagtgaaactgaacgaccaaccatgatgtcagccaattcttgtgatgacacgcccgcaactgggaatgagtcaattgattgtccacgacggataaccgttacttgatcagcaaccgccttgatttcatcaagcttgtgcgtaatcaagatgactgacttaccttcagctgccaagcccttcaaaatcgtcatcaattcatcgatttcttgcggcgtcaaaacggcggttggctcatcgaaaatcaagatatcagcaccacggtacaacgtcttcaaaatttcaacacgttgttgcataccgactgagatgtccccagccaatgcatttggatcaacatccaaaccgtattgttctgacaacttcttaatatcagccgctgccgtcttcgtatccaacttcacaccattaacgggttctgaacccaagatgatgttttctgtaactgtaaacgcatcaatcaacataaagtgttggtgcaccattccgatacccaactctgcagcctttgatgggctatcaacaattaccttttcaccgttgatcaagatgtcaccagccgttggttgcaacaagccagacaattgattcatcaacgttgactttccggcaccgttttctcccaacaacgcgtgaatttgcccgcgcttgacttgcaaattaatgtggtcgttcgcacggaactcaccaaattgcttcacaatatcgcgcatttcaagcacaattggctcttctgccatagtcatttctccctagaagctttcttcattcacaaaggtttcttatttgtgaaacaatatgtttattttacctattttttactaaattatccactatttgagaggctattattcgtctattaacatgcctgtaatactatttcgagataagttcatggttgtaaaaagaaaaacaggaactttctttcgaaagcccctgttttaattcgtcttttaaacgttttacttcatagtgcttggtacagtaacttcgcctgacttgatagcttcttcagccttctcgacagctgccttttcttcggcatccaagttcttcttagtgatagcaacaccgccatccttcaaaccgtaaaccaccgtcttgccgcctgggaattcacccttcattgattggttagcaaccttaacgattgagctagcaatttccttgatagctgacgtcaacgtgaagttgtccgacttgccatccttagtcttgtagttaccttggtcgttttggtccatgtcaacgccgataacccaagccttgtcctttgatccaaagtctaggtccgtgttgatgtccttagcagctgtaaacacagcgtttccggcaggtccagcagcttggaagataacgtgcgcacctgatgtgtagatagcgctagcaatcgtcttagcctttgccgtatccgtaaatgactcaacgaattgtgcatcaaccgtcatgttagggtcaactgacttaacaccagcgatgtatccagcctcgaatgattggataacaactgagttcataccaccgatgaagccaacctttgagtcacccaattccttagccttcgtcgctgcggcaacaccagccaagtatgatgcttcttgttgcttgtaagtcaatgaggcaacgttcttgtattgcttcttagcaacatcgtcaatcaaaacgtaatccgtctttgggttttgcttggcagatgcaaccaacgcgtcgttcgttgcgtaaccaacaccgatcaacatgttgtaaccagcagatacaccttgttggaagttcgttgcgaagtcagcgttcgtctttgatgcaaagtagtcgtaaccattcttacccttttgaaggtcgtgtgactttccccactcgcttacaccgttccaagcagactcgttaaatgacttgtcatcaacaccaccaacgtcagtcaccattgcgactgaaaagttcttctttgaatctgagttgttgttgttcattgcggcgataccaacaccagctgcaacgacaaccacaacaccaccgataatcaagttacgacgtgaaaccatgtctcatttcctccaaaagtacgatttgtactgttcctagtaattcccatgtctagttaacaaatgtttttcttgttaacctgacttgccttgattagtatataaggttcgcttaataaaaacaatgaagaaagtgtgaatttcgttcgtttaactcgttttttgttaaacgttttactggttttaagacattttataacgtaaaacacgaacgaaaataacgattttagtcacattgtttttggcaaaaacgttttacttggttttgataacctggttaaactccttattttcgtcacgcttttttctttacaaaatagttacaaaacaaaagggccgagttaactcggcccttcactatctactattagaaattttggtcaaactcagatccttcagggtggttaggcaccttgatatcaccagcgataatggccttctttgccttagcaacagcggccttctcgtcggctgacatgtacttagtaggcgccgcaacgccaccttccttcaaaccataagcaacaactgttccgcctgggaagttacccttcatcgccttgttagcaactagctcaagaccacgtccaacaccagtaattgatgacgttaacgtgaagttagactttttaccatctttgtccttgtaagcgcccatgtctgattggtccatatcaacaccgatgacccaaaccttatcctttgaatcagccgtcatcgtttggttattgtccttcgctgcagtgaaaacaccgttaccaacagttccagcggcttggaaaattaccttctcgcccttagccatcatcgccttggcaatcgtttgtcccttagcggcatccgtaaatgaatccgcatattgcacatcaacgttcatgttcggatcaactgacttcacaccagccgtataaccagcttcgaaggcatcgatgatgttaccgtgcataccaccaatgaaaccaacagatgagccaccaagatccttcgtcttagttgcggctgcgacaccggccaaatatgatgactgttctgaacggaacatcaatgagacaacgttcttcgtcttcttcgtatcaacatcgtcaaccaacacaaactcagtctttgggttcttcttggccgcattaatcgtcgcatcatgcaatgcgtacccaataccagctaccaaatcgtacttaccattaattgcttgctggaagtttggtgcaaaatcagcttgggtgtcggattggaaatagttgtagccattttgacccttctcaagaccgtgtgactttccccacttttgaacaccttcccaagcagattggttaaatgacttatcatcaacaccaccaacatcagtaaccatcgctactgtaaaattcttttttgcatcatcgctcttattaccaataaccgaaaatgctgcaattcctgcaactgcaacgacggcaatgccacccgcaatcatcaatcgacgtgagaccatgtttatattacccctcaaatttgaatcatcttgttttacgaccaaccgtcgtaaaaccacttgctatataatacgaacttcgcctagataaatcaaccactatttttcgtgtttagttcgcaataaaccatcgacttacgtattatcaattaaaaataagtctatttacgaacttaaatcgcgtttttaaaccgaacgtcagcaaaaagccgttttattcgattaacgaagttgttcaccttgcaaaatagcgaacataataaatgaccaagttttttcaaaaaaactcggccatttcattcaccattatttagaattgttgattgaatttcgaaccagcagggtggttaggcaccttgattttacctgacacgatatcatccttcgccttttcaaccgcggtcttctcatcgttggtcatattcttagttggtgttgccacaccgccttccttcaaaccataagcaactgttttaccacctgggaattcacccttcatcgccttattggccaccaactcaagtccacgtccaacgccagtaattgacgacgttaacgtgaagttagactttttaccgtcctttgatgtataagcgcccatatctgattgatccatgtcgacaccgattacccagaccttatcctttgaatcggcaactagttgttgattagtatccttagctgacgtgaagacaccgtttccaacggcaccagcagcttggaaaatcaccttctcacccttagcaatcatggcgttcgtaattgtctgccccttagatgcatcagtaaatgagtcagcgtattgcacatcaaccttaatgttcttatcgaccgattgcacaccggcaacataccccgcttcaaaggcatcaacaatgttaccgtgcattccaccaacaaaaccaacagtattcgaacctaaatccttcgccttcgtcgccgcagcaactcccgccaagtatgatgattgttctgatcggaacatcactgacgccacattcttcgtcttcttcgtgtcgatgtcatccaccaacacaaagtccgtctttggattcttctttgccgcattcacagtcgcgtcgtgaagcgagtaaccaatccccgccaccatgctgtacttagccgtcacagcttgttggaaattcgttgcataatctgcttgcgtctttgattggaaataattataaccattcacacccttagttaacttgtgtgatttcccccacttttcaagaccttcccaagctgattggttgaatgacttatcatctacgccaccaacatcggtaacgattgcgaccgtgtaattcttcttcgcattcccggcatcgtttcctgacatcgcatatgcagcgcccccaacgactgcaaccgccacaacaccaccaactaacaacaatcgacgtgataccatttcaacgtcctcccaaaataacattctgttgtatatatctctaaaaatgtaacatttcgttacgttccccgtatttactcagactataatacgcactccgctaacaaaaagcaagcgccacaattacgatttattcgtaataaatccaatcagcctggcacaagcacctggtattgctacgtttatcaaataattgcgaactttatttatgttttcactttaaataatacgcaataattcagaactaacattctgttatgagcgcacaaaaaaacagcctccgaagaagctgtttccagttatttattattgaaagccgttaagctcgtcatccccatccgtaactttcttcgttacttcttggccatgacggcgttggtattcagcgataacacccatttcacccaaacggttggcaactgagtatggcaagttaatctcagactcgaagtacgtgtccaagaatgccaattgatcaacagtcaaacctgatgaaacggcgtgtgataacgtcgtaataacttcggccgcagctggcgcgttcgttgcaatttgtgcaccgtacacaataccagtttcataatcataaattagggatgccaaaatatctgacttctcacccaaagcgtgaatcgttgctggtgtgtgaatatccaaacgttcaatcgtctcgccaattcgctccttggcggccgtaaccgtcaaaccagtcttatagaagaaacggtcaaacactgagaaaccaatagtacgcaagattggttggatttgaacatccacacctgccaatgcataaccagcaacacggcccatcttaagggctgcagacatcaatgggaagtattgatcgaacttcccatcaacaacggctgaatcaccgactgcataaaagtcaggatttgatgattgcatttggccattaacgacaatagccccattgtcacgcatatcaacttggccagccaacaacatcgtgtttggttgcaaaccagaagcaatagccataaagtcaaagacttctgaagtaccgttattgaagttaacttcaatcttcttaccttgattttcaactgaaacaacttcttggtgcttacgcaaaaccaccttgttgtcagtcaatgtcttttcaaggtcttcttgcacagtttggtcaaagtaacgtgtcatcaaacgctctgaacgcgtcacaaacgtcacgtgaacaccggcgtgaaccaacgcagcagccaattcagttgaaactggtccaccaccgtaaaccaatgccttcttacggaagcccttggcaaacttgttgatatcttgtgcgtcttgttcatccttaacaaacacaacacgatccaaatcagccccgacaaatgaaggcacacgcgctgatgaacccaatgcgtaaaccaacttgtcaaaactttcttcaatcatcgaaccatcttcaatgcgacgagcgtacacacgcttcttcgttgcatcaatacgttcaaccaagacaccggcacggtacgtcgtgtttggttgaccttcgaagtgctcgaagttaacttgctctgcgctacttaccttaccattcaatgctagcttgataccagctgaaataaatggacgatcacgcaaattcttctctagaatgacaatttcatcatccttattaacatgacggaatgcgttcaccgcagatagacctgcgtgcgcaccaccaataaccacaattttcatattaactaccctattagtatctatattttaaaccactattaacgcgtttaggcacgtagcttttcagggaaagatgccccaaaaacacggtaccattcagatgcaaacaatgattggcgacgagtgcgcttcaacatcatttctgtattcaaacgtcgttcaatctcaacccacgtgatttctggttcagtcataaccatttcacgggcatccgccaacaagtttttatcaacaaacttcgcatccaaagccacatcatccaaaaatggtgctgatagcaatgatctaatttccatatccatacgcttaatttgcgcgtccatcggttgcaaacgcttctgcacccatctacgcttcgagaacaagtctcgattcaagactgaatagtaaatcaataagtacaaagttataaaaaaagctaatgccgtagcaccaacgtaaatgataatcttatcaatcggcaagattggtaatccaaagaatgcaagaactgccgccaaagcagttagtacaaacgaaaggataaacgtcatcgtatttttgagctgtcctaatcggacacgtcgctcagcacgaagtcgacgtcgacgggatgataaacgggttaacgtgtcgtttaattgtcgcaaatgttccaataaaacgagcttgtcgtccttatccatatgactcaatatcctattctctaaaaaattaaccttacgaggactagtatatcccgattaaaattaaaaaaccacgaaaaagcccgctttcgcttacaaaaaatacgcttcactataatacgacaaagtacgttaaaataatagtatggagttatcaaaagaaatccttgtccaagaacaagaagcattaaagattgccaagcttctggcgaacgatttgcgtttgcaaattctttgcctactgcaagaaaatggcgcagctactgttaccgagatcatgaacgcgttgcatgcagaacaatctcgcgtttctcaccaactatctgagttacgtgaataccagatgatttctgccactcgctcaggtcgccaaattacatacgcccttaccgatccacacatgatggaattgcttaacgacttgcttgaacacgcaaaccacgtgcgcttgcatcgcgagcacggcggcatctaaaaaaacgtgacgaatccgttacgtttttttagtttaattgcgtataatgaaatcaatatacttctaaggagttctcatgaaagaatttaaaagctttattctccgtgaagacgtgcaaaagttcatcgctcttggcgtcattgttctaatcatcgccttgctacatgacttgattagcgtcctgttgctaacggctatcattggttacttggccgttaaagctgctaatcgtgtttcacgtttgacgaaaattccctatggcttttccgtcttaatcgtctacttattagcgattttcgtatttgtgttcgccatgatttacatcgtgccaactttgattaatcaattcgcggtcattcccgacgaaattatgaagctcatcaaaaagtatcctgttattaaggaatacttcgatgatacgtataagaagctcaacctgcttagtgaaattactgacaactggaagtcactcttggctagtggtatcaatacgatttcaacagtgggtactgtcctatctcgtatcgttttgtcaatcttcatgagtttcgtacttgcgattacttggcaacgccttcgcattttcgggacccaattcttgcactccgattatcctaagttcttcaagcgcatttacgaacttggtcgtacattcattttgattttgggtagtgtcattgaagtgcaattgattatcgcctttatcaacaccattttgatgatgattggtttgagcattcttggtgtaccgagtgtcatggtaatgggattgatgattttcatccttggtttgattccgattgccggtgtcatcatttcattgttcccattgagcgtgatgtcatttgccgcccttggttgggttggtatggttgaggtttggattatgattgcgttgattcacatgttcgaatcatacttccttcacccacgtttgatggccagccgtactgagctacctgtcttcctaacgtttgcaacaattatcgtgatggaacacttgctcggtgcctggggattgattattggtgtgccgattgtcgccttcatccttgctattcttggcgtacaagatgcaagcatcagcaagcacgtcaaagataataaggtcgtcgctgaaaaagattaagacacgcaaaaacgctagtgaactgattagttcactagcgtttttctgtatctgtttaaattccaaatgtgccaccatgcacttcagtgacattcgtcgtgacaataaaggcatcctgatcgatatcgtgaatcaagcgcaacatgtgtccatagttggcgttgtccaccatgaccattagcatttccttgttattgtcagtgaagccacctctcacatcaaagacggtcaggctatgatcttcgctgagcaacatttcttgtatgtcagctagcttgtcgttactcatgattgtgacttgatgcttcaaatctagtcccgtttcaatgtagcgcatcaccattgatgtaatcaccaacgagaacgcggctaagaagaaagcattcgtaccagaaacaaacaagttaaacactgtgaccaccatatcgatggctaacaaagaaatggccgtattaattttaaaatactttttcaagatcattggcggtacagttgtcccaccacttgatgcttcaaagcgatataaaatggcaattcccgaagcaaacactgccccaccaataatcacggcaaggacggcatcctcaacaactttatgacttggtgtaatgtacattaataccggtaataaaaaactaccaaaggcaatattgcgcaccgttgaacggtccaagaatatcgctgccagaataatcatggcgatattaataattagcaccgtcaaagcacggttaatgccaaacgctgcatccagcaaaatagcgacaccggttgcgccaccagcggcaacgttaatcggtgcatagaaaaagttaatcgaaagcgcgataatttccagcgctactacaagagatagcgctcgaaaccagccctgttgactcaatcgtttgttcatatgggtctccttatgggttggaaaggtatttaagttatatatctagcataacattttcgcgctattgatgtgtgccattttttaaacactacttggtttcttcaaaccattcgtcaattaaacgctcacgcaacgggataaaaagttcgccagctttttgtccagcggcctgtccatcaatcgaaacaacgcgaccagcaaataacaatgaactcgtgatgaacacctcatctgcggtcaaaagttcctctttggtaaaggcacgctcttcaactggcatccccaaatcacgggctgcttggagcaagtgaacgcgagcaatcccaggtaaaatcaacttgtcggtcggcgccgttaccaacttaccatccttaatcatgtgcacattggtatgcgatccctcggtaacccgcgttgagccatctgcgcagatacgatagtagactgtttcatccacccccgcttcagctgctcgttgtgccgataggacattgggtaacaagttcagcgttttcacgtgtgccatgtatgagcgaatgtcttcttcggtttgaatacggaagtcgcgagtttgtgcctcacgagtcaccgtcatcggcgtaattgtcacgaataaattaggtttcgcatctttcggaaatgaatgatgacgctcaccactaccacgggtcacttgccagtaaaccgtgtaggtctcgttcgacactttgctagataaacgattgagcaaagtcgccaattcatctttggtgaaatctggcgtaatcataactgcatccatactgcgccaaaaacgatccagatgttcatctaacgcaaacagcttatgatgacgtacgactgttgcatcatacaccccatccccaaagtaatacccgcggtcggttgctggaatcatcatatcttccagtagcgactccttgccgttgtaataggcaatattattcattttcaacacccccgcaatactttctaatcatttactcataatagcactattttaaggcaaaaaaacacccgaactgaaaaagtttcgggtgttaattcgcttcattatttcttttgtaacttaacggctgttccatactccgcaaccatattcatgtcagcgcccattgagccagaatcaaaacgcatcatcacgaccgcgtcggcgcccatcttagcggcattctcacgcaaacgctccaacgaagaatttcgcgtatcttccaacaacgatgtgtatgccttgatttcgccaccaacaatcgtcttcaggccagccccaatatcagccacgacattctttgatcgcgtcgtcaatccaaacacttcgcctagcgtttccacgacttcataaccggcaacgttttctgtcgttgccacaattatatcttttgcatttgccattagataccccctgacatacttactttcaatatactcggaaccattccaaatgcaaataaaagacactatcaacatcactgtcgatagtgtctttcaaatggttgattagtcttctgacttcaaaaccttctttgatacaactgacaagtcatctgccaagtcgtataccaaaggctcaccgttagcaatctcaacacccaagatgtcatcatctgagatgttttcgatgtgcttaaccaatgcgcgcaatgagttaccgtgggctgcgataacaacgttcttaccagccttcaagtcttgtgaaatgttagactcccagaatggcaatacgcgttccaacgtaaccttcaagttttcaccgaatggcaactcaccttcaggaacatcagcgtaacgacggtcaaaggctgggtaagtcttacccaaaacttcaacagtctcttcttgcgtctctagcaatggaggcaaaacgtcgtatgaacgacgccattgcaaaacttggtctgctccccacttttcagcggcgtcagccttgttcaaaccttgcaaagcaccgtagtgacgctcgttcaagcgccatgacttcatttcagggatccacaattgaccagcttcttccaaagcgtagtgcaacgtcgtgatcgcacgcgtcaaaactgacgtgtaagcttggtcgaattggatgccttccttggccaacaattcacctgcagtacgagcttgggcaatacccttgtcgctcaacttcgtgtctacccaaccattgaacaagttcaatgcgttccattcactttgaccgtgacggatcaaaaccaactttgccattggtgatacctcttttgtattagaatatttcgttactattgtaacaaaatttcacaataaatagtagtgattaattgttccccaaagtttcaccggtatcatttcgcctaagatgacaacagaggtaccgcaacgaaatgcgatacctctgtcaaaatgtgttatttaagttaaatccagcatatcggaacgactaactgattacaagcaattatcgcttaatctcaccattctcgataaccaaaccagatgagtgaactggtccttggcgatctgggtagatgcgcttgatgatactgttaacggcagttggcacttcaccaaaaccagtggcaatcaattcagccttacctgggtactcagccacgtcaccaaccgcgaagacaccgggaacagttgtctccatctcttggctaaccgtgaacttctgacgctcaacggctggttgaatcgtccaaccggcaacaatcttattttctgacgtgaagccgtagttaaccatcaaatcatcaacgttcaacaccttcttttcatcttcacggaccttagccaaagtcacgttcaatgaaccgtcttcagccttttcgactgactcgatgttgtaaggcgtctcgatttgaacggctgacttttgcaattctgaaacagcgtgttccatggcacggaacttgtcacggcggtgcgtcaagtgcacttcagctgccacagtgtccaacaacgttgacatatcaacagctgaatcaccaccaccagcaaccaaaacacggtggtcccggaagtcttcaacgtcgttcaagaagtagtgaatcccttgaccctctaggccgttttcaacgtcttcaggcaaacgacgtggctcaaaagcacccttacctgttgccacgataactgacttagagtggaatgaccccttatcagtcgtgatatcaaactcagtgccgtttgggacaacatcaataactgtcgtatcaagatacaaatcttgttggaattgacgcatttgatcatcaagttccttcacaatcttggctcccgttgtgttcacataaccagcaatatccaaaattgtcttttgtgggtaaaggttagcgacttggccaccaacactttccaaactttcgataatcgttacgtctagttcacgcaaacctgcgtaaaatgcagcgaacataccaactggccctgcaccaataattgttaaatctgtatccttaaattcagtcatgattgtttacttcccgtttctatcggattttatttttctcttatttactttttgtattatacgctacaaaaaaatccgctgcataggataaaggaccatacagcgggttattcttacaaattacggtcgtacaacgttgtgaattctgacaaatcaacgccgaagtcgtttgctgaaacaatatcaacagcgtttccttcttcgccagccttctcttcgaaaatctttgcgatgtcagcgtacaaagcttggtaagcttccttgtcaggtccatcaacaaccaacaagtagttctccgtaccagttgcttcgttcgtcaaccacaacaagtgcatacgctcaatcttccccatggcgtcatcagccaatccaatcaagtcgtagcgcaatggcgttggaataacatcttcagcagaagaaatttgcatctcgccttcaccttgttgtgctgccaataaacctgcaatgtaagccaagttttcacgtgaaattggcataccattcgtaaatgggttcaatgccaatccttcaagattttcagagtcttcgttttgcaaaactggcaagtagtcagtcaatgccatcgcccatgggtgaacaggctcttctgaatcaattggttgggcgttgaaagcatccaaatccgtaaagattgggaatactgagtggccgttttccatctcaaaagtcaacaaacgcatttctgcgccttcagggatttcaacatctccatcttccttaatgattggtggctcactaaagttaactggtgcaataaagactgcttcaatcaacgcttgaataaacgcttgctccgttgtgccattttgatcttcgcgaaatgctgccaacgcatctagcaacgcgtcgttacgcaaaacatcttcttggttatccattatatttccccattcttaattccttgtgttctatctagtataacgaaaaaaagagcacctgcccagatgacagatgctcaatgtattagattactttgtgtagattggtgcgaatgcagcggcacgtgggtaaccaatttcttgaacacccaatacgttcgtaaatgctggggcaccagccatttgagcaaaggcaaagaattgtgccttcgcttcttcaagctcaccatccgtgtggataacgtaaatcaaagcgcgctctggtgcacgaaccaagtcgattgcccaaaccgtttgcaagtcaggcaaaacttcacccataccctcagccaacttggctgcgaactctgtttgatcatcaactggatcttccaacgtaattgggtcttgctcacgcatttgcgtcaacgttgccatcacgtagttcatgttgtcttggttcatgacaacgttttgaccgtaggcattgataaccaaaccagtatcagggttagctgacatcaaagcagcgtaagtttccaatgaaacagtcaacgcaacaacgccttcagcttcagttgaccacttgttgtactcttccgtactcgtgaaagctgggaagaatacttcaccctttgagttttggatgacttggtagttcaattgtgcggcaacttctgagtcgattacgaaagtaccatcaccgttgtcagtcaattcagcatcaacttgtactggtgctagcaatgatgcggcacccaacattgcgatgaaatcatgctcagtttcagggttaacatctttctcgtaagcatctagcgttgcttcaagatcttcattttctagtggacggttgaaaatcacatctgccatggtcaaattcctcattcgtttattttttgttagtataccccaactaaaacgaatcgtgttgtaaaaaggtcctgaccgaaacaacctaatctaatgtttcaggtacgacgacttgcttgtccaaaatggccgtcttcgcgtcctgcacagccatccaggcttctgtactcatacgaccacgtgtcaccgacacaccatcattagcaagaccatacaccaggtgctcaccaccagggaatttgtccttcatcgccaagttagcaatatcatatacaacctgatccattcgctttaacactgatgtcaaagtgaaatttgatgatgcatctaaagcctgataacgaccgctttgtgattgattagtatcaacaccaatcacccaaactttatccgcactacggcgtttttcattgattgagcgtgctgcttcgaaaacaccttgaccggcaccaccagccgtttgatagacgacgtcagcccctgcttgatacatattgttcgctaatgttttggcggttgcgtcgtttttaaagtcgccaacatagtcatgcaaaatttgaatatcggggttaattgactttgcccctgcaatgtagccagcttcaaacgcttccatgacaactgacttttcaccgctaacaagaccaatcgtgttagtcttcgtcgtcttagctgctgcaacgcccgctaagtaagatgattgattggcttgaaaggtaaccgaggcaacatttggtcgcgtctgagcaacatctccaaccatcacaaaatcacgatcagggtatttttggactgcttcgtccacagcatttatcttgcgatagccaaccgcaaaaatcgtcttaaagccatcattcaccgcatctgaaattgctgagcgcgcttccgtcgcggttaccgcgtgaaaggactgatacccatcgattccttcagccaagccagtttctagcgcgtactttttaacacctcgccaagcgagctcttggtaagattggtcatcaactccggccccatccgtgatcattgccacggttgcctgaattggttctgtttgcgcctccgttgggcgactcgtcatcatcattccggcaaccactgcaattagcgtcgttgccgcaacaccaataatcaaatttcttttcatctctttccctcaacatgaaaccaaattaaaagacgttgtgcgtaaaatgcacaacgtctcatttaaccaaattactttgaaggaactgtgatttccttattaacaatcttcttttgagctgcttggacagcttgccaagcttcatcagacatgtttccgcgtgttacagcaacacccttgtcatccaaaccgtaaaccaattgcttaccaccagggaacttatccttggctgccatttcagtcacgtcaacaacggccttaccaaccttcttaactgatgatgtcaacgtaaagtttgacttaccatccttagccgtgtaggcaccgtcatcgttttggtcacggtcaacaccgattacccaaaccttgtcagcagcgttcttttcgctgttcaagtccttggcttcagtgaagacaccagcaccggcaccaccggcagctgagaagataacatcagtaccgttttggtacattgaagcggcaattgtcttacccttaccggcatcagtaaagctaccaacgtattgtacatcaacttgaatgtcagggttaactgactttgcaccagcaacgaaaccagcttcgaacgtcttcacaaccgctgactccataccaccaacgaaaccaagcttgtttgtcttagtcgtcttagcggcagcaacaccagccaagtatgatgattgttctgacttaaacgttactgagacaacgttgtcacgcttctttgcgatgtcatcgacaatcataaagttagtgtctgggtgcttctttgcctcttcgttaaccgttgaagtcaattggaacccaataccataaatgttcttgaaaccggctgacacagcttgatcataattcgtcttaaaatcagcgtgtgactttgattgatagtaagtgtaaccattcttaccttgcttaacgccgttttccttaccccatttctccaagccttcccaggcagattgttggaatgacttatcgtcaactccaccaccgtcagtcaccaatgcgactgatgtcttacctgcttcacctgaagctgacttgtttccagatagtgcggcgtatgcgccaccagcgattactactactgcagcaccagcaatccacatctttacgtttgaagccatgttgttttttcccctttatgaaaaacccatttattttttcgatgaccaattcatctatgccataaatataacgaacaaattcataaaagtaaacgattatattcgcttattcacaatttattcacagttaatcgttttaaaaagttctgaaatacaaggtaaaacgtttataacgcgaacgttacttgttttgtcgcacaaaaaaagcgacgatttccgtcgctcaatcagttttttattaatttaccagtcgaaccatgtacgtttctggcacaaaaccacggacagcattgtacaaacgtttagctcgtgacgccttatcagtaattgcaaagaccgtcggacccgtaccagacatctgcaccgcatccgccccgaacttacgcatcttctcttttagctttacgatttctggatactttgacgctgtaactggttcaagcacattaaacatccccttgaacgcagcatcaaagtcaccgcgttcaacggcgtccatcaacgctgacatgtcaccgtgctccaagttgtcataatcaatcatcttcaaaattttaggcgtcgaaacactaatcgccggctttgatacaaccagccatagcggtggaaacttttgcgtaagtggtgccacaatttcaccgcgccccgtcacccgtgctggtcgtgagtaaacacagaacggcacatcggcatcaatcttcaatccaatttcagcaagttgcgcttccgttaacgtcatatgccaaattttatttaaaccgcgcaatacggccgctgcatccgatgatccaccgccaagtccagctgccactggaatatgcttgtcgatatgaatttccaccccttcagatacacccgcccgttcgcgcattaattcagccgcctgataggctaaattcttttcattcaatggcaacaagccactagtcgattcaacgataatctcttgatgatctgtcgttgttcgaattgtgactgtgtcagccaaatcaatcgcaaccatcaacatgtcccattcttgttcgccatcagcatgcgcaaatggcgtatcaagactaatattaagcttcgcatatgcgcgttctaaaatttccatgttaacggtcatcctttcgcagagtttctttcattatagcaatttgcaaccgtttacgaaacaatcgaccttgcttgaaaaaagccccatttatcggacatctcctgtatacttaaagaactatacaacgaaaggttgctcatatgcgctatctctacattttgctcgggttgatcacgttcggtattggaaccgtaacgatttgggtgcccggcattccaacgacgcccttttacttgctaactgcatttttctggggtcgttcatcagagcgacttcacgcctggttaacccaaaacaaacactatcaaaaatatgtgcacgaaggcatctaccaccgcggtttgactcaacgtgcacgcatcgtcatctatcttgtgaccgcagctatgatgagtattccattcttcacttctggcaagacatggctacaattcactttgattggcgcatcactcagccaaattatttcgatggaaggtttctaccgtggctggtggatgaacaactggttcctacctaaggatgacgctgaataaaataaaacctcgacttttcagtcgaggttttttcttacatatcaaagcgacccttaagtgatgcaatcacgtccggtgtcaatcgaacactgttggcttgaatgaattgttgcacatctgccaacgtctcaaacttttgcttaacaggttgtaccaaattagcttgcaacaacgcttcggcaaattgcacatcagccatgttaatcgttgtcatcccccaaggttgtgacaacaacaattcttcccacgcgcccttaatcagtgcctcggcacgctcgtaacgacggtccttgttaataaacgaccgcaaatcaactggattcaaatcattctctgccatcatgccactcctctaaccaactggcagcatcatcgcctaaccattgttggtttgtttcaataaattgttcaaagtcatctgcgacatcagcttgttcaactaagtccgcttcgtataatgcaatcgcaaattgcgcatcggttgctgcaatcgtcgtcggtgaaattggatgactcaccacgaagcgattccactcattccacaacaaagcaactgcccgttcgtattgtggtgcccgtaaaatcacggcacgtaacatcaatggatcaagcgccattaatttccctcccattttgttaatgtcacaacttggcctaccggttgcaaaactgaaagtgtcgcgtcagttggcaaaacccacactaatcgacgataacgattagctggcaattcttgttcaccgtcaccatcggtaaagataaccacgacagtactctgcggttggtagcgctctgactgcaacgtttcaaaaatcgtcgcaaagcgcgtgccaccaccagcacgacggcgaccatcggcaatccaattcttatcgattgcatgcacctcggtgtcaaaggcaaagaaatccaccgcagccgcaagttgcttttgcatctgggccacttcagcgataaagcgactcgccgtgtcatctgaaatcgaagccgaattatcgataaagaccgctatcttagtttgcgtggcatcaacttgcccaggtaattccatgcggtacggttgacgtcgattgaaacgggcacgactatcttgcttgccggctggtacattactcatcgccttacgcaacaggccacgccagttacgtcgtggcgccaatagttgttcaatctgacgttcaacctcaccggccatgttaccgcgacctgcaacaagcgcatcatggttggcatcggcaacgacgtttcgcaatgccgcctctgcctcttcgccagcttcagcacctgtcgaccagcctttgtgatcatcctccggcaactgtgaactagccccttcgttatcaatcgtatccatcaatggatgcaatagattgtaataggtgcttgaatcggcatacgtcggtaaatctaattcaatcatttcctcaacttcagctagcgtatgcgcgcccggaaatccaccacgaatatactggttcactgacaaatccgttgctagtccaaccatcttagcctcggctgcgttttcagcaattttatctgcataccgaatcggatgctcccacaccatgtgtagcacttgatgggttagcgcacctttgatatctgccactgagtgataaacctcttcaaataaaatcggattaatccgcaactcccagaatggcgcttgccaagaaagtcccatcgtgccgccgacagtatcatcatacacacgatttaatcttagaacgacctcgccataaaaacgactttcgtccaacaatttcatcgtggctttttgaattaattcatcaatcttctgataggtcatatgcggccacctttgtgatgacatcgtaaagttccttcgcgtggtcaccagtcgaactatagagttgctccaacaagttacccgctgctaattgcttaacgactgcgtattgtccgtccttagccgttgctgtcaaaatttgcgtaaagcggccagcgttatcatcttgggcaatatcaatggcggctaacgttgacttcaacaaagccaacttttgtacctctggcaaactgacaaatttcgtcatcacttgttctggcacttctggtccccatggttggctgacaaagatatccattggcgtcaatgtttcttggtttgtttgcatgaattgcacgaaacgttgggcagcagcttcacccaggtcaccagccacaatgtcaaaaatcaatgcttgttgggtcgcttcaggcaacgtcaacaattcatataaattatctgacacacgttgccaagcacgtggcgtaggattcaagtcatccccacgttcagctgggtaaagttgcgtcgcatcttcttgtaggtaacgttgaatcatctcatgaatgttcgggcgttgcttcgtcttatcttcagtcgctgcccaagcaagccagtcaacaacatcaaccttcatcaccaaacgaacggtacgatccttaatggctgcgtcaccggcgacaacaccgtaatctgcgttttcaaatccagccattgtttcatcgggattttcagcaatcaccaacttgacttctgatggcaaaatcaatgagttaatttgacgctgcaagaccaaattcatcaactcgctttgaacggcctgcgaaccacggttaaactcatccaagaaccaaataattggcttacctggatgggcttgcgcagtttcgataatctcaatcaacgtgtgcgtgtaaccgtacttcacgtcagctaatgaaccgtactgcgccgtttcgacgtaggcatcactcgtcaacggtggcactggaatagctaggtcacccttttctgacaaagaaacaaccgtcgtaaagagcgttgcgcccatttgacgggcaatttcagcaaccaacgctgacttaccaataccagcttcaccgacgatattaggcacattaccacctcgcaacacgagtggaactgccgttactaattcctgaaatgaaagcgccatgtcgtttctcctcaatctactgttaattacttatagtttacgctgttttaaatcctttttggtcgtaaaagtggtttgtgtcctccacaacgcatagacacaaacaaaataagaaaagccaccagatgctttaagttcatctggtggctaccatggtgtttcagttgtctttctgtacgcgacaatcgcttggcaaagtatcatgacatgagttaacaggttcgtccatctgtacacttcgttttccaagggaaggtctcatgtcgttgattcaataccaggttaagactagctcattgtttgcgcgtttgatatgagcgtcatcgtgacgattggcaatcgaagcatcaattcatttatgaattatacggaacacttttgcattcgcctaataaaaagggaactttacttcaaatacgctgtcgcaacatccttaaacaggtcaatcatcttgaagtaagccgcttcttcaacatactcatcagccttgtgcgccgttgcattacctggtccgatgaccgccaattgcatgtttgggttagccttgataaattgtgaggcatccgttcccaacgaaaccgcaatcgctggcgctgccattggttcatccaaatactttggaatcgtttgttgaatcaattgaatcaattcactgtcctttggtgctaccactgcgccatcgtacgccttcacattcaagcgcaaatccatttgtggatctgtcgccatcacatcagccattaactgtttcaaacggccaatcaactcctcaggtggcagttccggaataatacgagttagcaccgttaacgttgcagagtcaggcactgagttttgttgttgtccaccttgaatcacatcgggcccgtatagcgtacggtccaacaccggactaacttctggcaagtccgcatagaattgcttttccgctagatagtaggtaatcaaatggtcaatcgcattgatacccaactttggcatcgaactatgagctgccttccccttcgccgtcacttcataagccaaaaagcccttgtgcgcatggaagatgaagtgttgttcaggcgctttgctgccacgcttcttttcattcaactcagtcaaagtcgctggatcgattaccgcaccaccactacggaaatagtcatcaatgtcatccaacgccacgccagttggttcagcaatcaccatcgcttcaacatcatctaagtagcctcgctcagttagcaacttcgcgccagcttctgtcttctcttcatcaaccgtggcgatgaagcgcactgttccatgcaacggtgcaccagattcttgcaactcaatcatcgcaattaagaattcagcgataccgcccttcatatccgtcgtaccacggccatacaagcgaccgtcctttgtaaccacttcaaacggatctgttgaccaggtatccaaatcaccttcgtgaaccgtatcaatgtgaccagcaaacgccagcactggtccttcaccatccccaatttcggccacaatattagcacgctgtgaatcatcagccactagctgactttcgatgccgtgacgcttaaagacttcctgcaaataaaccgctactgatgtttcattggctgctaccgtgttaatggcaaccaagtcttttagtattgttaatttttcttgttcccgcatagttttccccacctttaaaacttctcatgtaattttaatctatgtggcccaaatacgcaaaacagcgattaagtatcataagagatacttaatcgctgtgaacatttttactctattaacgttgttgtcgtgcctcaatctcagcaacgacttcttctggtttctttggatgaacgccaatattcattaagatggcaatcacagttccaatgaacgtatcaaacacacgttccaccgcgtacatatacgtcgcatctgctggaatcgtcaaagcaatcatcagtaaagccgctgttgatccaatgattcctttattattaccaatgccatcgttgatcgaaatcagtagcattaggaaggtcggcaagaccagaatttgaacaaggctcgcctcgttgaagtgttcgtaaatcaaaaagtacgcaatcgcaaagccgccacccaaagcgttggctaggacacgcgacttaccaaactcaaccgtcgtctcgaaatcctgtctgagcgaaaacacagctgaaagtgctgcaatcataggattaccacgatctatgaggacgaaaattgccacgataatcatgacagctaatcccgttttaaacgtgcgcatccccaatcgaaatgatcctaatttcatacagttgcttctccgttgttattcgtattgtgttgcatgacgataaccaataaagatcatcgttgcaacgccgacaaaggcaataaagacaacacctgctccgccatagaacaatgaaccataaccgctctgttcaatcacggcaccacctagcaaaggtccaattgcacgaccgacagacggtgccgcggccgttaatccttggtaacgtcccttcaactccattggcgttagctcattaaccagcgctggaatcattgggaaggctgttgcttcaccaattgttgtgacaaccattgccaacgcaaagccagtgaaagtcttggcgaatggcaatatcaagaacgccaagccaaacatcaacaagccagcgaaaatctgaatgaacattgatttgcgattagctgataagttcaaagcgttcatgccaagttgaataacagcaatcaaaataccgttaatcgtccaaagcatcgagtattgccacagaggcaacttcaacacactcgacatgtaaactgacaaattaccaagccattgtgaataggaaatccacaagaccattaagccaatgacaccagtgtaaaccaagcgccaattccactttggcaatttgaaactcgactttgttgtcttttgttccgtacgttccactttaattttgaaatgtgaacgcacaatgaacaaaaggacaatatacataatcaaagctaagataaacaaccacgtaatcccgtacgtatagataggtccaaccgcagccgttgcaaataccataccaaagtttcccataaagtacagcatattaaagacaaatcggccgtcatggctccggacataagttccgtacgaattaatcgcagctgtgttccaaccaccgaagaacccaaccacggctaaaataaccgcataagttggccaaccgtggaaaagaatgaacaacacttgcaacacaatcatggccactgttccgaattgaatcagcttatgtggtgagaagcgatcaaataagcgaccactgaccagcgatccaaccgcctgacctacggcattggccatcatgacccacccgataatgactagtgtttgataaagttcatcgtgcaaatacactgacgtcaacggccaaataaagccaaaggcaacactgttaatgaaactagccgtcagtaaccagcgaattgacatgccttgttcgtttgtttgcatcccttacctccattattttgaaaaaagagaacgaggctaccaaaatggtacccccgttaatgactgttgttattacccgaatccacctggttcctcagcatggaattcaatgtttgagaatttgttgtatgacttaacaaatagcaaacgggccgttccacgcgcaccagaacggttcttttccaagatgacttcgatttctccgacatcttgttgttcttcatcacgtggatcatttggattatctgaatcatcgttggccttctcataataatcatcacgatacaagaaagcaacgatgtcggcgtcctgctcgattgatccagattcacgaatgtctgatagcattggacgcttgtcttgacgttgttcaacactacgagaaagctgagaaagcgcaataatcggcacatccatttccatggccatcatcttgatggcacgagaaatagctgaaacttcttgctgacggccttcgcttcccgttccttcaatcagctgcaagtaatcaataataaccaatccaatttggccttcacgcttgtatagacgacgcaacttcgaacgaatttccgtcaccttaatacccgctgtatcatcgatataaatcttggtgttcgccaatgaccccatagcaacggccaaagcattccattcctcggaatccaattgaccagtacgcatgtgctgtgagttgatgttcccttcagccgccaacatacggttaaccaatgacgtatctggcatttccagtgagaaaataacaactggcaagttcgggtcagccacggcaaccttttgggcaatattcaaaacgaacgccgtcttaccaacggccggacgcgcagccacgataatcatttcaccaccgtggaatccagtcgttagattatccaacgctgggtaccctgaggccagcccagtaactgtctcagtcgttcgtgagttttgctcgatttgctcaaatgacttctccacaacgtccgcgatattcttaaagtcggcgctcttctcaccgccattaatcatatccagcttcgttgacagttccgccacggcatcatcgactgaatctgcgccttcgtaagtctgcgtcagactgttctgcaacgtatcaatcatgttgcgacgaatcgacttttcacgcacaatacgcgcatagtacaacgcattaccagcaactggcaccgttgacgccaattcagtcaggtaggccatgccacccacgttttcgacttgattatccttattcagttcgtcggtaatcgtcaaaatatcgatggcacgttgcgtttcatcaagcttcaaaattgccgcatagattaaacggtgtgccgttcgataaaagtcagatggttccaagattgtcatcaaatccgcaatcaaatcctgcgggtcagttgacaacaaaatagatcccaaaacggcttgttcagcggtcacatcttgtggcacgctaagtgcagtcgtttctgtttcatctgccatgggggcacctccttcatcttcttattcataaaatctattgtaacagaaaaagccagtgaaacatcactggctcgtcactttatttatccaccgatttttattgttcgtcagtgtggatacgaatctttgcctcaacatcgtggtgcaacttaaccgttacagtacggtagcccaacgcacggattggctccttcatgtccatcttacgcttatcaatcttcaagccgaattgcttttccaatgcttcaacaacttgctttgatgaaatagcaccgaacaagcgaccatcagttccggccttcgccttcaactcgacaaccgtcttatcgtcttccaactttgccttcaaagcttcagcttcagccttttcttcagcggcctcacgatcggctgccttcttttgaccacgcaatgcagaaacatttgcgttagttgcgggctcagccttcttgttcttaatcaagaagttgttagcgtagccatcaggaacttccttaacttcgcccttcttaccgcgccccttaacatcttccaagaaaataaccttcatgattatcgacctcacttattaatcttcattatcactatcatcatttgctcccgcaagaacagacaataattgttcatagacagcagtcgttgtcgtatctgaaacctgcgttgccgcattgctcaaatgaccgccaccgcccatcgcttccattactaattgtacattaaatgacccagttgagcgcgctgaaacggcaactgtattatcatcgcgtcgtgaaatcacaaatgaggcttcaatgccaatcatttgcaacaacgcatccgcagcctgagcggccacaactgaatcatattgcacatcatcttcaccaatgacaattgccgcattattatgaatttgcgcacgctcaatcaagtgggcacgctcacgatatgaatcaaccgtttccttcatgaagtcctgtagcatcttaccatcggcaccgactgaacgtaggtaactagccgcatcaaatgttcgcgtaccagaacgtaacgtaaatgacttcgtatcaacctggataccagccaacatggcagtcgcctcaatacgagacagtcccttcgtacgacgtggttgatactcaaacaactccgttaccaactctgatgtcgatgacgcatatgactcgatgtaaaccaattgtggttcatcagggaactcctcgccacggcggtggtgatcaataatcacaactcgttcagagagttggtgataaacttccgtcgattctgaaatcgatggcttagaatgatccaccataaccaataagctacgttcagtcgcttctgacaacacttgtgacggtgccatcattgcagattgatctgacggatcagccttgagttcttgcaacaacagcttaatgtctgagtgttcttgaccggtttcttcatagacaacccaagatggcttgcctagcatctgtgccaaacgacgtacaccaagcgctgcaccaaacgaatccatatcagaacgcttgtgtcccataatgaaaatttggtccgcttgtgtcatcaagtcggccaacgcttgcgaaatcacgcgcgcacgaacacgcgtacgcttagccattggatttgtatttccaccgtagaaacgggcatctccagttggtgacttcacaacaacctggtcaccaccacgtcccaaagccaaatccaagttagcttgggcattctgtgccaaaacatcaatcgccgtttccttataagcaattccaatactcaaggtaatgggcgtattttgcattgacgtagcttcgcggacagccgtcaaaacgttaaacttatccgcctcggcacgacgcaagccctcacgataaccaattaacatgtaccggtcgactgctaaacgacgcacgtaaatcttgtgctcagccatccaatcagacaatgtcttcgtcacgaaggtacgtaatgcagaagcatccgagtcgttcatgccttcagacacttcgtcatagttatccaaggaaacaattccaatgaacaacttgtgcgcctcgtagtcactcatgacttgtgctgaatcagtcgcatccaacaaataagcagcccggagttccggttgcacttgcacattaaatacacgatccaaccaatgcaattgggtcacacgcttatcttcatccggccatcgtttaatcaagtccgccaattgcacagaagcttcttgcattggtcgaccaacaatgacccgttccccaaggaaactttgtagataaggatttacccagttaatttcattctgttcgttgaacaaaatgacccccaaaggcatctgaataatcgcttcttgttcaccacgattaacgcggtatgaaagattctcaatatagtgtgtggtgtcttcgccaataatctgcaaggtcttgaatatgaccatcaaagcaatcacaaccaaggccagccagacaattccggcaacccaattcaccataaaggctagaatcgcgccgataattgccatcaccgagacgagcactgccatccaagcgaggcgccgattttggaagaacgccggtaaagcatccaaatttttcacgcgtatcacccaacctattccttaatagtttctttataaagtagtataccatgattaccaaatagacttgaaccgataaataatggcttttttatgttgaaaatctattttgtggtttgtgtccgtccttttggtggtttgtgtcgtcgctatcgcgccgagttggtttttgggtgagtggggtggtgctccgtcctacaatataagctggtggcaacggagtcccattctccctaagcctcagcgtatttccgcgcctgccggcttgaaatccactgctgctaagtgataattggtgctcctgtccttgcttggtcaccggctaatatcgcaggagctccacaccaccccgctcacccaaaaaccaacagcagccaatcaatactctaattgttcgagtttcaaccaccacaacactgcaggttaaactgtccacccatttattttccggtcgatgtaaatccataacggactagaatatcttggctgctggcatggggctgggggatttcggagcgattttccgtgggacagagaagcccgacccgaccgctgcccgtctatgtgccaaagccccaagtttccagtttggcacatgcgaccggcaagggagccacgggcagtgctcgcggttgggcgtgtcccacggaaaatctttgtcggagaaattccccagccccatgcctcgacgcaacgcgtcgaccccaacctcaaaccaagcaaaaaacgcacccaacataataatgtcaggtgcgtttcttgttaatcgatcaaaccagcttcgcgagcgcgttgcttgtacatctcgatttcgtcttctgcagcccaaacgaaatgttcaggtgcaatttcaaccatctcacggtcacgtccgtccatttcgtcagttggatcgtaaacgattggctcacgggccgtctcaactgatggatctggaactggaatagcactcaacaatgagcgcgtgtaatcgtgcaaaggcttgttgtaaacttcgtcggctggtccaatttcgaccatctttccccagtgcataacaccgatacggtcagaaatgtacttaaccatcgacaagtcgtgggcaatgaacaagtacgtcaatcccttgtccttttgcaattgcttcatcaagttaacaacttgcgcttggattgaaacgtccaaggcagagattggctcgtcggcaatgatgaactttggttgcacagccaacgcacgggcgataccaatacgttgacgttgtccaccagagaactcgtgtgggtaacgatttgagtggtcacggttcaaaccaaccgtctccaacaaatcttccacacgctttgaacgatcttcgtcactcgctgccaagtggttaacgtcgataccttcagcaacgatgtccttaaccttcatacgcaagttcaatgaagcttgtgggtcttggaaaatcatttgtaccgcttgacggaagtctgacaattcgccacgcttcttcaacttagcgatgtccttaccatcaaacaaaacttcccctgctgatggttcgtacaacttcataatcgtacgaccgattgtcgtcttacctgaacctgactcaccaacaagaccaaacgtctcaccttcgtaaatgtcgaaagttgcgttttgaacagccttcgtttcgttgctacggcccttgttaaacgtgatatcaagtcccttgatttcaactaacttcttcttttcttcagccattagttgttatcctccgttccaagaactgccgttgcgtctacggcgactgccttcttacggtcagcttctgggtgctcagcttgatagcgagcccaacgcttttgtacttccaatggtggctcgacttcaggcgcacgttcatccaacaaccacgttgacgcaaagtgcgtctctgatagcttgaagaaaggtggcttttgcttttcatcgattgccaaagcgtacttgttacgtgccgcaaatggatcaccaactggtggctccaacaaatcaggcggcgtacctgggatagcttccaactcaccacgcgccgtttccgtcgttggcattgagttcaacaagccccaagtatatgggtgttgtgggaagttaaacacttcatcaacagttccaatttcaataatttgtccggcgtacataaccgccacacgatcagccataccagccacaacaccaaggtcgtgggtgataaagatgattgatgaatcaatttccttttgaatcttcttcatcaagtccaagatttgggcttgaatcgtcacgtccaacgccgtcgttggttcgtcggcaattaggatttcagggttattaatcatcgcaatcgcaataacgatacgttgacgcataccacctgagaattggtgcggatagtcgttgatgtggttttctgaatttggaataccaaccaacttcatcatttccaatgccttagcccaggcatccttcttgctcatcttcttgtgcttaatcaaaggttctgcaatttgttgaccaatcttcatcgttggatccaatgaagtcattgggtcttggaaaatcatggcaatttctgaaccacgcaagtgctgcatgtcctcttctgacttaccaatgatttcatcgcccttgaacttgattgaaccgtgttcaacttcagcattctttgccaacaagcccatcaatgagcgtgtcgtaacagacttacctgaaccagactcacccacgatagcaagcgtctcacccttgtacaaatcaaatgaaatgtcgcggatggcttgtaccttaccgttgtaagttcggaaattaattttaaggtccttaacctcaagaatcttttctgccatgtcttaactctcttccattaatccttcgtacgagggtcaaaggcgtcacgcaaaccatctccaagcaagttaaaggcaatcatgatgacagccaagataagtgctggaattaccaattggtatggatagaattgcaaagccttttgtccgtcgttcaacaacgtacccaatgaggccattggcactggaattcccaatccgataaatgacaacaatgcctcgaagaagattgctgatgggattgtgaacatcaattgcacaataatcgttgaactcaagtttggtaccaagtggcggaaaccaatacgccatgctgatgatcccaatgtacgagcggccaagatgtaatcttgttccttaatcgtcaatacttgtgcacgtatcaaacgtgccattgacgtccatgatgtcattgcgatacccaatgcgattgacaacataccgggcttcaaaatcaaaatcaacaaaacgaacacaaccaagttgggaattgatgaaataacttcgatgatacgttgcatcacaatgtcggtcttaccaccgcgccaaccggaaacaattccgtatgtgacaccaaagaccaagtccatggcagcggcgatcaacgcaacttgcaatgagatacgcgttccgtaaaggacacgcttgaagatgtcacgaccaaattggtcagttccaaaccagaaattcttcttctttgaaacaccagctgaatcgtatgaatcaaccttgacaccatccaactttgcatgaccagtgaaccctggaatatctcccaagacacctggcaaacgtggtggcaagttttgcaacgtaacatcttggtgtgacgttgactttgagttggcaattggtgcagaaccaaatgctgccacaaaaatgaaaaccaaaatccacaatgagatgaaggctcccttgttcttcttcaaacgacgccaagcatccttggcaaagctcaatgaaggcttcataatcttttcgttatcgacatgacgatccgctggaagcagcttaaagtcatctgccgtcaaatttacttgttcagccatgtgctactccttactttgccaaacggatacgtgggtcaatgacaccgtacaagatatccgtaatcaacaatacaaccatcaacatcatggcatagacaatcgtcgttcccatgatgatttggtagtcattcgtcaaaattgatgaaacgaattggctaccgattccaggaattgagaagattgactcaacaacgattgacccagtcatcaagttaaccgccattggtccaatcaacgttaccaacggaatcaatgagttacgcattgcgtgcttccaaatcacttcacgctttgacaatcccttggcacgtgccaattcgatgtagtcagaacccaaaacatccaccatttcggtacggatgaaacgggctgacgttgccaaaggtgccattcccaacgcaattgttggcaagatagtagaagagaagcccttccaaccagcgattggcaaccagtccaacttcaaaccaacccagtattgcaacaaagccgcaaacacgaatgatgggattgaaattcccaaaacggcgatgattgacaagattgtatccgtctttgtgttacgacgaacagcagccgctgaaccaagtccgataccggcgataacaccgaagatcaaggcttgaattcccaattgcgctgaaggtcccatacgttgtgcaatcaacgttgaaacttcttggttagcaaattggaatgacacaccgaagtcgaaatgcaaggcatcccacaaataagtgacgtattgaatgaaaattggcttatccaagccgtactgtgcttcaatcatcttttgttgtgcctcagacaaacgctcagcattcgcaagcggtgaaccaggcatcagcttcatcaagaaaaatgtcgctgagataatcagcaccagcgtcaaaataatgattgctagtcgcttaagtaaatatttgatcatagcgatgaccttcccctattattcctgctattcatattatgaaagactcacttacgtttaattaaaaacgaggttgatgtctctcacatatccatagtttttattagtattttctaatcttaccagacaagtcccgattataaaagggtttgtcaggtaatatcacatgagaatcaaaatttcttaacacttacgaatttgttagcgtttacatagattttgatatgtttgtccagattctgggacgtcgttgcactcgccctatatgtaaaacacgcatctatccatagtagatagatgcgtgttgtctattcaaacttaacaaacaagtgtcgttttgattctgcaatcaaaattacttcttgtatgcccacttccagtcgtaaggtgcaccagcagggttcataacaacacccttaactgacgtacggaacaacgtagcgtatgaacggtagtacaaaggtgccacaccgacttccttgtcgatgatttgctctgcttgcttgtagtcgtcgtaacgcttcttgtcgtcgttaacgtcagtcgtcttagcagcttgcatcaactcgttgtattgggcgttatcccatgaaccgttgttgaatgatgaatccttcgtgtacaagtccaagaacgttgatggatcaccgtagtcggctccccatgcagtgataaccaagtcaaacttcttttcttgtgacaaagccaaacgttgcttaaatggtaccgtcttgatgtcgatcttcaaaccgtccaacttttccatttgtgattgcaagaattgagcagtacgctttgcaccgtcagtgtcatccgttaccatttgcaacgtcaacttcttaacgccagcttccttcataccttccttgaacaacttcttagccttagtcttgtcgtatgcaattgcaccctttacttcagctgccttagcaaagtcttcgttcgtgttaggatcaacagccaacttagttgacgtaaacgtcgttgctggcgttgcagttcccgtcaaaatcttgtctgacaaagtcttacggtcgattgagtatgagatagcttgacgaatcttttcgttagccaaggccttaaccttcttttggttaaactccatgtagaacgttgaagcttgtgggataaccttgtaagccttgttcttcttagaagccttaacttgatcaggtgacaagttagtgaagtcaaccttacctgacttgtacaagttgtaacccgtgttttggtccttgattgtttgaacaacaaccttaggcgtcttaacaaccgcagcatcgtagtacttgctgttctttaccaatgagtacttgttgtttgaaccagtccagtccttcaagatgtatggacctgatgccaacgtgtacttagcggcagttccgtacttcttaccaaccttttccacaaacttttggttttgtgggtagaatggtgccatcgtcaatactgactcaagttgtggcattggcttttccaattgcacttccaaagttgtgtcatcgactgcagttacacccaatgatgacaaatcagtgttttcacctgattggatagcatcagcgttcttaatacctgagaacaagtatgcgtattgtgatgccgtctttggatcgttcgtacgttgccatccgtatacaaagtcgtgagccgtcaaagcgtcaccgtttgcccattgcaaacctgaacgcaacttgaacgtcaatgacaagccatcttctgacttctcaacagactcagccaaagccaaagcaggctttcctgacttgtcgttacggtacaaaccatcaccagtggcttgcaacgcatcaaaatcaacagcagcagtagactttgaagggtccatagttcccaagtcagcaccttccgtccagttgatcgtcttgtacttagcagcatctgccgtcaaaggtgcaaccgttgatcccaaaatcaaggccgttgacaacaatgctgacgtcttcaacaatttgttcataaaataactccccatatccagaaaatgtaaataacgtttttcaatatgcatgtatcatatcctggacgaaaatgagaagcaatgccattttttaatacaaactgtgaattatgtttgaatttcagacaataaaacgtttaaacaccgcgttatatcaacgtttttaaaaatgagaatattactcattttcatgtcactttcacatgttttttgtgatttattacgttagttcgcaacaaaaaagctcgcacctgacaaagatgcgagctttttagcactgtctattcaattaacgcaatgcgattgccatgtagttcatgaagcgctccaagtagaacggtgcatcaaccgcaacagctgcgtatgtgttcttgactggatcagtcaaacggctcaaatcaccaatcgtacgaccatcttcgtggtcgacacgcatgttaattggtagcaaggttactaagttagggtcaactgccacaccaacagccaatggatcgtgcaatgcggctcccgccttgttgatgtccaagttatagtaggcatcaatgtagtaatccatgatgtcagcataggcacgtcccttttcggtacccaagtcacgccattgttgcgtctctttctttgtgagcaaagtttgcaacgtaacgtctagtccaaccatcaccaagtgcttggcattcttgaaaacataatcggcggcttcagcatcttgattaatatttacttcagtataaggggttacgttaccaggtactgttagcgcgccacccataatcgtgatattaccaatcaactcagcgatttcaggatccttcttaaatgccaaggccaagttagtcaaaggaccagttggcacgataaccaaattctctgcatattcgtgagcggcttcaataaggaagtcaacagcagattgatcttcgattggacgctttggttcaggcaaaacgacgttaccaataccattgtcaccgtggatgtcctttgagacttgcattgcctcaaaactatccgtgttcaatgagtggtccacaccacggaagactggcacatccgttgcacccaacaactccaacaacttcaagctgtttacagacgtaatgtcttgtacgttgtttccgtatgatgatgtgattccaatcaaatctgcatcaggcgttgccaatgcataggccaaagccaaggcgtcatcaacacctgcatccaagtccaaaatcatcttcttttgagccatttttccattctcctctataatatacaagttttactattttatttaagcattcatttgttgcacttgtgccaagaaccattcgttgaaacgctcggcatccacatcaacaccaatcgtcgcattaacgaagtcattttcgtgccaacggtgttggaaatcccaaaccgttgcaccggctgctggtccttcagtgacaacgtcaacggcaccatctttaacagtcatgcatgatggatcaaccgcataaaggattgtgttcacatcgtgcatcggcttaccgccttcatgaacatcaccataagccgtaataatatgactcaacatattaccagccttccccatttgcgtgatggctgccatcgtttctggtgtaatcaacgccttcaatgttacgtccagcccaatcatggttttcttaactggtgcttccatgacaatcttagccgcgtctggatcagtaaagatattgaattcagcaactgatgatacgtttcctcctgaaaccgaaccacccatcaaaatgacctcatcaatattgaccaaatcaaatggataattttggaacaacgtcgcaacgtttgtgtaagcacccgtcgcaatcagcgttactggttgtgagctggtttgcaacaccttgtgcatcgctgtcacagcatcatcttcaatcggcttaatcgtaggttctgggaaatcatatcccggcatccccgactcaccatgaatgttggctgcatctgcaaatgccttctttaacggcttagatgcgccggccgcaaccgggatgtcttcacgatggaaaaactcaagcaacttcaatgcattttttgtcgtcttatcaactgacacatttccagcaacagtagtgataagcgacacattcaaatcagggtgattgacggcaactgcaatcgcagcggcatcatcaattcctggatccatatctaagataacctgacgcatgattttttacctcttaccaaacaaagattccggctgtagcagctgctagcaatgaaaccaaaatacctgaaagcatcaagtaccctgcttgagaactaatcaaatcgttaaccttcttaccagtcaatcccttgaaagctccgataatcatacctagcgttccaaagttagcaaaactcgttaggaacaccgccgtaactgcaaccgcgtgtgggttgtggaacaaaccagttccagccatgattgactttgaaatttgacccataacaacgaattcgttcgtaaccaacttcaatcccatcaattgagacaagttgaaggcatcggctgggttgaatcctagcaaccaagcaaatgggaacataacaacaccgataatcttctccaacgtcaaccagtggaagccagtcaatccaagcaattggtcaatcaaggcagccaaaccaacgaaggcaataaccgtagcggtgatgatcaagatcaacttaccggcacccaagattgagtttgacaagaatgagaagaatggctcgcgttggtgaccttcttcagtgctttcgttaacaataacgtcttctgatggatccaattgcactgggttcaagattgctgtaaagacgattgaagccaagatgttcaatggcacggccatcaaaacgtattgtccaggaatcatctttgtgtaagcacctagcactgaagccgtcacacagctcattgacatcatggccaacgtcaaattacgttgtgctgacatgcggttcaattgtgcctttgagacagccaatacttcagtgttaccaaggaacatcatctcaactgagaagaatgcttcaaactttggttgacgggtgatgaatgacaacccacgtccaacccacttaataatccaaggtagcacaccaatgtaagtcaagatgtcaaacattgggacaaccaacaagattggtagcaatgctgatgtgacgaagtttggtccgccgtggttggccgttagccaatctggcaacgcaaacgcaattccttggttcgcaacagcgatcaaccaggcgaaaccacttgcggcacccttgatgatgtcttgaccaatcgtgaacttgttaaagaaccaagccaagaccaacatcaacccaacaatcgtgagaacagaacgccaatcaatggccttcttatccatagagaacaagtacgcaattccgataagaattggaatagcgatgatgttaacaatcaaaaacataacgatacccccaaataaagataaattattttacaatcacgatatttcgtgtacaattcttgtaaaacgtttttgtaaatcgttttacaagtaataatgtaacatgcttcacaagatttagaaagcgtttacactcggttttttcgaaataaaggagatttttgcattaaacccgcatcctgactgtgatttttgaaaattccaacgttgctctgtcactaatcagaataaaaaaggagacattatgttttatcttattggcatcttatctggattgatgctagctgttcaaaatccatataattcaaactttggtaagcaactggcatcaccaattgccggtggattcatggtttacgttctaggaacgattgaattccttctcttgttactgatcactcgcgccaatgtcgctggcatcctatcgctaggttttggtcacggtaacatttggttgctcggtggtgtaatgggagccgccttcatcaccagcatcatcatcttgttccctatcttaggaccaatcaacgccgtcatttatccaacccttggtcaaattttctcgggtctcatttatgactggaccggcgctttcggttcacatcaagtccccgttaaggtgcttgcaattatcggtcttgtcctactattggcaggtgtcttcctaacatcatatgaaaagagcttgccaacaaatgcgcctaaagccaatatctggcaaatcatttgggcattgattgctggtgccctttctaccacgcaaggtttgtttaacggtcaattgtctgccattgttaagaacgcttccggtgcgtcatttatcgcctttctaatgggaaccgtgttcttgctaatcgtcgttatcattacaaagtcacttcacaaaaacacattgccaactggtttgacatcatttactggttgggtcgcttcaacattgggcgctgcctacgttttgattatgaccatcttgatgcctatccttggtgctggtcttacaatcggtttgtcacttgtcggtgtcatggttggatcagccttggtcgaacaatttggtctattcggagtcattaaaaagcgcgtgactatccgcaagattattggaattttgcttttcatctgcggtgttgtcctcacgaagatgtaactatcccaaatacgattattatgacgattatcattaacgaagccgttatgataatcatgttggttgtaaccaacgcccattttatatggtgatgtcacatttctttacaaagtgttttcttatcacccattaagacatcacacccacatattccaaaaaaagcatccgcccctgtactgcggatgcttttttgtatcgtgtgttgtgtgtcgtcgctaaccattatttgcaaataaaaaatggccaaccgaagtcgaccattcagacaaaaataaaataaaccctcaccaaatataccagtgggtaagtatacttgcatatagagagaaagagagaggggcgtattagccatgataaccaatacgcaacaccgtatgtgccgaaaaatcacatacgatgcgaaactatgctcagttctataaaagagctgcgtagacgtactaccacacttcgattgtaagtgatagggtatcagccatgtagtgaatgtaccttgtattcacgcgattttaaatagaggtacaggtacatttctcatacatctacggttgttattctaaactagatattgccccctaaatgcattatttctttattgtgagtatctttattcccagttatattcattatgctattccttcaaaaaactaataccttttcaatgtgaataatctgttatccaactgcaactgacatcttttccactttaagggcaacctcacccaacaaatcatttaaagcagtatatttaaacctgtagttaacggtgcgtacattaactacacactcctataagtagacgcatagtctattttcgttttctcagcatcattcgctcaatgctgagtttttttatttgtccgcatatcccgtttactaattaagggacaaccctcctaagcgcctattaatcggcgttataatggcaccgtaccgttgaatcttactttactaaaattatcgtctaattgttattgatgagtgctttgcttcaactaacacatactattacccattcaacgatacattaaaaggctagtgcatttgcgctagcctttttaatttagtcaccatccgcaattctgcgatcgaacaactgctttttcatggtttgtcgtggcatattcacgcatgtcagcacgctgtaattcatccaatgctgaacataaatggcgatgccgctcatctttagaaataaacatttccaaatcaacaatcccaaactttgctttaacaatttcattatcacgccattgaacaataattggtccagtcaccttattcggctggctaaacaaccggtgttgctgctcactcatcgtcagagctaatatttctttatctcgcgtagctttattagtccatgctaagacttcacaaaactcactaaacgacattggaaacgactgtttaacctgaatcagacgatatgtcagatgatgttgctgcaagaagtctgccacctgctttgatactttacgttgcttgcgtgtaccgacaacgtaaagttcaagtccatcttgatgtttcataattgcgcatcccccttcttcatattcacttccatggtaaaacaagcagataccgtcaactccagctttgcctcttttgttgtaggaaaccggtcctaaaaacgttttttacaccaataaaaaaagcagatcattactgatctgctttttgcggactacttctgtcgtccatagattgattctgtaaatttgttcatcgttaaattgaccgccgtatgcaagaatgaatcaaactcagcaaacgtcggcaacgtcgtccaaacaatcacctgtgctgcttgcgcacgaggcagtaaggtatcactgataatcatgtcgcattgcttcatgtcatcgctcacatcaatacgtagttcagcttgacgttcaagcatggttgcaacttctttatgcataaacgcgtcattaatccgcaagctaatatgcaattgcggaatcatgacagaacggtctaatagaccgatgaataagttataaaacaccttgaacaaacggttcttaatattaagcgtcttgatacctaagtactcattgactcgtgttaggaagcgatctgtaaacaacgtgtactcagggaacaacgagtggctaattgtgtaatcgtcatttccttgataattgatatgcgtcaaaaatagtagcatcatcgctggttgctcaagttcattagctaattgcgtcgttaaatcttgtggcatatcttgcccaaagaattcacggtacaccgtctgggcaatgttgctcaacatcgcatggactttccccacttctttgttagcattgccactcaaatgaccggcagacaacccgacgcgtaccagcatcaagacgccataacgactctccagtgacaactcatgcggtggcaaacgaacaaatcgccggataactgactcgttcagaatcagtaggtttttgtatgcctcatctagttgatcatctgctaatagaacatgcggttgcgtagaatttgaaactgggcaacgtgcattcaagcgcacaagccaaaccgccaactcaatcatcaatgacaagtgttggtgttgcgttaactgcgctgcttcaacattcgacatttgataaaaacgtgccacttgattagcttgctgaataatatcggcttcaaaaaaatcagttaattcggtttcatcatgaatgacgtttttaaaaatgctaaccagcataatacgaatcgcccattcgtctccttgtagccgattataagtattaatttcaatattcgctggtcgcgcacgatcattaaattgacgaatatcattttttaaatgcagttttgggacatcaaggtgttctgccaacacagacaaggctgttggtgtattattcatccccgttattaatgtacggaataaatatgactccttaatatagcttgctgttaagctaagcaagtaggctcggttaccaggaattaattccacttcacgttcagatgggctcaatcttagctgtccctgctctggcacaccaaatcgtttctgatcatgtagcaattcattaatcagtgatttgatcatgtaagtggaccaattgaaatggcgttccaaatctggaatcaacattttcgtttggttcgtctcataaaagtagctaaccaatgctactttcttaatttccttttttcccagtaaccactccataataattatcccccgacttcaatccaatatagcgttagcataaacgattggaaagagtcgtccataaaagcatcgaagtactcccagttctccttcgcttggaataatttgattgactctttgacagaagcatatttggtttgtgctagggcaactttttcagccataatcagttgaataatctcaaccatttggcgcaaaaatagggtcatccaatcatccacctcaaaaggtaggctgaagaaagaattcaataaatcatgaacttcttgactctgtccacgttggatactaattaacaatagctggtataccaaaaagctgattacgtgcaacacatcatgacgcgctgcatcgtgacgctcctttaacttttgtgttaggaagcgaatgctggtcattgccttgggataataagccaaaatctcatcatatgtaaaataatttagatatagcaggaatgctttgagttcggccattgtgtagtactctgagcgtcgcaagacatcattcagtactggtttaatgcgtttagcttcttcactgcttaaaacaacaggtcggaaatcatttttgtcttgtaaattaattaatcctgatatgtcacgcgtgcgttggtattcagcgattgcagcaattaccggactagttgcctcatcatcaactggtttcggttcaataaataagcacaattcatccaatccaacattaagcgtgcgtagcattgcgtgcaacttgtgcaccgtaatgtcaccttgcccatttacaaacgtgtagtatcgactgctagagattccagcatgcttcaagatatcgcacactggaatatgcttcatatcgatcagcccacgcacagctgatgatatggttgtatctacctcagttttcatactttctttttctctcttcatctcaaaaaatcatagcaaaagctaaaaatttatttccctttggtcaattaccagattcatctttttcatatcccattaaaggcatactaacattttgtaatacacaacctttagatattttcgaattaaatacgttgggactatgatgttatctatttttaaaaaatttaaaaataaccctagttctttgccatatcacgcttcaatacttgaatttcatccccaccgacaatgacctcatcacagacgttcaagaacaagccgtgctcaacgacaccaacttgatttgatagccatgtcgcaagctcttctgggaatggaattgtatccaaatgcaaatcaataatgttattaccgttatccgtcgttagtggacgcccatcttcatccaaacgcaaaattggatttaaattgtgcttcttaaacaaacggcataattgttgttcaccatatgacaccacttcaactggtaatgggaagtgtcccaactcagcatgttgcttgctaccatcgacaatccaaatgttgcgctttgaattcttggcgacaaccttttcatatagcaaagcagcgccaccacccttgataccgttcaattgtggatcaaccgcatcagcaccatcgacagtcaaatcaatgtaatcaaccgcatcgacgtcagccaaaggaatgcccaagcaacgcgcttggtgggcagtacggtttgaagtcgttacgccgacaatatcaagtccttcattggcaacgcgctcaccaagacggtcaacaaaatagcggacagttgaaccagttcctagaccaactaccatgccattttcaactaagcttgcagcgtattcaccagcggccttcttttgttgttgaatcttgtctaacatatcgtcctccttagtcttcattgtgcaatgatcgaacaacttctgagtgagttgggattgaacggattgcaccagaacgtgaaactgcaagtgaagatgccttacatgcatattcaactgcatcggcaacattcgtcgcatccaacttcaattgtgaaactaccgcaccgataaacgtgtcaccagcagcagtcgtatcaactgcctttaccttaaagataggacgcgtgtgggggttcttaccatcaaggttgtagtaaacgccatcttcaccaagtgtgatgatagttccttgcactgacaattcagaaatcgcatcgctaactgctagtaggtcctcatactttgttgatggctcgcgttccaatagcgctgctgcttcagtctcattaggtacgatgatatccgtgcatgctaggatagctggatcaatgtccttagcattcataactggcgctggatttaaaaccgtcttaacaccgtacttcttagcaaggtagaatcccttagcaacagcctcttgaggcacctcaaattgggcaaccacataatcagcatccgcaatcaatgcttcagacatgacaacgtcatcagctgacaactcagcattggctccaccatacacaagaattgtgttgtgcccatcttcttcaagcaaaattgtggctgatccagttgctgtgtccttttcacgcaaaccagaaacgttgataccttcatcttctagtagggtcttaaattgttgaccagcttcatccttaccaattgcaccgataaaactaacttctgcaccttggcgagcggcggcaactgcttggttagcaccctttccaccaaggttcatgctacgttcgtcaattcgcaaggtctctccttggagaggcaaacgcttaatattttggatgatatccaagttcaaactaccaattacgacaaccttgttcatttctttcaccttttcccttatacatcatttttaaagtattcatcttgtaaatcgtttttgtaaatcgttttacaaagaataatatacaccctttttgtggaatgtaaaccttttcaactcggaatttggtaaatgcatcacaagcatattcgtttttgtgtacaaaaaagccctagaaacgtggattcctagggcttttacatcatgattatttagttggtgcaggtgccgttgattcgcgttgaatgaggcggacatctaaaatttcttcttgcattggcaatgctggatctttaaggcgtgctagcaccatgtccaacgctaattgacccatacgccaaaccgcctgggtcaccgtcgttagagatggcaccgtaaactcagcataatcagtgttgtcatagccaataacactaatgtcttctgggacgcgtaccccgccgttcttaaggccacgtaacaaaccaatgcccatttcatcgttcaaggtaaaggcagctgtagcacctgatgcagcgaccttatttgcaattgctaacccaccgtgctttgatagcttcgtcgcaatttcaataattttaacgtcggcttgttcgtcaataaccgcagtaaaccccgagatacgttccaacatatttgttgtcatcacatcgggatgtagcaacgcaatttttttgtggccaagttctaccaagtggcgcgcaactacctggccaccagtaaactcatccgtcttaacgtggtccgagatgttactatcattaatttgatctagcacaacgtaggggatgccttgcttttgcagataacgatccacttccaaggcattcggtagcattcgtgcaataaccaaaccatttacaccgcgttccaacatcttaagcagcccttgttcaatttcatcatcatcaactgaaatgaacaccaagtctgcgagattgtgggcatggttttgcatactttgcattaagtccgaaaagaacggattacgcaaacttggtaccatcaccccaatcaacggatttccaccacctcgaagactcttggcactttgatttggcacataacccaattggcgcacggcatccatgacgcgctcaatcgtttcctctggaaagtgatcatttttcttattaataacttgtgacacagtcgttggcgaaacgcctgccaacgccgccacgtctttaattgatgctttttttgccatgtctatccccctcacgatattacccatgtactctctaatacatatctttacaaacattatacctatttcaactagtaaatgcatttactaaatcgaaaaaatgcatcaaaaaagctgaacaaacgggggattccatctgctcagctttttcgagttgttcacatactgacttatacaagtcataaggagttgtagcgtcaacattagctaaccttctcgtaaccatcccgctagctaatgttgtcatattatgcttttgacatctctacgaatgctatcttaccttaccgattcgtcagtcgggtaatctatccttcctaaaggacagtcaagattacttggttagcaaaccgcgcaattcaagttcacggtaaagtgaacgtgtcttactgttttgcaagcggatcattcccttatcacgcgcgataagacgaataccatttgcacgtagttgttgctttgcccaagccttagtacctacaagtgccacaacctctcacctcttttccgataatctcatggattaccacagcagctgttggtctacgcccctgacttcagtcaggcgcaagaccaaagacgcacctgataagggcgacttggtcatgtcggaggttttagacctccgacatgaccagtctactttatgttggatgcatttttatggctgtcattaagtctgcacctaactgcaggacaacatggcagaattcctttaaaatggcgatttaattgggcagcacttgggtctattttgctcgttgatagctagcagtaattcgccaaacaatcacactcatcacggccatgccgagagcaaagacgatgtaggcactatgcaagccattgccaaatcctgaaacaattgttgtggcaactagaacaccgacaaccccagcaaattggcgagccgtgctaatcatcgctgaaccatgagtaatgagataatcaggcaattggttatttgcataagtcgtggctggcaacatcataaaggcattaccaacttctccaaatgcggcaaaaataacggccaatacagcgttatgcaagccaaacgttagtgccagtcctgcataaccaataaaaatactggcagctccgatgcgcatgacaacctttagccccttttgatcaagtagctttcctgaacggcgattcatgacggccatcaaagcagctggcggcaccatcaataaaccagaaactaatttgctggtgtggagtacattctgataatacaacggcatcaacaccgtcatgacaatcaagccaatgtacgatgcacctgttaatagcaaccctaatgtgaagcctgcttgcttaaagaccttaaagtccaacattggttgtgccatgatgccttgacggtgtacaaaatacacgctcaagaccaagccaatcatcatcatcgcaatcatactgattggcgtagtggtgtgtcccatggactgaatgccaaatagtaccatagcaaaaccgaatagcccaattaatgacgggatatccaagtgaacctctttcttcacgatgacgttttgcccaacgaataaattgaccaaaaatagcacaccaataaccagttcaaagaatacgaagacaccttgccaattgaaccattgactaataataccggacacaatcggaccggtagccagggcagcgcccatcaccaggccaaccatccccatgctagcgccacgattctcttctggtgtaatcaacatgatgacactttgataacttgggaataagaagccaactgctgcaccttcaagcacacgtccaaaaatcacccagccaaacccagttgcgttaatcgcaataaatgttcccagcaaaaacatggcttgaataccagctaagaaccatttgaaggagacgcgattcaaaatccaagggctcaacggcatcgtcaccgtcatgaccaacataaaaccggtagttagccactgcaccattgaaatcggtacactaaaatggctcgccatgacgggataaatcgtcgtcatagccgactgactaattgagaaagaaaaactggttagcaacagcatccaaacaaataacgttcgttcgcgcttacttaattgttttgtctcactcattctgtccactcaccatccgcaatgtcacccaataactcacgtgatgggataaagaatagttggcctgacataagttgtgagaacgtcaacaaataatcagacatctcaaccatttgcgtcaacattgccttggtaactgaccaataacgtgaatagccaataaagtaggttcccgtcttgttcaaggccggttctgagaatggcacgttcatacggacgatttgacgctcttcaccatcaatttcgaccttagcactcacgttgtgtgcgttgtggaacttttcttcatcttccaattcaagatcatcatacttgtgacgaccaattgccttctcttgtacttcagtctttagttgtccccagaagtccatatcgtgaagccacttttgcgcaaatgcatatgacccattcacaaaatcaggatcctcatcaccaacgaccgcaacttcagcagaatcagctgcgcttggcacttcagtcccgtcgatgaagccgataatggcgcgaccttcaaaattacggaagcccttagtttcatcgataaccgtcgtgacatcatgcagaacggtcatgtattgacgcacaacctcatacacaatcgacatgtcattcgcacgcacgtggatgaaaatatctccctctgtcccaggcatgctgtattcaggtcccttaagtcccttgaactcttctagttcagctggaaccggcttgtttgggaacaatgtttgccaagcagtgtaactaaagccgattgcggtcttcaagttcccatctgctgcacgtacgttcattgaacgattaattgcttgtgaacggtcagcgaattccgtgatggcatcttgtagttctgccaacggctttgtacggtccaatcccaacaccacaaattcaacgctttgaccaacgtccttccaaacgtcttgtgcctttgtataatccatttcagccatgataagccctcccaaaagtataattgggcggtgtctcagttctatcaaattagcaagttgctaaataagtgtcataaaataatcggccaaccatgagttgaaagcttatgacaattatttaaccgaggcatccgccacatctactattattggcacacttacaacccaccaacacaaaattcctttataagggaatgattaacgatgtttctccatttttgtgttggtggttgggtcgctgcctgtgcgttagcacaacactaatcacaaacaaaaagcactaccgttcaaaacgaacagtagtgcttttaaggttaagccgccatacgacgatctagaatacgaccaatctttgagatgacgtagttcaaggcgaagtacaaaacagctagtgcaaagaacattgcgacaatcgcatttggttcttgcgcataaataatttgtgcacgatatgtcacttctggcaacatgataatcgttgccaatgacgtgtccttaatcaatgacacgaattgtgacacaatcggtggaatcatcttcttgtaggcttgtggcaaaatgatgtgccacaatgcttgctggaagctcaatccatttgaaagtgctccttcaagttgcccctttggtacggctacgataccagaacgaataacttcggccaacattgctgactcgaaaatcgtcaaagcaaaaatcgtagacgtcataacacccaagtgaataccaatctttggcaaagcaaagtacgtaaagaagataatcaacaaaagtggcaaattacgaatcaaatcaataataaaaccaacaatctttgatagataaggaatcttcacgtaacggataacaccaaggactgatccgatgataaaactcaaaataacggatacaaccgctacctcaatcgttacccatagtcccatcagcaagaagcggatgttgatccatgagaaagctgacaaaaattcgctcatgattatccctccttactcaacttggcttccaagtaacgcatgtagtaactcattggcattgtcaaaatgaggtagaaaataccaacaataatgaatgggccaaatgtgtcaaacgtttcttgtgaaatcatgtttgcttgatacatcaaatccataccggcaacgaaggccaatactgatgagttcttgatcaagttaataaattggtttccaagtggtgggataaccaacttaaaggcttgtggcaaaaccacataacgcataccttgccaccatgacaatccgttagacatggcaccttcaagttgtccctttggcacggcattgataccggcacgaaccgtttcagcaataaacgctgacgtataaagtgttagtcccaacgttccggctgcaaaaccactaatcttaacgatgtttgcaataacgacgtagaagaacatcgtgataaccaacaatgggatgtttcgtacgacttcaatatagatacgaccgataatgtttgcgaccttgttcggaaccacttcaagcaaagcgaagatcgttcctaataccaatgacccaatcaaagcgagcactgaagacacaatcgtccagccgaatccacttaagaagtcgccagcgtgtgattgaaataatgaaatcattccttagccaactccttccagttcataccttcaacgccagagaaccacttcttggctagcttagcgtatgtaccatcttccttaatttcgtcgatggccttattgaccttcttaaccaacttaggattgttcttgtccatggcaacaccgtatggttccttcgtgaaaggaccaccgacaacttccaatgactttgaaccagcggccattccatatagaataccgttgtcagtcgtcaacgcatccccttggccggccttcaaggctgtcaacgcagtggcatagtctgacaatgcgacaaccttggcctttggcgcaaacttcttaaccgttacggcagaagttgatccagcaaccgccaagatacgagcacccggcttgttcaaatcgtagatatttttaatcccactatctgacttcaccaagattgattgacccgcgttaaagtaaggctttgaaaaatcgaccaccttggcacggtctggcgtaattgacatcgtcgcaatgatggcgtcaatattaccgttcaacaacattggaatacgggtacctgacgtaatttgcgtcaactcagtcttagcctttgggttcacacgcttagtgatttccttggccatgtccacgtcgaagccttcaagctttcccgtcttaatgttcatcaaccccatcaacttggtgtcacccttaacaccccagaccatcttatcggtcttcttaatgcggttgtacgtttcattctttttatcgctagcttgaactgtcgttgtcacaacacttccggctagtagtgcgatggctgcggtagcaagtaccgtacgccatgtgcgcgtaaacttgcgactcatattccgcacctccctagtggatgatttgtgacaagaattgacgagcgcgtggttccttagggttctcaaagaactcttcagttggagagtcttccaagatttcaccgtcagccatgaaaataacacggtcggccacttgcttagcaaagcccatttcgtgcgtcacaaccaacatcgtcatgcttgagtcagcagcgatttcgcgcataatcttcaaaacatcattaaccatttctgggtccaatgcagacgttggctcgtcaaacaacaaggcctttggcttcatcgccaatgaacgtgcaatcgcaatacgttgttgttgcccacctgacaacgttgaaggcatcttctcagccttatcagccaagccaaccttctccaacaactccattgcaatcttcttgttttctgcttcatcgcgcttcaacaccaaacgtggtgccaacataatgttctctagcaccgtcttgttagcgtacaaattgaagtgttggaacaccattccaacattcttacgcgtacgattcatatccgtcttgggattggccaaatcttgaccgttaacaatcaattgtccttcttgaactggttccaaaccattcacggtacgaatcaaagttgacttacctgatcctgagggaccaagcaaaacaacagtctcaccagcttcaactttaaggttgatatccttcaaagcatggaaatctccatagtacttctcgacgtccttaaattcgatcatcgacatttgggttgcctcctatttgataattctctcaatttaaattatctctctataaataaaaacccgccgcgaatactcgggacgggtcgctactgtaataatagtctgtaagtaatgacagtgtcaaattctttgtcagctttgttgacaacaagtttgtttcttcacaattcctttgccttataggctaattcaacggccaaatggtagtcatcatggcgaatttgtaggttagctcgaccgcgggctttcccttcaccaccaagaataacagctgaagcaacaaacaactcatatgattccattgccaacgctactggttgcaagccgaccgtttcaatgcgcgccaatcgttgtgccagcatctcgttcaagccaccgtaaatggccaaaccaccgcgttccttttccaaacggaaatatggtagtggtgtaccaggatggttcgcataaatgacgtcatgatcagccgctaaataggccatttgttcatcttcggacaagcctccataatcttgcgtcatcaaaccgtttgattgcagctgttcagcgaccttcgtcaactcagcttgcatgtctgggtccgtcaccgcactggctggcaaaacgtgttgtcgcccatacaagccatttgctggtacaaacggcgttgcagcacgttgcgtcttatctgcatccgctggcttaccacccaataacttttcaactttgggtgataaatcccacttgaaagtcttcttcgtaaagtagtagacaacattcaaaaaggcaaagtatgcaatcacgatgaacgctagcagtagacccaagccacgcaaataagcggcatttttcaagtgcataattgccaagtacaaaacgtagaagttaccgactgacgctaagattgtatacacttggcctttccactttgtattcacgttaaagaagccaagataatgattcaataaatccaagattgtcaacattagtttgtgcctccgttatctgcaggcgtttgcgacgttgaggatgcgcttgaagaaacagcactcgaactaaccgctgatgatgacgccgcattgctactctcactgcgcgatgaactaactgcgctcgatgagactgcacttgaagatgatgcttcactcacagctgacgattcatcagtagcttcagaagttgaaactttcgcacggctttctgacgtgtcgcttgatgacttttcagatgacacattgctttgttgcttctcactagatactgacgtcgatacaacagaagagacttgttttggtgccccattagacgtatgcgttgagacattaacaattgcgtttgccgcactcaatgccaaaataattgaaaccaaagcgaccggtgtaataaacggtggtgtgcgatatgccatgaagacctccttgtatccttacaaactaaccttgaacaacttcttttacaatttcatcaatcgcctgcttggttgtctgccaatcatcattaacaacaaccttagcaacatttgttaattcagtcggcaattgtgtgtcgcgctgatattcatcactggccaaacgtgctttaactgccgcaacatcatccccacgcttttccaaacgcgtcaataattctgaagactcactcaccgtcaaataaataacgactgcttcatccggtagttcacgtgcataagtaatcgccccagccgtatcaagtacgattgtgataaatgggttcttttcccacgcacgctccaagccttcgtgtgacgaaccgtaacgatagtgcgagtattcaacactttccagatagtggttttcaccaaaactggcctcgttttcaaaatagtaatctacttgatcaacctcaccatcacgcggtggtcgcgttgtgtgtgtaatcaccttaggcatctcgtagaactcattcaaataattggcaacggtggtttttcctgtgccagtgttaccagttaatacaaatactttgcgcttcataatccaaaaatttctctctgttttcttattaaacttcattataaaaccctgagcttaagttggcttaagctcagggcaaaattatacttattctttaccaccaattggcaaacgcatcacgcgcccgatgattaccatcaaaataaccacaatcacaactttaatgattgttgggataacgaatgcaatcaaaccagttgcaacagctgtttctattgccatcttagcaacaaaagccaaccacaatgtcccgaaaccaagttgtagaaaggccgcaatcaaattccaaaggagcatcgctggccaagaacgactcaaactagcccccataccaatgaccaacgggaatagcaacatcccgattaaatagccaccggttggcccaataacgatgccaacccctgaggtccagccagcgtacaccggcataccgatcatccctaaaagcaaataaaccgcaaccgctgaaaatgacacgcgtgttgccgcaatcgatgcaattaacggaataatgattgtttgcaccgtcaaaggcacaatcccagtcggaattgacaagggtgccaaaatagcaataattgcagcaaataccgctgccaaaacgagttggcgtgttctcatgaaatcacccatcctgtcattgttagttttgtgatttcacctgagtaaaatgtttggcgttgaccattaacgtccacgactaagccaccatcagcgctcacatcctttgcaatcccggtaatcgcctgatttcccacagccatttcaaccggctggccaattaccagtgaacgttggcgataagccgtcatgacttgcgacgcatctagtgaaaaatagcgaacaaaataatttaataatgtcgccgcaagtcgatctcggttcaccgtttgattcgttagcgcaccggccttttgtgcaatgtcagccggataatcagctgggttgatattcagaccgataccaatgaccaaaaagccatcttccccggttgtatttggcacagcttccaccagaataccggccacttttcgttgattataatacaggtcattcacccacttaataccaacctcgaccccaatttcttctgaaagagcctctgccgcagccaccgcaataccagttgtcactttaccaggtgccaatgtcttcatatcagtccatggccaaatcaacgttaggtaaagtccggttgcttgcggtgaataatactggcgaccatgacgaccataaccagccgtctgttcatctgccacaagcgccatcggaccgattacgtctcccgctgtaatcaatcgcttcgctgccgtgttagttgaatcgattgtcgtgaaagtctccaccgacaaggtcaccggtgtctgtaagtatgcaagtatagtggtcttatccacgtgttcgtcccccaattctccccaggctgtatcacctcttaatcataccttggtaactactaaaaaaccagacgtcccaagcggttcgtctggttgaatttactgtaatgaaattgcccgttcgtggcgtcggacttccgctacgattggtgaaacaagttttcgaaagcgttttggcaaatcaatcatatgattttccgcttcttccaatccttgaatatgttgttggttaatatcgtgatcaaacttcttgatgaaccaaaccatcatcctatgccaccattttaacttttcagggttaacagcaccctgcagttggtaaaaatgcacgcgctgttgcgctggatagtcaaaattctgtgtgcaaatactgctaaagtagtcgcgatcaatcggatgaagcccaactgagaagaaaataatctcacaggcattaagattcgccaactcgctattaatcaagttagcaatcttaatacggccattaaaaatcggtcctccaaaaattatcgtgtcgtacgtcgataaatctaatgcgccgatttcgtccaatcgatacttgctaatgtgcaactcatctgcaatccagttggcataagttgcggtgtgtccatattttgtatcgtaaattataaccgcactcataaccaaccctcccgcgactaatttacattaggataccggatggaactatgattctatgcgtaacgtttgactagtctgcgaattaattattgaacaatcccttgaagaagttaaccaatggattccaaatgttcgttacgaaccagttagctgcttccttcacgtcttcagagtttgcgaaatccttggccttagccatgatatcaccggctgaattttcaagcttattagacaagtccttagcgttatcaacaaaggcctttgaatctgaaattggggcgtttgccacgccaaccaacgcttgacccatttgttgtaccgctgcttcagaagtcttaccagcgataccttgcttatccaagttgacgttcaattggttaatcgcaacattaactgtgatgttcgtaccatcttgcttcttctcagccaattcacccgctgtcgttgttacggctgacgttagcttacctgggtagctactgtcgttggcgttttcgttaactgccgtttgcgtagcactcaacatatcattggcggccgtcgtgttgctctcatccaagttaataccatcagtagccaacgccttgtacacaccagccaacgcagcttcaccagaaacctttgagttagccgttaccgtgatgatgacgtcattcacaccagccatcgttgcggccatcgcatattgttgtgacgtcacttgggtaatgttgttttgtccgttatagtccttaatgttaaccaacgttcccgtacctggttctgctggggcaattgacactgaactaatcatagcgctatccgcaacgcctgaaatattcaagtacgttgccgcgtcagcaccagttgtcgttagctttgtgtagttgtcggttacgccaagcgttgatgccaacgtagattgatcagatgcacctgcaccatatacaacgtatgactttgacaatgcacggttttgcacatttgtcgtaccggccgctgaaaccacggctgttggtgtgacaaacacagtcgttgtgactgccgttgcaccaatcaatgatgttgccaacaaaattgtcgtgataaccttactcgttttcatggttaaatctcctcgaatattatgttacataattgtaacacaacaaacctaaaacaaaacttatcggtggcaataatccgtttcgaattgtgaactttttttgaactttttatagacagactgtgcgctacgtacattttgtactaggaaagcgttagtattatagagtaaagaagagaacagattatgagatacgagataagggagaattggttatgaaacgtggaaagtccgccgtgctactagtggcgagcgttggcacgatttttaccactagcaccgtttttggtgatacaacaaatagcactatttcgagcgaacaagcgttgatatccactgaatcaagcgatatcgctgcaacagcggatactgacacgacaccggttgaacaagttacaatcgacaccccatcatctgaacaagcaccaattgaacagccatcagaaacaaatcaaccgacagtgaacactgatgaattcattactgacatcgatatgtcaaatgttagtgatcgcacttcatcgtcggcacctgattcaaccggtgttgttgaaaacgttggggatgccacaacaccagcggaagacgcaactaacaaagttgaaacttccgctagtgacacaagcgtttcggcagttgctaactcagtacgcgtcgtagccacaactgcaactgcggaacatacgccaacacctattgatactgcgccaaaagcaaccacgacagcatcaacggccacaagtgattcagttatcaaaacaagcattcaagtggtgcccgctagtagctcaacccctgcacctaacgaatcagtcgctacgccatcaaccaacagtggcaataccgtcacaacgcaaccaacaggcgccgctagtgttgtgaataaagtcgcagttaaagctggtaatttagctgatacattattgcccgaagccgcttatactgtcgcatggacaccggccgcttttgtattggtaattgctagttttatcgcctgggccgttgcttattacacaattttgcgtcgtcagaagatgcgcgaatatcaaatcctaatgcacgactaaaaaaagcactcgcaaaatgcgagtgcttttgttttacatctattagtcttcgacgttagccaattcgtacattgattgtgcaaagattgccattgcacgcgtcaaatctgaaactgggtagaattcgtctgcttggtgcatcgtatcaggcacaccttcgaacatggcaccaaaggcaacaccacgcttcaacaaacggccaaacgtaccaccaccgataacttgctcacctgctggcaaaccagtttgatcacggtaaacttgcaacaacgtcttaactagtggatcatcaccaggaacgtagtgaggcacttgggcgtgaccctcttgcttagccgttgcgtcaaagcctgctggcaatgaagcagccacgtgaccttcgatttcctcagccgtcgtgttttgtgggtaacggaagttcgtgtttacgaaaccatcttccccatcagtaaagcgttggataccaacgttcattgacaagtcgtgcatcaaatcatcgtgcgtctttgcaccaatcttctcagcaaccgtgtcatcgtgcaattgtgttcccaagaacgtcaagaatcccttagcgttgccaccaaagtcttggttttgcaagaagttagccaagtaagtaccagcgttttcaccagtttcaggcatcgcaccgtgcacttgctttccatagaaagtaaacgttacttggttaccatcaaccttagcttcacccttaacacgcttttcagcggccaagtaagcatccatagctgaaaccaaagcagcagtatctgcagcttcaacaacagcaacagcagttccaggaaccatgtttggacgtgaaccagctgagaatgaaaccaacttcaatgaaccaccttgcgtaccagcaaagcgcgttacgattgaaacgttacccttttcaccgttgatgattgggaattcggcgtcaggtgagaatcccatcgttggcataccgtagtcctcaaagaactcgtccataccagtccagtcagactcttcatcgatacccataaccaaaaccaacttgcgcttcaagtccaagttcaagtccttgatcatcttcattgcgtagtaagcagtgaatgaaggtcccttatcatctgatgcaccacgggcatacaaacgaccatcttcaattactggagaccatggatccttcgtccaaccatcaccggctggcataacgtccaagtgaccgatgattgcaacagtctcttcagcgtcttcaggacccaattctgcgtaggcaaccaagttcttgtagttacccgtgcggaatccgtcacgcttagcaaattcttcgaacttcaacaaagcttccttaggaccaggtcccaaaggtgcatcttccgttgcagcctcgtcatcacgaactgacttaattgccaacatctccttcaagtctgtcaacaattcgtcttcatacttcaatgcttctgcacgccattgcgttgtcatatctcattgacctccactgtcatattggttgtaattatacgccattttataaagaaatgcagactttaatcaatattatgcatggcggctaaccttccgtcagtcatattttcttcacgtttgttgcaaaatgtgaacgcttacagaacgctttgtaaatttcggcttttttgtattttatagtgatattatgaacaagcattaagcaattacattttatatacacaggagttagcttcatggatgcaaaagttcaaaaggacgaatttgctaagcttacactgatggatcgaatctcatatggtttgggtgacttcgctcaaaacttggttttcggtactgttggtggattcttgctattcttccttactacggttaacggtatttcagctgcggctggtgccacaattttcttggttgttcgttggatcaacgttgtttgggatccttgggtaggtgctacggtcgacaagtcacatcctaagggtggaaagtacttgccttacctacgtaacttcggtattccgctagttatcttggctgcctgcttgttcttgccagttggacaatggttccctgcatttaaggtgccatatgccttcttgtcatatatggcaacggccatggtttactcattcgttaacatcccatatggtgccttgaacgcatcattgacgcgtgataacgatgaaatcgcaaagttgacgacggttcgtatgacgttggctaacatcgcgaacttgttggtttacacttgcttccctatcttcgttcaattggctacgtcagttggtcgcgagtcaaaggatatcggaatgtttggaatccacatgaacttgggtgactactcatcagctcaatcagctggtgcttggttcaaggtttatgccgtatacatggttatcggattcttggctttgatggttacttactcaaagacgaaggaacgcgttttgcctgctgaagatgagcctgaagtaaagtactcagacttgtttgctgagttgaagcgtaacaagcctttgcgaatcttgggattgttcttcttggttggctttacgttcatgttcttcggaaacactgtatggccattcttcttgcaatacaacattggtcactcagagtggaacggttcaatttcattgatcggttcaattcctggaatcttcttggtcttcttgtggcctaagattcgtgccaaggttggtaagaagcaattcttcgctttgttcttggctatcttcatgcttggttctgtccttttgtgggtatggactaagaaccctgacaacatcgcaatgggttacgctggtcgtttcttccaacaatggggattgacttcagctactggattcatgtggtcattggttcctgaggttgttacttatggtgagtacacttctggtaagcgtgttgctggtatcatcaacgccatcatgggattgttcttcaagattggtttggccttgggtggtatcatccctggttacatcaacgctgctactggatttgacggtactaagaagatccaatcagctggtgctttgatgggattgcaatggtcaatgatctggttgccaatcatcatggctgttcttgccatcttggtaatcatgaagtacccattgactgacgaagaagttaacaagatgaaccacgaagttgaggctcgtcacaagaagtaatttcttggttaacaattaagttagttaataaaaacgacgtgaatgtcaaaattcacgtcgtttttttgtgtcgttattataggtttgattgaatgcgggccatgtagtttggcaagaaatcagctatgaacgatggcttgaccacataactgtgccctgccatctcttcagcgattgctgagtgtgcataaacggctgcttgtacagccttagttgggttggctttgaattgggccgtgaaaccagcaattgtacctgctagcacatcgcccatcccaccagtcgcttggtaggcaccaccgatttgcagttgcttttgatcatccttggtgtagataatcgtgtggtgttgcttaagaacaagcacatcaatgttcaaaatttggcgttgtacctcgttcaattggtgctctgcttgatagttcagttgcaccccactcaagcgtgcccactccatttgatgtggcgtcacaatcgtgaatgtgtcacgcgggaacatcatgttttgttctgccataatcgtcaatgccgaaccatcaacaatcaaaatttgattttctgtgacggcttgcaaaacttgttgcaccaattgcaccgcaaaaccatccgtccccataccagggcccattaggatgacatcgctgtttgcgatcgccgtcatcaagtcagcgttgttacgccaatccacaaacatcgcttctggtgtacgtgtgtgtagtggtgccaaattaatcaaatccgtcgcaactgtcgttaaccctgcaccggcaccaacaactgcactagcggccatcaaaattgcaccaccgtattggatgttacccccgattagcaaaacgcggccaaacgttcctttatggctgtcgtctggtcggcgcacaatgacctcatgcaatatttctgatttcaattcactaatcatgccgtttctccaattttgtaagtgttacttaattataacgcgtcaaaacgcaaatttgaaattgtcccgttttcatcacgagttgtcagttgcattctggccactattcagcaaaaattgacagtatacatggaggaaggcaaatatgttaaatattgcttacgtcggatttggtaaaagcacgaaccgctaccacatcccttacttaatggaacgccaagaccgtttcaagattagtcgcgtcgtcacgcccacgctgggcaagcgacctgacgaacaagctgcgttggaaacaactggtacacaattttcaaccgatatcgccgacattctaaacgacgactcactcgatttagtcgtcgtggtcacccctgctcctagtcattatgaagttgccaagcaattgctactagcaggtaaaaatgtgctcgtggataaaccgatggttgaaacattagctcaagccaaagaactcgtcactcttgcacgtgaacgtcacctgttctttatgccattccagaatcgtcgtttcgacagcgactttctcacgattcaacacgtgcttgctgctggttacgttggtcggccagttgaactagagctacacatggatcgttatcggcctaatgatggcgtgaaattggggacgcctatcgacggtgcatggtacggtcacggtgtgcacttggctgaccaaattgtcgcactgtttggttcaccggatcgtgccacttacgatttacgtgcaacccgcgaaccgggcgccactattgatgatcaattcgaagtgaacttgttttacggcgatacctttaaagcaaccgtacaagcaaccgaattagctgcggtcgcctaccctaagtggattttgcacggtaccaagggtacttatattaagcacaatattgatcaacaagaatatgatttgaagactggaattatgccagggatgcctgggtttggggatgatgcaccacaagattacggtgtcgtcacttactataaccaaaatggtgatcgcattgaaaaggtcatccctactattcacggtgattacggtcgtgtgtacgattcagtgtatgacaccctggtcaacgacgcaccaaagttggtatcagatgaacaaatgctgacagttatcgaacttttggcggccggttattctgacgcaaagccccatgtgacaacgtttgaccgctattaaaaatttatcacatctttttcaagggtttatccttgtaagcgtttacatgcagtgttaatataatggtgtaccaaaggaaaggaaggtaaaggatttgaaagaagttcttaattcgacctctatcacgactctacctactaaattccatgcgggcgtgtcacagtaatgacgcaagataattaacgtattgttttataaagagataaacacctaagtcatgtattgacatctcttgcgatcattagcatcggttacttcgacaaagtacgataacctttttaaggcgtaagcatgtacggcgattcgaaggctgctcctggcacggtctgcttttcaaacagatagacatggatgcggtagagatagagacggtgagtttggttgcgaccataccctagcgacagacgtttaaaactgcagattaaacttctagggtggtccatctacaattgaatacagggtggcggagtagcgtcttccttgttacgtgtcgcaaagcgtaacgaaagtttaccgcgggtcaacgtaccggcggtttttgttttgtctaaattttgtggtgtgtgtccgacctctggtcggagtgcctggccccttctagggcacgctaacacgtactgaccatgacctgcagggagcgcgaaccacagcaagctgcgtttccctttacctcccgtggctctaagcggtaaaaccgctaagaacccacacctgcgggtcaaggtctgcacgtgtctatacgcgtggcggggccaagcacagcgcttagcttgatgaccctacacatttgtttcatcgaaacgatattcagttttcaaagaactatctcagagttgctcatcagcaacgttttatatcttaccaactcatgaagcggatgtcaacaacttatttcaaattgtttaaacaactcattcacagtttgaacatattttccgtcgcaagcaacttatatatcatatcgaattgatttatgattgtcaacaatcaatttcaattcattttgcatcgttttgcattcgaattagattcgtttgaaaaactcaacttgaatataataccgaacatctataacaaatgcaagccccaatttaatccaatcgtgcaacaccggtcatgtcgacatttcgaagtagatcagcggcatccttcgcattcataaactgcaaacctagcatgcctagtcgatccatattgaagcgtgcggcatcgactggttcgaatgtatacaatgaaatcaagtcttctgctgtttcaagcccttgaccgtgccaagctgctaactctcctaagcgaaggttatcaatatcaaaaccaagttcatccttcatccccgttagcaacgatcccaacgcggtgtctccgtcatgcttgtgcatcttaacagtatagaagcgtggcgttgggacttcatctgtgaccaagaagtatgattgatcatttcgagtaaagacaactgttcctgcgattaatgacataatgccatccccctttaattagtgaacgtgtgcgttcaaacgttgcaatgcttccgcaatcatatcatcacgattatcagcaatcgtttcgaacccgatatttaaatgctgattagtccaataatgatggtgccaattatcgacacgttgattttcacggtccgttctaaccttttgattagcatctaatacactacgacgtgacaatgaaatcttctcattgtactggtcgatatctagaatcatgacgtcaatcacctgaccaacgtgcaattcatccccaacgtgtcgaataaatgccgagcgacactccgaaatatgtattaatccctgcgtgtgatcatcgagttgtacaaaagcaccgtatggttgaatgccagttacggttccttgcacaatctcaccaatatgataagccataataacctcctccaattagtttttcttattatatgtatctcgggtttaccccgagtgacaaccttatgcaattgttgccttgataatcttgatatcttcaagtggcttgtctgcgtagttaacacgaaccttagccatgtcgtcaacaacatccataccttcgataacgtgaccgaatacagtgtggcgcttgtctagccatggtgtaccaccttgctcaccgtatgctgatacaacttcatcaggtacaagcccctttagttgacgcaacatgttcgctggtacacgtgaagcttgcacaataaagaattgtgaaccgtttgtgtttggaccagcattcgccatagacaaggcaccacgcaagttaaagacttcatctgcgaattcatcttcaaaagaatcaccccaaagtgactcaccacccataccagttccagtagggtcaccaccttgaatcatgaaatcactaatgacacggtggaagataataccatcgtagtaacccttttcaatcaatccaacaaaattctctaccgtctttggcgcttgggctgggaataattgaatcttaaccgtaccctttgttgtttccaaaacagcaactgggccttctactgcagccaaatcaaattgtggcaatgccatatcttcattctcctctaaatcttaaaattcactgcttgtattataacataaatattaaggccactcacactgccccaaaaacatggtaaactagaatctagttgtcaacagacattcaaacagattactgggagtaaacaaatattatgatgcacattatcgatttgttcctgcaccttgatgttcatttgaacaatctggttaacgcatggggcatttggtcatacgtcgcgcttttcgctgtcatcttcattgaaacgggatcggttatcttcccattccttcctggagattcactattatttgcagccggatcaatttcagctttgcatggtagtatccttaaccactgggtactcatgatcatgttctggattgccgctgtatctggtgactcactgaacttcttcttgggtcgcacggttggcttgaagttagttaagcacccactacttggtcgcttcattaaggacgagcacttggcggaagcaaatgatttcttcgttaagcacggtaagatggccgttattttgggtcgtttcttgccaatcattcgtactttggtgccatttacagctgctatttcaggtttcaagtacaagaacttcttgatgcttgaagtcatcgctgcaacaatttgggtcgttgtcgccgttgaagccggttactacttcggcggtatcccatttgttagcgaacacttctcattggttattattggtatcttggtggtaacggccttgcctgctatcatcagtgcagttcgccaatcaattatcagcaagaagcaaaagcaaatggatcaataattctaaaaagtcgcgattggtttcgcggctttttttgtacctgtatgtgaaaaaaagaccatccaacttgtggatggtctttttaactataattagtcagccaagtgctcggcttccaacttagtagcttcttcgtcgataacaacgttaccggcttcgatttcttcaaaagcttggccgattggcttaactgaatcaaagtgtgccaacgttggcaatgcgccttgctccaattcgtgggcgcgcttagctcccaaggcaatcaacttgtaacgtgagtcaacacgttccaacaacttatcaactgatgggtataaaatcatgattctagctcctcaatcattgcaatatattctggcaacacacggttaacgcgcaaacgttcaaccttgataatatccttaatacggtcaaccgccaaaggcacttcgtcattaacgacagcataatcataattagccatcatacgaatttcagcagttgcagcagagacacgacggtcgataacttccatcgcttcggtaccgcgaccgatcaaacgttccttcaatgcaccaagatcaggtggcgtcaagaagatgtatgcaccttctggcatcttttccttcacttgcaaagcaccttgaacatcgatttccagtaggacgtcgcgaccggctgccaaagtcttttcaataaagctctttggcgtaccgtagtagtttcccacatactcggcgtactctaacataccgtcgttggcgatttctgcctcaaactcttcacgagttacgaagaaataatcctctccgtctacttcacctgctcgggggtgtcgtgtggtcattgagattgaatattgaaagtcgatgtccgtctcttcaaacaacgcctttcgcacagtccctttaccaacacctgacggacccgatagtacgatcaatacgccacgcttcatggtactcttactcctatctttttctctagctaatcaattttatattctactcgttttttccgacttagacaacaagaacaacacggcacttaggacaacatccaaattagccaacatatacgttcgactaatcgtgccagtcggcattggtagcatatcacgtttttctttaccagccgtaacaatggcctcaataaaggtcgttaaatcatactcgactagcttatcaacatctaatagtcttgctaaacgttcaatcgtcgccagtccttgaccagctgccgtctccttttgttccggatcagcatcgcgacgaatccattgctgccaggccaaccaaactggtagatccgtcaaaagcgccgcaatcggtgctgtcacagggtcagtcgccaaccacttcactaactgactaccacccaaccaactaaaattaacatcaactggcaaagcgaaatagtaaccacccagttcaccaagcacttggcgcgttctgatttcaccaagacgcacataggtggcactcaagtcagggaaaaaatctagcaatggtccgaactgccacggcgttcgaatgaagtgaaccactgcatcctctgggcgatcccagttttcagggaccccatccataattgataccgcataaatttcctttgcaccatgatcagctgcaagattaattggcaaattattcgaatagccaccatcgatgtattgcttcccgttaatcatcactggggacacaactgggtaaaacgcactcgatgctagaatccaatcggtcaattcgtcagctgtggtttcatccgtcacactatacggtgtggcctttagcaacgggaactccgtggctaccagcgtcatttctgctaaccttggtgtcgctaactcatggacaacaaccggataaatcaattcgcgtaatgattctttgttgaaatagtgtcgaccaactaagtgcgtcgcgattgtcttcgtaaagtcagttctagaaacaccgacttcatccacctcatacacaacatccgtcgtcagcgtgtcccaagtatggtgtgagatatcactattcaaatgcataaatgacatggcattgattgaccctaccgaaacacccaacacctcttgtggcacaataccgcgtgcttttagcacatcgaatacacccgcttcaaatgcaccgtgtgccccaccaccaccaagtaccaaggcaactggatatgcaaaatcatgccgatacgttaactcagccacccggttaaagccagccaacaatgggctatttgtctgatttggcgctacctttatggttagtgatttcacgcgttgcttactaaaataggtgattaattgttcaaacaacgccaaacggtcgatcgctttccaacccagagcactaattagtgtcacatcaccatcttgctcacgataaaccaccgcagcttcaatcgcatcatcatctgtcacaaataacaagccctgtgcatcagcgcttgtcgcattgtatctgtcacgagcctcagctgcatcagcatacatatttagcagttgtccaaatggcgcaatttgttgtggtgttaatttacccactactatcggcatatcatcaccctcactctcaaaataatcgtatctttattctagacactttatgtcagcatgcaagttttgcgtttaaaaaaaccaggacccaaaagtcctggttaatggttctattcacttcgcttagcaaacgctcgttgaatcaaatcacgggcattttctttggctgcatcggttaattcatccccagacaacattctggcaacttcgttaacacgttcatcctctgaaagtgtgtgaatacttgtctcagtacgatcaccaaccacttgcttttcaataaagtaatggttatcagcgactgccgctacttgtggtaagtgcgtaattgttaatacttgtgaataacggccaatcactgcaatcttttcagcaatggcttgcgcaacacggccagacaccccggtatcaacctcatcaaaaataattgacgtaataccttgttcgcgtgaaaagatcgtcttcatcgcgagcatcattctcgaaagctcaccaccagaggcgattttaaccaacggcttagcaccttcacccgggtttgtttgaatataaaattcaactgcgtctaatcctgtggcattaagttctttcagttctgtgatgtgcgctgagaaaactgccttctccatgtacaaatcacttaattgttcatgaatcttcgtcgctagctgcttggctgccttaagtcgtagctcatgaagtttctcagctagtgtacgggccttttgctcagcgacttcaacttgctcagctagttcagctgctgattgttcgccaccacccatttcagccaattcagcatcaactttcgcttggtgtgccaatacgtcggtaatggttgcgccgtacttacgttccaatgagcgaatcaagttcaaacgatcatccacttcgcgtaggcgttcttcatcaaattccaaaccatcccgtactgacaaaatttcagacgctgcttcctgcagttcgtaatacgcaccgcgtactgcctcagttaacgttgcatacttaggtgacaactcctcgatatcttccatcgcgctcatagcagtagaaatggtctctagaccgttgttatcccaatcgccgtccaacgcttcatgcgccttagaaagggctgccaaaacgtcttggaagttggtgagttcttgatactcagcttccaacatctcttcttcgccttcaaccaaactagcatccgccaattccttgctctgaaaactcagcatatcaagacgttgcgcccacgcttgttcgtcagcctgacgcttatggaatgcactttccagactacgataggtatcgtacgctgcacgatacttctctagtaccggtccaatggtcttcttcccatactcatccagcaatgataaatggcgctcaacttgcatcaactcttggtgttcgttctggccatgaatatcaaccaggtgctgaccaatttccttaagtgtcgtcgcattgactaaactaccgttaacacgaatgacattacgaccacttttatgcaattcacgatgaattaataattggttatcttctagcgggattcccaactcatcaagtaattgtgtaatcggttggcccggctccacatcaattaaaccctgcaagaccgctttatcagcaccctcacgaatgaaatcttgtgaaccacgaccgccggttaatagaccaacggcatcaataataattgactttccagcaccggtttcaccagtcaaaaccgtcatccccggttggaagctaatgttgagctttggaataatcgcaaaattttgaattgataattcttgtagcatagcctgctcctcttccgttaactaagcttgcgccgtcaacttatttgcaaagtcctttgcaagctcaccctcacgcaaaattaccaaaacaccggcatcgtcaccaatcagtccaaagacttctggcaaattagcttcttctaaggccgtcttcagagctggaccagtaccaggtgctactttgatcataatcatgttaccttgcgttgcgacatcggtcgtcgtctcttgcaaaatgcgacccaactgaccaaagtaatccgcccctgacataacagcgtaggcaaagccaccagtaggtagcggtaccttcactaattgcatttccgtaatatcacgtgagattgttgcttgcgtaacttcccaaccagcttcattcaatttacgtaccaagtcttcttggcgttgaatttgctcgttgctaatcaacgtcttaatggcttgttgacgttcttgcttacttcgtctcatccgtcttttcctcacgacgtgcattcaattgtgcgtgtgcaccagccactacggcttcacgttcagcttcagacatcgtactatcaccaccatcaagaaccaagtgcgccaagaactcaatgtttcctgaaccacccttgattggtgaatagtccaacccgacaatactgaaaccagctgcctttgcatagccagccactttatcaataactgctaggtgtgttgcagcatccttaacgatgccgtgcttcccaattgcttcacgaccagcctcaaattgtggcttaatcaacgttgccactgaaccacctggcgtcaaaatatttgagagtggtggcaaaatcaagttcaatgaaatgaatgacacatcaatcgttgccacttcaggttgtccttgcgtgaaatcttgcaattctgaataacggaagttggtgttttccatcaccacgacacggtcatctgaacgcaatttccaagccaattggtttgttcccacatccagtgcgtaaaccaacttagccccgttttgcaatgacacatcggtaaagccacctgttgatgacccaatatccaagaccgtcttgccatcaactgagatatcaaacacatccaaggccttctcaagcttaaagccaccgcgtgatacatatggcattggtgcgcccttcaagtgtagctcagtcgttaccggaatcttctcgcccgccttatccatgcgttgctcgttttctcccaagatttcaccagccataattgctcgcttggcttgttcacgtgaggtaaataacccttgttgaacagccaaaacgtctactcgttctttctcaatcgccattatttctccaatgtctcgttaaagtaatccaaaaatgataccaacagtgtaatgtcgttacctgtcaattcaccaaacttttgcaatgcctgattagcaaggttaacttgctcacgcaatgcatcaaccgcgccttgtacaccaagcaacgttggatatgcttgcttgtcctcatcatcgtcctgaccaagatcatccaaatcatccttaatctggaaagcaagtccatatgccatgccgaagttccaaagttgttctttgactgcttctgatgcatgagccatgataccaccagcaatagcggcatatgcaatcaacgcactggtcttgcgatagtgaatggccttcgcttgatcgagcgtaatcgtatcagcattcgtcgctgccatatccatcacttggccagccaccataccgttggcacctgatgccaaagctaattgtagggttagctccgccttttgtggtgttgttaatagcgggtcactagctagccattgataagccaacggttgcaaagcatcccctgccaaaatcgccacatcctcgccaaattgtcggtgagtcgttggcttgccacggcgcatatcgtcattatccattgcaggcaagtcatcatgaattaagctgtacgtgtggattaactccaatgcacttgcagcacggaccaaccccggtacacccataccgtaagattgtgccaccgccaatgtcaacaacggacgcaatcgcttaccaccagccattacggcataagtcatggcatcacgcagtgtcttttccgttgtgctttgcttcaattcggttgccaaagtctcttcaatctttgggacaacttcactggcaaactctgttaaattcatactacgcctcgggattaaaatctgaggttgaaccatccgcattaacaatctttgccaagctttgttcagccgtttgtagtgtcttttgtagttcttgactcaactttacgccagtctcaaactccttcaacgcttcttccaaaggcacatcgcccttttccaagcgggcaacgatttgttccagcgttgccaagttttcttcaaatgttttttctgccattattctgtttcttctttcttcgttaccgtcgctgtcacttgaccatctgccaatcgaatcagaacatcttcttgcaatgtcacatccgccaccgaatttaggatatggccatcctgttcaacaacgctatagccacgagccaaaatggccagcgggctaactaattgcaaccctgcaacggctttaccgactcgttgttcggcattttcagtttgacgggtcatggcatttgttaaacgcggtgcaatcaaatcaaattggtgacgtcgttgcgttaccaaagtcacaacggattgttggagtcgttgctgcgcaatgtctaaacgttgtaagtacccctcatagaggcgagccggttgtgtcaaaacataactgttttgcaaccgttgcaaccgttcttgtgaattaacgacttgtcgttgcatttggttaaccaaccgttgttgcatttgctgaatgcctaaccacaagtctgctaatggaactggcgtggccaattcggcagcagctgttggcgtggccgcgcgttgatccgcaatgaaatcagcaatcgtcgtatccgtttcgtgaccaaccgagctgataattggcatcggcatcgtcagcatttgccgtgcgactgcttcctcattaaacgcccacaaatcctcgatcgatccaccaccacgtcccataatcaaaacgtcgtagtcgcccgcttcagcaaccgccgtcatctgggcagttagtgatggtacagcgccatctccttgcacaaccgccggatagaggacgatttctgcaattggataacgtcgttgcactgttgtcataatgtcacggatgaccgcaccacttggtgatgtgataaccgcaattttctttggaaagcgtgggattggacgttgcagttgattaaacaacccttcctcagccaatttcgctttcaattgctcgtaggcctgatacaacgcgccgaccccgtccggttccagcttatcaataatcaaactatacgaaccgttcggcgcatacaaatccatgtgtccgacagcgttcaccttcattcccggttccaacttgaactgtaacttttggaaagcgaacttgaacatcgttgcgttcaaaacggcaccatcatctttcagtgaaaaatattgatgcccaggacgttggcgataattggaaatttcacccgtcacatagacctcttttagatagggatcggctgtgaatttacgctttaagtacgacgtcaacgccgacactgttaaatagtctgccatgggtcctccaatgcaaccccgtggtgttgtgcggcaagttcaaccgtcgtttgtagcaacgttgcaattgtcattggtccgacaccaccagggaccggcgtaatcaaactagcaactggttcagctgattcaaaatcgacatcccctactagtgaaccatcttcaaggcggttaataccaacatcaataaccaccgctcctgccttcaattctgatcccttaatcaggccaggaacaccagttgcaacaatgacaatatcagcctcgctcacaagcaattccgtcaacgatgctggcgtgtaacggtgcaatagtgaaacggttgcattggcaccttgtagcaaggcagccattggacggccaaccaaaattgaacggccaatcacaaccacgtgcttacccgccacatcaacaccttcgtgctgtagcatcgtcatgataccgcgtggtgtgttggcaactggatagtagccttcacggttagcatacaaacgaccgatgttttctgggtggaacccatcaacatccttacgtgggtcgatagcttcttgcaccttgtgttcatcaatttgtgatggcactgggctttgcaccaagatagcgtcaacgctatcgtcagcattcaattcagcgattttggctagcacctctgcttctgaagcatctgttgggtacttaattgtctgtgcattcacaccgaccttaccagctgcacgttccttattgcgaacgtaaatctcactagctgggtcatccccaaccaaaataacagccaaccccggtgtaatcccttgcgtcaccaacttttcagtttgacgcgcaacggctgcacgtaagtccttggcaatttgcttgccgtcaattaactttcccatggtgcacctcacttttattcattatcaatgcataaattttaccacaatctatgccgttaaaccatgaaccagtccaagcaaaaaacggctgagccctttaaaaataagggttcaaccgttttaatatactttaaattcagaaaatcattacccaaaatcaataatgaataaagggtgcccactacttaacaaaccacgtgtggtacaacttaataaacaacgttcctagaatcgcaatgaccaatgtattcgctagcattgccatcccagcttgagcgtacgccttaccaagcatcgtcccataaatccagtgatcaccaagcggtgcaataaccaaccaaacgacagcattcgcaatcagttgccaaatgttgaataacaccagcttacgtgatgtcaattcaccgacgaaaataccaatacgtgtcgttgccagccccataaagaagccaaacataccgtcggcaattgcccaagtccaccaaactgaatccaagcttgccgatgacgggtcagtcaacgaatgtccaatgaatgccacaatgaacccagcaattgggccaaaaatagctgacatcaacgccaaccaagctggcgccaacgtgatatctgtatgtgcaacgcctgaaggccaggcaatatatttaaacagcaccacaaagacaatcgtaccaacaattgtgccaatcaccttgtgtgctgacaaaatattatgattcatggaaccactcctacatctagttttcgttattcatgactgtcattcaagacaaccaagttttgtggcaaatcttgcccgttaagttgctgataatactttcggaaaacagtattatatgaaccctcactcatcaagttagggttcatcgcaagataacgaatcgttttaacttgcataatttctgttttattcggcttactgaagtcgttaataccaaccattggggacatcaaatcatttgcttgcccttggtgtttcaaagccaacgcgtgaccgaactcgtggataattgtatgctcagcttcctggttgtgcaagtcctcaatgtcccttgatgttaccggcccgtatacggcaccagacagatagtcttcacgttgaatcgtcttagctaaccacactttggcagcttgctttgaaatccacatcgtattaccggcttcagtggtcgttgccaaaacagttgtatccgtcttaccaagatcatccgtaatatctttgtagccaatcaacaattgataatccgcatcatctggccagacgttacgatcaacattctcgtgttggttagccttagttgacgtgactttaataaagtcgacccctaatgccttattccaaacttcagccgccttgtttacccaaaccaacgcttgaccatctgtttcactcattgccttagacgacacaacgaccttcatctcaccatcagtattcaaatcccaatgcgatgtgcccggtaacttatcagcatcagttgcacccatggcagcctgttgcttaccgactttagcaatatatgctttctcttgcttagctgccgtattagcatcagccacattcatatagtaacgaataacttgtggtgcaatcaacaccaacaaaataataatcgtcaacacgattgccaatcgcttgttacgactcatccgcttccttcgtgccatatatactctacctcatctcaaaacccaaacctaaaacgctactcgccgtcctctgcctcttcagccggtgcgttcttttgctcttcaattgcctcgttaattgcagtcagttccttatcaaagaaggcagcaatttttgcttctaccgtttctggatcatccaaaaacgccgcgacagttgctgccgtttcaatacgtaggccagactttgtcactaatgggtgttccacaatcatgtaaagggtcacatcagtttccggatcattaatcacaatcttgctaatcgcatttgtgtagcgaattggcaaattaatcagaccggtttccaaacgcaagctaattggctcatccccactaataagcaattctgcactgaaaagcttgttatctgccaacgccttttcagcatatgtaaacaaatcgtccaaattaacagttgcttggtctgccgcggtaaacgacttcacctcatactgttcatccttaatcgctgcaataaaatcatttccagttaattgcatcatatttctcgcttttcattgatatctaacgattagtgtagcataaaacaggccgaggtttgttttcctcggcctgttcttaacttaatctgtaattggcgtaaagacatggtccttcaacaaaagctgttcatcggcctgcttggctacttcacgatcgtgggtaatcaagataaccgtcttgccaaattcgtgggctagttcagcaaagagcgcaacaatcttttctgaattttcgtgatccaaatttcccgtcgcttcatcggcagccacaatcggcgcatccactaacaaagcgcggacaattgcgacacgttgttgttcaccaccagacaaacgttgcacattcttttgtgccttctcttcgtcgatcccgacgcgggccaattgttccaagatatacgtcttatcatttgcatgctttgacttcgtaatggccaatgccgtttggacattttgaaacgctgtcatcgtcgtcaatagattgtatgactgaaaaatcgttgagacgtacttctgtcgaaaagcggttaggccaatcttcttgattgaaacaccgtccactaggatatcaccttcacgtgggacatctagccctgccaaaaatgaaagcaacgttgtcttaccagatcctgattcaccgacgatggcataaaacttgccactttcgaaggtcagattaacatccttgtacaacgcattgtccgccgttgtataccaatgcgttaaatttttaatttctagcgtcattattattcctcactaatcggcttgcaaaatttgctttggtcgcatacgcaagatactaaaggcggcccctgataccgaaagcaccgcaatcaagaacgcaacgccgcccaattctgcaattgctgccggcgtcattgcgacatccaactgttcatttttagcagctgcaccgccacccatcattgggccaccgcccatgccgccactaggcttgcctgatggcgcaccaccttgttgcccgttttggccaccacctggcatgccaccacgcgctgattgcatttgttgggtcgtttgttgttgtacaagttgcttaccaactaagccagaaacactattaccggctgctgttgcaatacctagcgcaattgccaaaataaccagcatttccgtgaacaattgggcaacaacctttggcttagactcaccaattgataccaagataccaatttcacggcgtcgctcgcgggtaatcaaaataataatcaaaccaagaatcaagacaccggcaattgacacaatccaaacaatcttagaggcaaatgctgccacgttcttcatacttgcagccaccgtcttgtattgacttgcatcagacgtcaaagtaagttctgacgtatcaatcaacttcttggcttgcttcacaaacgctgttgttttagcaggttcagccatcgtgaacgtcacgtttgatgcttgatctggcgtaccattaatatcattagccaatgtgaatgatccataaattgtgttagccggatcttcccgttggaatccgtcggtcgttgtcttcaacttgtaaatgccgacaaccttaacggtcttttcagtcgccgcatcatccgttgtcttaacagtcaacgtatcgccaaccttaatgttgttagccgtggccaattcatttgcaatcacaacattattggtgttttggtcactcgtcttaatgccacgacctgatacgattttggctgtgccatcagaaaatgaagccgttgacgtggttgacgtcacaccattgatttgaatgtcacctgaattttgattacccatcatgccaccacgatcaccaccacccatcggcgtattcgttgatgtggttgtaatcgccttaaaacttgaggcgtttactgaggcactattcgtgatgttgtatgaggcgacgtttgaaagcgccgcaatcttcttaacctctgaaatcgttgccgttggcatcgtaatcgacgtcgttgtgtctgaagatgacgagtcactagaagaagattcggatgattgcgccgccttcatctgctcaaacattttctctcggttagccgacaacgttactgttgatccaactgaattagcggcattcgtggctgcttttagggccgcgttttgcacaatcaaaccagccatcacaaacgctaaaataaccgttgatgtgaggactaacaagaccgagcgcccttttcgcgcccacaatgtgatacctgctcgttttacgaaattcatgttacttgtcgctcctatcattgtgtcgttgcgctacttgctgcagcatcatcgattgaatttgactgtgattggttaccataaccgcccatcggaccaccattaccaccaaagcccccagtttgctgggtcatatttggtcgacttgtttcacctaaaccaaacggatgaaacgctgcaatagcactaaacgccattgctaacgtggcaatgccaagcgtgacgtactgcaaccaaggtcgttgcttcttttgttcataacgatctgtcatatcgctatcctccatctattttttgacaaggcttataatatgagtccaagcttaggcgatacttcacgggggctaaaagcaaacataaatttttatgtctttcgaattgttagtggaaatttgggcacaaaaaaacgccgtatgacacaaaatcgtacggcgtttaatttatgcaatctaatgattacttgttaacggcttccttgaagtccttaccagccttgaaggcaggtgcctttgcggctgcaatttcaatttctgcaccagtttgtgggttgcgacccttacgtgctgcacgctcgcgaacttcgaaagttccgaagcctaccaaagcaaccttctcgcccttagcaagttcgttcttgataacgtccaacaatgcgttaactgtcttagcagtttctgactttggcaattcagtttgtgctgcaaccaagtcgatcaattctgtctttgaagccatgtgataatacctctttattaattattacctgattagtatacgctatgcatcgcaaaatacacagctttttgtgcgaaattactaagcggtcttagtgaatttttaaaaatgtatgcaaaatacatacctataaaaagagaatgccgctataactggcaagttacagcggctaagagagagaaagagaattggttgtgtaaagcatctctgctttacgagtattaatataacaccccatgtatacgtttgcaaccaatgcccccgcctattctcctattagtcggatttcctacacaaacggcacaatttcttcacgattggtcaactttgcaccagctgcctcatcgataataactgtgacatttgcatgcttttgcaagatacttgcaggcatgtcttccgtaactggtccttcgatcatcgctgccacagcatcagccttcgctgccccgtaagcaaccaacaaaatttccttaaccttcatgatgctaccgattcccattgagtaggcgtagcgaggcacttcgtcttcgtgctcaaagaaacgcgcatttgcttcgattgttgactcagttagcgtcacttcgtgcgtcaaagaatcgaatggcgtaccaggctcgttgaacccgatgtgaccgttttgacccaatcccaagatttgtagatcgattgggtttgcgtcaatgataccttcgtaacgcttcgtctcagtttcagcatccgccataccgtcagggacatagctctccttgaatggcttagcattgaacaagtgctcgttcatgaagtaacggtagctttgctcgtgcgtaccaggcaagcccttgtactcatccaagttgattgaaatcttatctgagaagtccaagtcgctagccttcaactcatcataaattgagattggcgttgaaccagttgccaatccaaaaacgtgtgcgccattcttaacagcctctgcaaagacatcgtatcctgcgcggccaccagcttgttgatctttaacttgtagaatcttcattttatttccccttaaaaaatgcgttctgtgtttttatttatctttggtatagaccaattatagaccaatttctataccaattcaactcagaaagtctttttttgtttgaggtttagttagttagttggtggttagtgtcgtcgctatcgcgccgaagcatgggatttggttggggaggcggtgctccgtcctacaatataagctggtggcaacggagtcccattctcactaagcctcagcgtgtttcagcgcctgccggcttgaaatccactgctgctaagtgacaattggtgctcctgtccttgcttggtcaccggctaatatcgcaggagatccgcaccaccaccccaaacaaatcccatgccagcagccaagctgtattattctgtctaagattatcatccactgggaaatagatggataaactgttcaccctgcagtttttcggtggatgattatcgaacaatcagagtattactcggctgccggcatgagggctgggggctatcggagcgttcaaatgagggcaacatgccgcatggccggcgctattcagacaagtccactcaggatttgaataattagggggaattatttgccccgctgaatggcgtccgcgccattcggttgcccccgtttgaactttgtcggagatagtccccagccctcatgcctcgacgcaacgcgtcgacacacaccacaaactaaaagacctgatgtcaggaattccccaacatcaggtctttaatcgttaattattatcccttaacggccttttccaatgtctccattgcgcgtgagtgacgtgcaatatctgacatcaactctgcttcaaaggcatcaacagactttgacttcgtgtccgttgaaccgaagcgacgaatcgtaaccgtgttgttgttaacttcttcatcaccgataaccaacgtgtaaggaaccttagacgtttgggcatcgcgaatcaagtaacccaacttttcgttgcgatcttcgtattcggcacggataccttgcttgatcaaacgatcagccaagtccttagcgaacttaccgtgggcatcgcggttaacaggaatgatacgtacttggtgtggtgccaaccaagttgggaacgcacccttgtacatttcagtcaagtaagccgtgaagcgctccatcgtagaaataattccacggtggatcataactggacggtgcaattcaccatctggtccaacgtaagtaacgtcgaaacgctcaggcaacaagaagtccaattggatcgtagacaacgtctcttctccacccaaagcagtcttgatttgaacgtccaactttggtccgtagaacgcagcttcaccttcagcttcgaagtaatccaactccatgtcgtccatggccttcttcaacatcgtttgagccttgtcccacatgtcatcgtcatcgtagtacttttccgtgttttcagggtcacggtatgacaaacggaaacggtaatccgtgatatcaaagtcagcgtaaacatcgatcatcaagcccaaaatcttcttgaactcgtcttcgatttggtctggcataacgaacgtgtgaccgtcgttcaacgtcatttcacgaacacgtgacaaaccagtcaaagcacctgacttctcgtaacggtgcatcattcccaattcagcaattcggaatggcaactcacggtatgaacgtggcttgtgcttgaacaccatgatgtgagatgggcagttcattggacgcaattccaagaactcgccatcacccatgtccataggtgggaacatgtcatcgcggtagtgatcccagtgacctgattgcttgtacaagttcaagtttgacatgattggcgtgtaaacgtgttggtaaccgtcttgcacttcgcggtcaacaatgtaacgctccaacgtacgacggattgcagcaccgtttggcatccaaacagccaaaccagcaccaacttcttgagacgtgaagaacaagtcttgctctgcaccaatcttacggtggtcacgttccttagcttcttcacgacgcttcatttcagcatccaagtcttcagccgtccagaatgccgttccgtagatacgttgcaacattgggtttgaagactttccacgccagtaagcaccagcaactgacgtcaacttaaagtgcttaatccagttcgttgatggtaccaaaccaccacgatccaattcaacgtgctcaccttgcacagcgattgagatgtgctcatcggctggcaaatcgttaatcaattcaatcttgtatggatcgttcttgaacatctccaaagcttcgtcgcgcgtaatctcacgagaaacgattggcaagttttctgaagcaatttgcttcatcatcttttcaatctcaggaaattgctcagctgaaatttggctaccctcaaccttatcagtatcgtagtagaaaccattatcgatggctggaccaacaccgtagtgaatttggtctgggtacaaacggttcaaagcttgtgccaacaagtgagaaacagagtgacgcaacaattgcaatccttctgcatcatccttggtaatcaatgaaaaggcaccatcttcttgaatgccatcgttcataccaacgtagtgaccgttcaacttacctgaaacagacttcttagccaatgactttgaaataccgttagcaatttccaaaggcgttacgccagctgggaattccttcacagcaccgtctgggaatgtaatctttacatctgccatattgtgtaatctcctatttaatctgcgtgcgacttgacgcgcgaaaaacaaaaacgtcccgttacaacaattatacttgtcgtaacgggacgtttgcacgcggtaccacccgaattcgagagggttccccctcacctcatcgtcccttaacgcgggaaacggaactggttcaccagttcgcttggaagtagtaccgttcaacgaccgttatttgcctcccaccaatggcaaactctctaaaaacaatcttgttcaacgacttatcttcgtcaacgctttattcttaacttattatactcgaaaactagaaaaatgaaacccttaactattgacgcaacgattagttaacgccttcctcttcgccagggttaaaccatgacgcgtgggcatttgtcttttgcaaggttaggtcgaaatagtggacaaccttgtctggtgcattatgccattcccacttcttgtccaaagatgccttcgtaataatacggtattgcgtacttgggaataagcaactaataatggttaattgtggcgattgtgtttgacgcaatacgtcagtatcacctttgttaaccagaatttggcccgtaaccttatattcataaatgcctgatcgattggccatatagattggctgaccattcaaccaatcactgcccttcaactgaccatcaacaaggtaaggggcatcctgattcaggcgctcctgtaaggcagaaaatccagttttaccatcattaaaattgtggctggccaagccgtaattgccttgccccatgacgggaacctggtcaccatccggatcatctaccgtgcgattagcatagttcgcgccggcatccagaccaacttcactgtatgcattatcgaaaattggttgcaaaatgcctagtagcggcatgctaacgaacccttgcttatgtagtccctcatcgcggtgtgtttccttcatcacccggtcaacaatggcttgtcgttcaggttgcgtgattttctcatttgacaccttaacccgttgcttcaattcttctcgttgaatggtgccccggatatttaacgtattttcttgatatccgtaataaccacctgctacgacgccccctaccaagaccgccggcacaacgcgccgtattagctttcccattaggcgtcctcctcaaatgtttagtcattctattctagtgccaaaagtgattgcggacaagttaatcagtggcaaattacttctaaacgaacaaaaagattggcttctgcaagatgccaatctttttttaactttatttgatttagttattgcaacgttacgcccgcttcacgcgctagttgtcgcaattcagaagattccaaatgcaaatccgaacgtagtcgcccaaatgaaattcccggtttgttggcgacacgatcttgaatacgcttgatttggcgctcacgatactcactcttgtgggcactttcgttttcaaccgtcacgctaaactctgatgctgcagacgttgcaaaggtatagttcaattgtccgacccctgttgacattgatgtaaagttagccattaatagccccccaataaccgtacattgacgatgttttctttaagatagttcttattatactctattgttcgtaaaaatgggattatttgtttcggttcactgattatcgttcagaaataaagaaagaatccgatgtttcagataacgaaacatcggattctttagttaattatcgtaattcaacgccagcttcacgtgcaagttgacgcaaatcagctgtttccaaattcaaatcggcacgcaaacgcgcgaacgtgatgtccggcttagttgccacacgatcacgaatacgcttgatttgtgcttcacggtagtggttcggacgaccacttgcattttctacctttacgccaaactcggcggctgttgatgttgaaaatgaatagttcaactttccgacaccagtcgacattgctgaataatctgccataatgtttcccccatatgactatctctaatttagaaatatcatacaagtcatatatggctgaattgtgatttgtttctgaagtctaaagaagcaaatcttgcccgcgaagtcaaatattaaaaccggcagctgtaacgaaacaactgccggttttaatcatcatgtttattatgcgttagccttttcaatcaaagccttcgtaaatgcttgcaactcttcagttgcttcgacatctgggctcaagttaaccttaacaccatcggcacccttagtagcacctgacttctcaaattgtgcttcgaacttgtcgatagcaacggcaaagtccttaccgtagaagtcatcaccagaacctgaaacaccgtagacaatacccgtcaaatcagcgtcttccaagtcctcaaagaagtccaatgactcatcaggaaccgttcccttatcaaacgtgtaaggtacaaccaccacgatatcagtctcatcagctgaaatgtcgtgtgggtcaatcattgagatatcttccttcgtaacttcaacaccttctgattcaaacgtgtcgatgataacgtccgcaacatcttcattgttaccagtaattgtagcgtaaaatacacgagccttcatgataatctacctcttttaaaatctgtcatttcgtatttgttgatacaagtatattgcgaatacgaaacactttcaaattaaaaggggtggttatcatattcaatccatgattcgtgtgaatcttgaatacgcttaaacatcttttgcatgtccaacgttgagaacgtgaccaagactgggcgtccgtgtgggcagttgtatgggttttctgagtgtgacaattgatcaatcaagcccttggcctcaaagtcattcattgaccagttagccttgattgaacgcttgcaggccatcataatggcggtacgctcacggaattgggccgtcgtcaaattaccatcacgcaaaatccaatcaaccatttcacgaatcgtatcttcttcttgccccttctcaaaccagcctgggtgttcacggacaatcaccgcgtcatccccaaacggctccaaatgcaagccaaccttagccaactctgcttcgtgggattgaatcttcaagatatcaatcttagggtattccaatacgattggcactagcaacttctgcatttccatgccgaccttaccaatttcctcacggtagtattcatacttcacgcgctcttgggcagcgtgttggtcaatcaagtacaaaccttcttcagactgggcaaacaagaatgtaccgtgcatttgcccaatataatcgagctttgggaacttttgaccgtgttcatcaacagccgtgatggtgtcgtccttcaagtctagtgattcttgctcagccgccatcgtcacgcccccttcatcaaaggggttcactgcatcggcatcttgatacttttcagcgaattcactcaccgccgtgccttccagttcatccgcattatgcaccacaaccggcgcgatatcatcaacggagaagttatccgccaacttttcataatccgccgtcgacataggtgctgggtgattggcaggtgtatccggcgcatatgagctaacatatggctttgacgcttcgtttagttgcgccaagaacgcctcgtcattttcagctgcgttttgctcctcgcctagatagttttcataggcatttggaatcaaattctggtttgcaaaacgttccttaactgtgcgctcaatcaaatccatcaactggctttccttagaaagacggacttcatgtttttgcgggtgcacattcacatcgaccaacagtggatccatcgtgatttgcaaaaccgcaattgggaaacgaccgaccatcaactttgatccataccccttaacaagcgcacgactcaagttaaagttcttgatataacgtccgttaatcaaaattgaaatgtatgaacgatttgcacgcgtcaattcaggcaatgaaatatacccatttaattcaaagtcgttgtcctcagcctgaattgccaacatcttacgagcttgttgtacaccgtaaatagacgcaatgacctgttgtagattgccgttacctgctgtacgcattacttcgttgccgttgtgtgatagacggaatgaaatatcaggataactcattgccaaacggttaatcacatcgacaatctgtgctaattcagttgattgtgacttcaagtacttcaaacgcgcaggcgtattaaagaacagctctgacacggtaatgtcagttcccttacgtgctcccgttccgacttcttcaagtaactcgccacccttgtagtgcacgcgcgttccttgtggtgcatcagccgtagccgtttctaaaacaacatccgcaactgacgcaattgatggcagagcctcaccacggaagcccaacgagtggacacggaacaaatcattacgtgacgtaatcttagacgtcgcgtggcgcaagaacgccttttgcacctggtcagcctcaataccatcaccgtcgtcaataatgcgaatcgactttacaccagcttcttcaactagcacgtcgatctgatgactattggcatcaattgcattttcaaccaattctttaacaacagatgcaggtcgttcaataacctcaccggccgcaatttggttagctaaaatatctgataattcatgaatttctgccataacgcagccctcttattacttcatttgcttttgccactcatttagtttcatcatcgcatcaagtggcgtcatcgttgcgatgttggtttgcttaatctcatccaaaatggcttgaagggctgggtcaaccgctggctccaacgcaaacaagtcaagttgcgtatcttcttcaacaactggttccggttctggtgcgactggtaatgctaccggttcagccaatttagctgacactggttgcggttgcactaacgtttctgaaatcgtgacatcttgcgcttccaagcttgccaaaatatcagatgcacgggcaatcaatgagtctggcaagccagccaacttcgccacgttaataccgtaactttggtcagccggacccgtcaaaaccttgtgtgaaaagaccaactcaccattttcttccgtcgcaccaacgtggacattgcgcaaatgatcaagctcatctgacaacgccgtcaattcgtgatagtgcgttgagaaaagcgtcttagccttggtattgttgtgaacgtactcaatgattgcttgagccaaagccataccgtcatacgttgccgttccgcgtcccaactcatcaaacaaaatcaatgaacgcttcgtcgcattttgcaaagccgtatttgcttcggccatttcaaccatgaatgttgaatttcccgaaatcaaatcgtcagccgctccaatacgagtaaagatttggtcgaaaattggtagttccgcctcactagcagggacatatgacccgatttgtgccatcacgaccgtcaaggctagttggcgcatgtacgttgacttaccagacatgttcggccccgtaatcaacataatcgtttcgtcttcatccatgtagacgtcgttggcaacgtatgattggtgacccaataccttttcaaccacagggtggcgaccatccttaataaccaacttttggctatcaaccaatgtcggacgcgtgaacttatattgttcagccaccgtagcaagtgattgcaacacgtctaactcagccaacgttgcggccagcttttgaatacgcgcaatgttgtccttaatttggtcacgcacttccgtgaacaattggtattccaaatcgctcgacttcgtttcagcttccagaataatttgctcacgttccttcaactcaggcgtaatgaaacgctccgcattcgccaacgtttgcttacgcgtgtaacggtcagggtcaagcttaccaatgttagccttggtgacttcgatatagtaaccaaagaccttgttgaaaccaatctttaatgtactaataccagtcgcttcacgctctttagcttccaactcagctagccacttcttaccacccttcatcacatcacgatactcatccaaacggctgttgtatcctgagcgaatcacaccaccatcagtaacagaaattggtggttcctcggcaattgcctttgaaatcaaaatttcgatatctgaaaccggatccatgcgacgcagcaagtcaccaaagacagctggatctaaatcaccaagcgtcaccataatatctggtacttggcgcaatgaattacgtaattgcaacaagtcacgaccatttgccgtaccataagcgacacgtccagccaatcgttccaaatcgtaaactgacttcaacgtttcttgcaaagcagcgcgtgagaagaagtccttcaacaattcaccaatcttgtcatagcgggcctcaatggtctcgcgatccagtaacggttgctccaaccattgcttcaatgcacgaccacccatggccgtcttggtattatccaacaaccacaacaacgttcctgaacgctgttgcgtacgcaagttaaccgtcaattccaagttggcacgtgaattacggtctagcttgaggtattgggcgatttcgtaaggcgttgccatctgcaagtggtccagcgagcgcttttgtgtcgtaaacaaataagccaacaaaatatcagccgcttctttttgttctggcacttccaattgttgcgtcaaatatgacgtttccgcattagccggtccttcttcttgctttgaaaccaagattcctaagctcgtgaggttggccatcaattcatcaggcaactcggcgttcgtgacaatttccttcgtctccaaacggctgatttcattcaatacaccgttcgttgctgaaactgacgtcgccttcacttcaccagttgaaaggtccgcataagccaatccaaaaccaccaaccggcgtcattgataagctgaccaagtagttgttttccttggctgcatccgttgtattacgcatgcgtgttccaggtgtcaccagttggacaacctcacggcgaaccatcccctcagcttcagctgggttttccatctgctcaacaacggcaaccttataacccttatcaaccagaatatcgatatagttttgtgcggcgtggtgaggcacacccgccattggaattggttcagcagaattcttattacgttgcgtcaacgtcaactccaatagttgtgaccctaacaccgcgtcatcattaaacaattcataaaaatcaccgaggcgataaaacaaaaacgcatcagggtattgcgccttgatttcgttatactgtttcatcattggtgtttctttcggcttagccattatgcaaattttccttccccatcaaaatgtgcaaaaacgcccaccggttcagcgccggtaagcgttcattttttaatcttcgtccttgaacaaatctgccaagccagccaaaggtgtattcgcctgtgctggtgcttcttcttgcttttgttcaaaatcgtcttcagaaatgacagcccagcccttaccctcaggcattggttggtccttctcttcttccgtcaagacttgaagtggcactgacaaagcaacgtattccatcaacgcttgatcaaaatcaatcaacccatcttcaattaaaataactgagtcttcgatttcataacgatcagcgtgctcttcgttttgcaagtaaacttcatcgatatcgaaatcaacatccatttcaaccggcgtcaatgaacgcgttgatggcgttaccaacttacctttcacgtttgcgtgaataatgatgtcttcacgatcagcttgcgcaaatccagtcaccgtcaatggggtaacgtccaatacaacgtcaccaaaggttgccaacaaaggctccttcaaatcaacgacctcgctgaattgcaatgattccgtcttgtacttttggagttcagcatattgccacttcatgtgattatcctctttctataaaaactggaatacgtcccgtgtctaacggtgacgctttgtcctgacgtgtccgtgagaactgttgatataggcgaccagcccggtaatcaagcattaggatgccagttaggtcatctttctcaactttatgtatcaacggcaacgtgaatgactcacgttgttgcttcaaatagcgacgaccaactggcgttgcgcctaacatgcgcaagtacggttgttgcatcgccgtttgcatctcagcatccgttatgttcaaaacggtgtataacaatgtacgctgcaggcgtgcctgcgtgtaacgctttgacttaaacgtcgtcataaacgtttcgtagtcagctgttatatcccgttcaatggtttctttaagacggtaagctaacccatcagtcaattgataaatggtttccaattcatcaatcggcgtggtcagtaccttgtagcgaagcgcatcataccacgtttccgaccaatcagccgtttgcgcaccttgtgctaacaactcagctgcgggttgcgaaacatagtcagcaaattcagctgctggtgcctcctgattaatcaactcacgtagcgcggttgcactcgcgatgtgatcatctgaaagcgtcgtatcatgatatccagctttgatgcgctgaattggttggaggcgaatctgatccgctaaaccaagttcaataacggccgtagcgtaagcaaacccaagcatgtcattcggatccgtcaaacggaatccgacaacttctgccaaaacatcattaaaagctgttgcataggtttgtgaataatcagcagaaaaatggtcatccgctgccaatcgttcacgggcctgttgcgcaagtgctaagaaatccagctcagcatgctcggcaccaaatacgatacttgaaacaccagcgtcagctagcagttgcacggcaccacgcgcaaaaatatgtgcgggttgcacagcaaacgcaaagggcagttcaaaaacaatatcgaccccaccagctaaagcgaattctgtgcgacgccacttatcaaaaatggcgggtaccccacgttgcacgtagttaccactcatgaccgccacaactgtatcagcaccagtaaccgtctttgcttgggcaacatggtaggcatgtccattatggaatggattatattcagttactaacccaactgcctccatgttatcctccaagctttacgctttcgtcgcgttaaagaaccagcgtggtgactcatcagtcacctctgatcgaccaaagtcagccgtcacttcaatgtttgtaaagccagcttcagtcaacaaacgcttgtatgtgtccaaagaatatgtgcgctcagtgtgtacttcttgcaattgttggaagccatcaatgtcttcgttataaacaaagaacgtcaattcatgttccaccgtatgtggttgttcttcaacaccatatgatgaccacataaacgccgtctcatcatcatgccagttatacatataaccaggataataaacgtccgtttgccatggtgaaatcacatcgaacaagaattgaccaccatcttccaagtgttcagcaacttgcttgaacgccatcaatgtttcgtcttcattagccaagtaattaaatgaatcagcaaatgatgtaatcgttgcaaaacgctcatcaaagtctgaccactcacgcatgtcgccttcaatcaatggcaagtccaattcggcttcttgcgcgtgttgcgcagctagcgccaacatctcagtagacaagtctaaaactgaaatatcgtcataaccggcttgcttcaattgaattgccaagcgtcctgcaccaccggctagttccaatagcttaccatccttgttcttaatgaacttggttgcgtattggaaccaatctgcgtaggctgcttcgtcaaacaagtcgtcatacagcttcgcaaaagtttggtaattcattagaattcttccttaacgatccattgatcaatgtcaatttcaggtgcagcaccccacaacttttccaagttgtagaattggcgcatgtcgtccttaaagacgtgcacaaacaaatcaccaaagtccatcaagacccattcaccttcgcgacgaccttcgtgacgcttcaactcaaagccagcttcagccatcttgtcttcgagttcatcaacaatcgccaaaacttggcgttgcgttggggcatccaaaatcaagtaagcatctgataccaagctaatctcgtggatatccaatgcgaccaagttttcagcgcgcttttggtcagcagccttaacagccacttccaacatttcatttacgttgctttccattattacttcacactccatgcgttgtatgtcaaaagcgtgcccggataaaccggaacctgcttttcaattaaataagcaagcgtgtggcccgtttgccacccgacacttgctgccaagtcttcaaatgccaaggtgcgaacttcttcaacacctgggaaatcgcgacctgactcaatatagtctgccatgtagataatttggctcagcgtcgtcatgtatggcgcaccagttgtgtgctgacgaattgctgtcaggatatcttcgttttcaatgcctagctcatctttcaccatttcggcgccgacgataccatgccaaacgttgtttccccaattaaccaaatctggatccaattgcttttcggcaatcttcgccaagaaatctgcatcagagcgttccttggcgtaatcatgcgtcaaggctgccacagatgctttctctgcatcaacaccccacttttcagccaaggccacagccatttcttcaacacgcaacacgtgttggaaacggtactctgacattgctgcttgggctgcttcaactaagcttttacgagaaccgttatagtaacggccccgataaatcatctcgtttgtcatccatgtataaccctttttctacaatgtaggctgctaccatgtcaggtagcagatagcgcacactttgcttattagcaatgcgcttacgaatatccgtcgaactaatttcaaggtttggcacctcaacccattcaacaggataatccgttactcgtggttgtcctgggcgattaacaccaacgaagtgaaccaacttaaggaggtcatcaatgcgataccacgtctttaagtaagccacttcatcaccaccgataatgaaatagtattcgtaatttgggtgctccacctttagttgcaacattgtgttgtaggtatagctcttaccaccgcgttgtacttcaagcaattcaatgccaaagcgactattacctgcaatggccgcttggaccatcttggcacggtgcaatggatcaattgcttgcttcacatccacgtgtggtggcttcgcgttcggcatgaagtataccttatccaagccgagcttatctgccacttgttcagcgatgaccaagtggccaacatgtggcggattaaacgtgccacccaaaataccaattttctttgtttcaccgataaacgcacgctcagcttgcgcttgcgtgacggttttttcgattgtattaatcatgcccgaacccccgtttcgagagtgatattaaatcttttgtacagccactgagtagtgacggttttccttgtcagctgattcaccaaacaacaccaacgtgtgtccaattgtttgtacaacttggatgtccgtgttttcttcgatgaattccttcaaagactcaacttcaacgtctgagtttgccaagatgttaaccttgaacaactcacgcttgttgatggcatcttctagttgatccaaccagttttgtgtcaatccttgcttaccaatgctaaacaatggacgcatgtcatgtgctgatgcgcgcaagtaacgcttttgctttccgcgtagtgaaatcatattaaatcattgcccttcgtgttaatactgaaaccccttcaggagcccagcctgctacaaccgtgttggcaggaactgtaatccagcccaaaccgtcaatcacgatatctgtcttctctgttaccttgaactcgtgacgttgcaatggtggcaacatgtccaagttctccgtcgttggtggcaacaacaattcaccagcgtgcttgctgtagaattcgtctgccttttccaacttggtacggtgaatcatcaagttgttctcgaagtatgccgtaataccagccttctcaccttggatgaagtcaaaacgagccaacgcacccatgaacaacgtttgttgtgggttcaattggtaagtctttggcttcaattccttttgtggtgaaacgtacttcaagtcctttggcgtcaagtagtgtgccatttggtcttggtgaatgatacctggtgtgtcgatgataaacgtatcgtcatccaatggaatctcgatacgatccaacgtcgttcctgggaaacgtgacgtcgtaatcacatccttgttgtcaccagttgcatccttgatgatttggttaatcaacgttgacttaccaacattggtaacaccaacaacataaactgaacgaccttcacggtacttttcaatcatgtccatcaaagctggcacatcatcgccactcttacctgacgtcaattgcacgtcgaccggacgcaaaccagcaatgttagcttgttgacgcatccaatccttaatctttgaacgcttcaaagactttggcaaaacgtcaaccttgttaccaactagcaaaactgggttatttccaacaaagcggtgcaaccctggaatcaatgaaccagagaagtcgaacacgtccataacgtaaacaaccaatgaatccgttgctgaaatttcgttcaacaacaaacggaaatcatcatccgtcaaatcaacgggttggatttcgttgtagtgacgcaaacggaagcagcgttggcacaacacttcttcgttttcaaatcccttcaacaaagctgacattggggcataacccaattcacccttgtgctcagtttggatcaacgcaccacatccaatgcatcgcaatccgtctgccaagtaaccttgaacttctgcttcactaatcaagtgtcgtcctccattgtagttctgggtgcgcctttagcatttgcttcttaacacccttttcaaaaaatcggttaatctttgtattccattggtcagtctcaatcagaggcttaaccaaaatgctacgtacgccgtggttgtttgatgaccagatatcagtcaacaattggtcaccgaccatcacgacttcgttcttttgtaaattaagctttgttacggcttcattcaagccacgtgtcaacggctttagggcacgtgacacaaacggtagattcaaaggctcagcaacacgtgcaatacgtgcagctgagttatttgaaacaatcattactgggatgccagcttcattcattcgctcaagccagtcatgcaattcagtcgtgccgtcagggttattccaagcaatcaacgtgttatccaagtcagtcaaaactgccttgataccttgtgcctgaagttgttctggcgtcaaacggtagattgcatcaatcatccaagttggtgtaaatgattcagtcatttttcgtccttttcacaatttgtcttactataaattatacgctaaatactgtcgtttataaagtggggtgactaggtcccaaataaaaaacaaccagcaacggaaaccatcgctgattgtttttaaaatctattacttagcgcgctcagcgttgtacttcttttcaccgacgtgttcttcacccaatgaaacaaagtcgtatgacaacttggcgttacgctcaaattcagccaaaccatagttaatgatttcgtcaatcaagttcgtgtagctcaagcctgatacttcccacatttgtggatacaaagaaatgtttgtaaatccaggcaacgtgtttggctcacccaagtatggtgtaccatcagcatcaatcataaagtccatacgcgtcaaaccaacaagacccaatgccttgtaggccgtcaatgccatgtcagtgatttccttttcaaggtcatcccccaactcaactggcaattcaaagaccattcctgaggcgtcaacgaacttgttgttgtagtcgtaccaaacgtcttgttcaggcaatacgataccacccaaacgtgatgcacgtggttgctcgtttcccaagattgagatgaagacctcacgtggcttgttcaaagcagcttcaaccaataccttgtagtcgtattgcaaagcgtccttaacaccagcttcgaattctgcagcgttcgttacgcgtgaaataccaactgaagaaccttgcttagcagccttaacgaacaaaacttccgtgccaagttcctttacaagaccttcgtaagtgtagttttggtaatcttggtccgtcaacaaaacgtacttcgtgttgcgtacaccagcttggttcaagatacgcttcgtcaaatccttgtcgaatgacattgctgacgcagccgtaccagcaccaatatatggcttttgcaacaaacggaacaacgcttgcaaagtaccatcttcacccaagttaccgtgaacaactgggtagaacaaatcgatttcagccatctcacccaaaacggcaattggtgccaatgggttcgtcaaatccatctttgacttcgctgcagctaccacagtgtcttcatcttcaccatcaaacacacgctttgaatcagcggcgttgatcatgtaaccatcctttgaaatcaagaaaacagttacgttgtacttttccttgtccattgcatcgtaaatgttacgagcagagcgctttgagacgtcgtgttctgatgagttaccaccaaagaacatcgcaatgtttagcttttctgacatgtcgttctccctgtcaaactgattgaatttagaaccctaagtataacacgaaactgtaaaccggaccgattacgctaggaaattgcgtgcttcgttaagataatcataaatttctttgggtaatttttcgcgtagcaataaaccttgtagcaagcgttgttgattgtacatccggtgccaatctgcttcaacttccggttgcatgcgacgcgtcatttcttggcgccattgcttgagttgcttcaagaagtattgctcatacaacggattcaagttcaccaacgttacgatatagctatcgatacgacgattctcacccatgaccaacggtgtttccaaacgcttgatgcgttcaatcaaaaccgtgagcaagaataccttatctgcgcgtgtcactgcatcatcatgcgtcagctcatccaacaagtttgcgatgtgcaagaaagcatgtgcccaacccttgccttcaacaaaaccgcgcgtatcatgttccagcgcaatgtacgttgccaagttatcgataagcatttcgtgcaaatcgtcgctaaacagctctacttcactattgcgatttgcgtagttcaacatcgacaaaatgaagaccgcgaatgagcggaagaagatgccgtcattatcagtctcatcaatgtgtgagaacaacactgaatcttgtaataagtaacgcgtcatcatcacaatttgtgcatcggtaaagacattcgcttgcaacgcatcgctaataaagaaaaagacacccttatcacgcaactcaggatcagtttggcgcaacccactcatcacgtccaacaactcttggtcagtgacgacaaccggttgacccgcaatcaacgcattttgccaatcagacactttttcatgaattgcagtcgccgttatcggatcaagctgctcaacaacagtcggtgcgtcgtaatcaaactggtcaatcaaacgaccaacttccgttccaagtgaatcaaacaactcaccatggtgcacacgcgcacgcatattttttaattcttcacggacatcatcaacggtgtaatccattatctctatcccttttccgtattattgcttcctaaatgaaagctacctccactagattaacacaaccacgcaaagatagcagtttattatattttgtttccaaccgggtcgatgacacttcacccgatttccgttcatctagacacaatttgaacgtcggcgaaaacccaccatttcagcgtttattttctttcacccgtttttcacccatttagacacgattttcgcccgtctcgacacagtttgtttcacccgattattccctgtctagacacagtttgttccacccgattattccctgtctagacacagtttgaactcgtaacgaagcccaccatttcagtgtttattgtccttcacccgttttttgccgatttcgacacgtttttcactgatttagacacaattcttatttgctgcagaaaaaagccccagccgacacgcagtcgactgaggctaattcatctatctatttcaacaacaactattccttgaggtggaagtagtatgttgacacagttacgtcacgtgaagccaaggctgtacgcaaacgcaaactattttgattgtgcaacgcattttgccaaccgtgacgaggcacgaattgtggaatcaaaatcgtcaatgagtggttacgttccttcgcaccctttgcaatttcatctacgaaacgcaatgaaggctctgtgattgaacgatatgacgagtggatgtccacgtaacgcacatctgggaactcgcgcttgaactcaacgcccaaacggtgctccttttcagggttcgaatcaaatgagacgtgcatggccaaaacgcgatcacccattgattgggcataatcaatcgcatcggccgttgccttagtcaagtttgagaccaacacaatcaccgtagaaccatcgtagtgatgacgcttgattggttccttagacaacacacgcaattgcttagcaaccgccttgtagtgtctgttaatcgtccagaacatacgaagcaaaactggcatgataatcaagtatggccagacagacttaaagtgcatccagaacaaaatgataaccaaggcaaacgagataaacgctccaacaaagttgattgacgcctttcccaaccagaagccttcacgttcacggaaccagtgaataatcattcctgattgtgacaatgtgaatggcacgaaaactccgaccgcataaagcggaatcaaagcttcagttgatccgttaaaaatcaaaagcaatacaatggcaccgacggccaatgacataataccgtttgagtatcccaaacgatctcccttgtccatgtaaatgtgtggcatgaacttatccttagccaagttaaaggccaattgtgggaaggctgagaaaccagtattagcggcaaccgccaaaatcaaggccgttgcaatttgcaaaaggtagaacattacgccgtgaccgaaaatcgtttgaccaatttgggccaacaccgtcacgtggtcatttggtcgaataccgtaccagtatgacaagaacgtaataccaccaaagaagaaggccaaaatcaacgccatgattgatagcgtcgccgccgcattacgtggctttggctccttgaagttcggcacggcatttgaaatggcctcaactccagtcaatgaagatgaaccacttgaaaacgcacgcaagaacaacaagattgtgatacttgatgatgacgtaccaattgctgctgcagcatggaaggcaacttgaccagtcgcaatgttatacaacccgtacaagaccattccagtaatcatcacaatgaacaagtaaactggcaccatcaggaacccggctgactcacgcacaccacgcaggttaattcccatcaagattaagatgatgacaaccccaatcccaactgagtacgggtgaagtgctggaaccgctgacgtaatggcttctgttccggccgccacagatacggcaaccgtcaacatgtagtcaaccaacaaagatccaccggcaacaagcccagcgttacggccccagttcgttgatgttacgacataagcaccaccaccagatgggtaggcgtgaatgatttggcgatacgatagcgtaatggccgtcaacaataccaacaccaaaatggcgattgggatttgcaaccacaacgcaaccgtacttgcagcaatcaacgctgtcgtaatctgctcagtaccatacgcaactgatgacaatgcatcagacgaaagcaaagccaaggccttggttcggctcaaatgttgtgagccctcttccaatgtcttaagaggctttccaatcaacaaccgctttaaaaagcgccacatgatttttctcctaaacacctatattaggcaaaacgcccaaaaataatttcaattttctacaacgacttattgtagttctatttgggctcgttgtctatgattgatacttactttcggaaatcaaaaacgccaaccctctcacaggaaggtcggcgtttaatatttactatgaaattacatcatacccggcataccttgagcaggcattgcaggggcagcatctgtcttaggttgctcagcaacgacagcttcagtcgtcaacaacaaagctgaaacagaagcggcgttttgcaaagctgaacgcgttaccttagtaggatccacgataccagcttcaatcatatcaacccattcatcagtcgcagcgttgtaaccaacacctggcttctctgacttcaattggttaacgataactgaaccttccaaaccagcattttcagcgatttggcgtacaggctcttccaaagcgcgacgcacgatgttgataccagtttgcacatcaccagtctctgacaactcagcaacggctgggataacgtttaccaaggcagttccaccaccagcaacgaatccttcttcaacagcggcacgagtagcgttcaaagcgtcttcaatgcggtacttgcgctccttcaactcagtttcagttgcggcaccaacgttgatgacagcgacaccaccagccaacttagccaaacgttcttgcaacttctcacggtcaaagtcagacgtcgtctcggtgatttgacccttaatcaagttcacacgctcagcgatagcttccttgttgccggcaccttcaacaatcgtcgtgttgtccttagaaaccgtaaccttagcagcttgtccaagttgtgcaatcgtcacatccttcaagttcaagccaaggtcgtcagtgatgacagttccaccagtcaagatagcgatgtcttccaattgcgccttacgacggtcaccaaatccaggcgccttaaccgcaaccacgttgaacgttccacgcatcttgttcaaaacaagcgttggcaaagcttcaccagtaatgtcatcagcgatgatcaacaaagcacggccttgctcaacaacactttgcaacattggcaaaatttcttggatgttggcaatcttcttatcggtaatcaagatgtatgggttatccaatgaagcttccatcttgtccgtgtcagttaccatgtattgtgacatgtaaccacggtcgaattgcataccttcaacgacatccaacgtcgtctcgatacccttagactcttcaatcgtgataacaccatcgttaccaaccttctccatcgcttcggcaatcaactcaccaacttctgggttagcggctgaaattgaggcgatttgggcgatttcttccttagtagaaaccgtctttgacatctcgtgcaacgccttaacagctgcatcagttgccaattcaataccacgacgcacaccaactgggttagcaccagcagtgacgttcttcaagccttcgttaatgatagcttgcgtcaaaacagttgcggtcgtcgtaccgtcaccggcaatgtcattcgtctttgaagcaacttcggctaccaacttggcacccatgtcttcgaagtgatcttccaattcgattgacttagcgattgttacaccgtcgtttgtaatagttggtgcaccatagctttgctcaataacaacgttacgtccctttggaccaatcgtcgtcttaactgtgttagcaagcttatcaacacctgcttgcatctttgcacgtgcatcttcagcaaacttaatgtccttagccatatttatttcaccctctatttcaaatttttaatagttaatctgtttgtttcaaattaaagaactgcaacgatatccttttcgtgaactaccaagtaatccacaccatcgaccgttacttctgagccagcatacttatcgaagatgaccttgtcaccctccttcactgcagctggggccgtcaagtcaccaactgattgcgttgaaacagcgacaacagttcccgtaactgacttctcttgcgcgtttgacgcaagcaaaataccaccaactgattgctcaggcgcttcctcaacttgcaacacaacacgatctcccaaaggcttcaacatgttatatgacctccataggcaaaattattattagcactctcgataactaagtgctaacttacatattcaataatagcacacccacacgtttttgcaacatattttggttaaaaaaagagccccgatacaaaatatgtaccaggactctaaataattattacttcaattgtgacaacatttgcttcattgctgttgccgtcatttcagcagtttgttcagttgtataagccttaacttggtcaggtgtagcctttgggttagcttgcatgtacgcagcaaccttcgcttcaatagctgacttcatttgagcttgttgagcagcttgtgcctcaggtgcagctgacttttgggcagcttgcaacttcttagattgatcagcagtcatcacaacccaagtgttctttggcaccgtcaccgtcgtcacttgcttcttaagcttgccaccttggccaccaataccgaacatcacgcgccagaaggcattcttccactcccaacgagtcgtttcgaccttaacagtcgccttcttaacgtcagcaaccttgtaagtcatttccttcttaacaccgtttggaatatcagcaaccttcgttgaaggcttaccgtgaaccgttggcttcttagcatcagctgtgtcgctgtaaaccaagacatagttatcagcctttgaacccaaacgtgattggaccaagacaccagctggtgactttgaacccaaagctgagtagacacgcttcgtcgtcgttgttgtcttagcagtcaaacctgtgttgtttgcaaagactgacgttgtcatccacacggcgccgattagcaataccgtgaagataggtccgaagatagcgcgcatagtacggttcttcaaaaccaaccatgagtagaacatgccgatcgcaaagacggccataactagaataatcatattagttatttcctcccttatctgcgacaacgtttccgtttgacttaccgtgcactagcttaccgctgtgcaagaagaacgccaagataataccaacaacggcgaatccaattccaaatgcaaatgatgcgtggaatccagtcatcgttgcgttaatcatcttatccatgtaagacacaacgttttccttggccaagtccttagcaggcttagcagccttgataacgttttgcgtaactgatgaaagcaaggcaacaaccaccgcgttaccaatttggcgaaccgtgttgttagcagccgttgcttgtgaagcttcctcaggtggcaaagctgacatggcactggccgtcaatggcatcatcgttgtagcgataccgaacatacgcaatgcgtacaacaacgttaccaagtgttgtggcgtttcagccgtcaagaataggaatggcactgtaccgatggccaagattgagaatccaaccatcgccatgcgcttagcaccaaccttgtcgtaaaccgctccggcaactggtgacatcgcaccaattaccaaggcaccaggcaataacgtcaatcctgactcaagcgctgacataccgtgaacgttttgcaagtacgttggcaacatcatttcgacacccatcatggccatcatcgccatcattacggcgaacgtcgtcaacgtaaattgcttgttcttgaacacgcgaacattcaagaatggatcgtccatcttcaattgacggaagacaaacacaataatgaccaaaattccgattaggattggtgccaaaacatttggccagttaccaaatccatcagtggctgagtttgagaatccccataggaatgatccgaatccaataacagccaaaatcaatgaagggaaatcaagcttcatatcacggtttggcacaacattcttaacgaagaatggcgttgcaatccaaaccaagaccaacacgatcattggcaagtagaaaatcgtacgccatgagtttgaaatcaacaaaccaaacaagtggtgattcttttccaaaatccaacctgaaagcgtaggtccaatagctggggccaaaccgataacgataccgttaatacccatcgcagcaccacgttgttcagctgggaaaatgttaaccataacaacttgcatcaaaggcatcgtaataccaaccgccacggcagctagaatacgtccaagcaagaacatccaccacatgtcgtgatgactaggcgtaaacgccgttgttgccataccagccaacaacaatgtgtaagcgaccatgtacaagtacttggttggaatcttagtggttaggtatgctgataccggcaccataattccgtttgccaacaagaagtatgtcgttgcttcttgggccgttgcaagtgaaatattaaaatcgtgcatcaacgttgggattgctgttcccaatgacgtttgcatcaacattccagcaaacgttccaatcaacagcaccatgaccatggcaccgcggttgaaaggcttgccgttaatgtctaaagtttctgactttgccatttcgtcctccaaattagtttattttttataattgctatcatttattcagcaagagttagtttaaacttctaaatttttaaaatcaagggtttttgtcaactaatttgacaaagatttagactgttttcacaatagcaaattgaattccgcgcaaactgcgtcaaacctgaattcctaagtgtgataactaacacaaagtcattaatagtcactttaaaatgaaaacgcaatcattaagaaaaggagccgacacccgtaaaagtgccagctcccgcctcattaaatatcaaattcttccaacgccatacttgcttctgtccagcgttcttcgacttcagccaattgtgcatcgatgtccgcaatttcctttgacaagtccgtcaacttgcccaagtcagccccgtttgctggatcattcaattcagcattcaatgcatcgcgcttatcgttcaaaccagccatttcttcttcagccgcagcaaccgcacgttcgtacttacgttgctccttttgacgttccttacgctcttcacgtgacaacgtctcaacttccttagcagttgcttcttcgtattcggccgtcgtttcaaaactagcctttgcacgatgcgtttctgcttgctcaccagccgtcttctctaggtagtaatcgtagtcaccatcaaagaagcgcgtcccgtttggtgacagctcaaccacttccgtcgcaactgagttaataaagtaacggtcgtgagaaacgaagaaaatcgttccgttgtattcgttcaacgccgtttccaacacttcacgagaatcaatgtccaagtggttggttggctcgtccagaatcaagaagttagcatgttgcaatgacaacttcgtcaatagcaagcgcgcacgctcaccacctgacaaggcagaaaccaacttatcaaccgcttcacctgagaacataaatgaacccaaaatcgaacggacgtcacgttctggcatcgttgggtgttcatcccaaatcgtgttcaaaactgacttctttggatcaagcgtttgttgctcctggtcatagtaaccaacctcaacattggcaccaagcttgatttcaccggccaacaaaggcaacttacccaaaatcgtcttaatcaacgttgacttaccaataccgtttggtccaaccaaagcgacagcgtgttgcttatcaacttcaatattaacgtggtccgccaatacattcgctaggtcatagcccaacttcacttcgttgacacgcatcacttcgtttccagattcttcatcagctgagaattgaatgtgtgcaacaccagattcattctttggcgcttccaagcgttccatgcgttcaagttgcttgcgacgtgattgggcacgcttcgtcgttgacgcacgcacaatattacggttaacgaagtcttccaacttcgcaatctcttcttgctgcttatcgaaagccttttgttcttgtagaacctttgctgccttcaattccatgaagcgtgaatagttacctgtgtaatgatccaagacacctgagtgcatgtcataaatttccgtaaccacgcggtccaagaagtaacggtcgtgggaaacaatcaacaatgcgccttggtagttttgcaaatattgctccaaccaagccaatgtttgcatgtccaagtggttggttggctcgtccagaatcaacaggtcaggcgtttccaacagttgcttggcaatcgccaaacgcgtgcgttggccaccagacaatgattgaatcttttgatcatagaatgactcatcaaaaccaaatccatgcaaaacggaacgaattgtcgcttcgtacccgtaaccattcttctcactaaaatcgtgttgcgcttggtcataagcagatagcaaacttgcatactcatcactctcgtaatcagtcgctgatgcaatcttcgtctccatgtcgcgcatcttcttttccaatgcaatgacatcagaaaatgcatcaagcatctcattgtacacagacaaatcagaatccagtccagaattctgcgccaagtaagccaacttgatgcccttcttcattgaaatcgtaccttcatcaggttgcgtttcaccgattagcatcttcaagagcgttgacttaccggcaccattgcggccgaccaatccaacgcgtcctttatcttgaatctgcatcgaaatattttcaaaaaatgttacaccactaaaacggcgtgcaacattacttgcttgcaaaataatcatgattattcttctccgtctcaataccctgcgtccaaggcattgcctaaatctcatttactagtgtaacagaaagtgcaagtttgtcgcatgtggaaattaaaaagcacccgacagtaactgtcagatgctcttaattgtttgttattaacgcaacgctgcgtttcgcttttgttgctcgtgttgcacgaaatactcccatgcatgcatttcactctcaaaccacaaatgctcaccgtcataatccaatacttccaatgacgtttgcaccaatggccactcggtgtttggcttaccttctaggtgttgccacataaatgacgcacgagctgcgatgtcaccagttggtgtgtagaaaatgatgttcgatacatttcccgtcgtttgataataacgcgttgctgacttaaagccacgccagtcccagatatctgtaacggccgtgttgtcattgcggtcgacgtagtgcaacattgacgtcgtaccgccagggttgcctgggaacaaatcaatgtcgatgacattacgaccataagttgtcccaaaacgacgtgcttgcgccatcccccagtccaacccatccaagtggtaacgggccttgtcgatttgcgggttgtgacggtagtgaaccgtctttgcttccacatccgttgccttttggaagacatcgtacatgttcaacaaagcatcatctggcaaaccgtggttcgctaaatgcatgtgttgatcagggtagtacccacgcaccacttgctttgcatcaatgccattctcgcggtctgccttaacttgcgcagcaatattagggtcaagcgttggcaagttagagttatccaaatataaattcatgagtttcactccttattaatctgccaagtacttgtcgcctgaaatgccgttaatcgtcacttcattgctgcgattaccaagtgtgtaggctgtcatcgtcgttccaccaagaccaacaccaacattagaaagggcatgtgcttgttcagccatggctggccaacgcttatcagcatcagctagcaaaccttgccatgcttgccaaaccgcttcttcgtagtaacggtcactgtggtcgtatgcagcatcagagaaagcttgcaacttttcaggatcattaaacaattcaaggaagcggtcggccatttccgttacgaattggtcttcttgaccctcaggtgcccactttgttaggtacccgttctcgccatcgataatcaaatcgtttggtccgtagttcacgttcgttgaaacaccaggcataccgtttgccatggcttccatcattgaaatgttgaacccttccatcattgaagccaatccataaacttggtgtgaacggtgaatagcgtacaactcatcacggtcagtcacataatcatgcaacgttacaaccggtgattccaaacgacgcacttgattcaaatccgtcgtttcagcgcccttttcatcgtacatggttggcttttctagtccgtacttatcgaacaaacgcaacaagtccttattcgtcttgttgttacccgtgttatcgaagtaaccgtagacatccaagtgtgcattcaaaccaggttgcttttggttagcaatcatcaacgcttcagcaaccgcggccggacgcttgtctggtgcgcgacgaacaatcatcaacactgaattcggttgacgatcagccattggcacacggtcagcttcacgaatttcagctggtaccacaccaactggaatcgtgaatggcgttgcctttggtgcgtaacgcgccacaacatccgccgtttgacgtggcatcgctgaaataaccgcttggtaatcattgatgtgcatgaagtcgaactcgtaattattgttctcatcagtcgtcatgacatcacgcgtatctgaggcatgcaaattgtgcaagtggaagccaatgtatgcaggacgatccaacttcaacaagccttcatcggcagccgtcgtacggtccatgatgaagatgtttggcgcgtcctctgagaagaagtcgttattcaaatcgttaacgaactcagccgtcaattcatcaaatgaatcaaagatatacgtcatgccatttggcttaatcaaacgatatcctgacacatagtttacaaattgtggcgcttcaaatggcttcgcttcaaattcttgccctgacatttgtgcgttctcagccaattggttttggctatcgatatgcttacggttcatgaccagtgtttctgaaccacgaggcgccttacgacgaagatattcttcaatcacagggcgacccttgcgatcaacaaagacgttggtatttggcgtaccatctgggtcgatgtattgctgacgtgaaatgaagccacgtgagtcatatgaatcgacgcggaacaagttaccaaagtgttcgaatacttcaaccatcgtgacacgtgattcgtgtagcaaatcaacgtgaattcgacccaagaaacgggtacggttttcatcttcataggccatgtatgtgtctggcgtatcaggcaattgttcaacaatcgccaccggacggccaccccactcaacatcttgcgccgtcaaaatgcgatccggcacatattcagtatgcgcgtagtaatcatacatattgattacttcagcatcgttcaatccccacgctagcaagtctcggtgcccatttggattaaacacacgcgtgacaattttgaatgattgtccattcttacggaacaacttaccacgttgtacctgtgcgtgttcaattcctgaaccttgcgcagcgaggccctcgtttacgaaaaagttcatcgcaataccctctttaactagttttattaggctaagtataccaaacccgcttacaaaaactaagcccaacccatgcgcacttctgaaacaaaatataacgaacctgtgaacaaaatcatatcatcaggacccattgcatcagcgattgtgcgataagcttctcgccaagattcatgaaccgtgacatcatgccccgtcacttggcgtgctgcttccgttggatcaagtgcgacgcgagcacccggattttggaagtgcgtgacgtgcaaatcaacattgggcaaatctgctaacgtatgtaacattgctgaatagttcttatcggccaatgcaccgaaaatgacgtgaatctgcttatccgcaaaacgcgtccgtaacgtttcagccaatgcatcaacaccgtgttgattgtgggcgccatccaagacggtcaacggttgctccgaaacacgttcaaaccgtaccggccacgtcactgtttgcaaggcctttgctaccatttcagctgtcagtggcacacccaattcatcgaccactaaacttgctgcttcaagggcaaccccggcattatcaatttgataattacccatcaaatccacaaagacatccttaaactcgtgaacacccgcgaagtcgaaggtctcaccccaacttgtttggcgtggcaacatctcggcttcaaactcatcccccaagcgatacaacggcgcacccagagcattagccaccgttgtcacaacttgttgggcttcttcaggcaatcggccagtcacaactggacgttgacgcgcaatgatgcccgacttttgcgtcgcaatctcagcgagcgtgtttcctaacacttgcatgtgatctaaaccaactgtcgtgatgaccgataccaacttatctggaatcacttcagtcgtatcccatgtaccgccaataccaacttccaatacaacgacatcaacagggtgctcagcaaaatagacaaacatcatcgccgtcaacgtctcaaactcggtcggaccaccctgaggcaactcttcgtctagcgcttcagtgattggtgcgctgcgacgcataatatccaacaaaatgtcatccggaatattaccgtcattcccttgtacacgttcattgaattgcaaaataaatggcgacgtgaacatccccaccgtcaagccagccgcacgcaataattgcgcaatcatcttgctagtcgatcctttaccgttcgtccctgtcacatgcacatacttagacgcacgttctgggtgacccaaacggtctaataaagcattaatgcgatcaaaactaggggtcttcttccacttgtgtcgaccatgaatatacgcaatcgcgtccgctgctgtgttcagttcaatcatgatgtcgccttcttccgtttttcattagcaatatcgtatcacaccggcatttttctggtgtgttttttaggcaaaaagtaaaggcgccatctatcgaaatagacagcgcctttacaggtgtaatttaactagcattgtaacgacgaacagcttaaattcgttattaacaatatataagatattactccaaaaactcgcatcctgcaagcctttagacgtaacaatctgattacttagctgacttcaactcttccaaacgtgattcagtcgctgccaacttagcttgccagtcagccaacttctcgcgttcttccgcaacaacagcttcaggggcgttgttcacgaacttctcgttacccaacttaccttcagcacgcttaacttcaccagcaaacttcttcaagtcaccttgcaaacgggcaatttcttcgtccaagtcaatcaactcttccaaaggcacgtaaacttcagcaccagaaataatttgcgtcatagccaactttggtgcagctacatcagcagaaatttcaagtgactttggctttacgaagcggttgatgtagtctgagttttcatcaaagatgcgggccaagttttcatctgacgtcttgatcaaaacgtcgatttccgttgacattggcgcattggcttccgtacggatcgtacgaacggccttgatcaagtcagtcaagctttggaagtcagcttcagctgttgggttatctaactcagccttcacttctgggtaagcagcaaccacgattgactcaccgtcatgtggcatctcttgccagatagcttccgttacgaatggcatgattgggtgtagcaaacgcaatgtgttgtccaaaacgtatgccaaaactgcttgcacgttcttcttagcagcctcatcatttccgttcaacgtttccttggtcatctcgatgtaccagtcggcgaagtcgttccagatgaagttgtacaatgaacgtccagcttcaccgaactcgaacttatcaaagttcttcgttactgaagcaattgtctcgttcaaacgtgacaaaatccacttgtcggccaacgtcaaaactgacaagtcagcaggcaattcggccttcgtttcgtcatccaagttcatgataacgtaacgtgaagcgttccaaatcttgttgatgaagttccaagctgagtccatcttcgtgtatgagaaacgaacgtccaaacctggcgttgaaccagttgccaagaaccagcgcaatgcatcggcaccgtacttctcgatgacatccattgggtcaattccgttacccaatgactttgacatcttgcgtccttgttcgtcacgaatcaaaccgtgaatcaaaacgttcttaaatggacgacgacccgtgaattcctttgattggaacatcatacgagcaacccagaagaagatgatgtcgtatcccgtaaccaacgtgtttgttgggaagtaacgcttgaagtcttcagcgtcttcatcaggccaacccatcgttgagaatggccacaaagctgatgagaaccacgtatccaaaacgtcagagtcttgctcccagttttcgatatcttcaggtgcttccataccaacgtacatctcacccgtttgcttgtggtaccaagctgggatttggtgtccccaccatagttgacgtgagataacccagtcgtggatgttgtccatccaacgcgtgaaagtatcttcaaaacgtggtgggtagaagtcaacacggtcgtctgacttttgcatatccaaagcttgctcagccaatggcttcatcttaacgaaccattgcgttgacaaacgtgactcaactgggataccagtacgctctgagtgaccaactgagtgaacgattggctcaatctcaagcatccagccttcagcttgcaagtcatcaacaatagccttacgtgcatcaaagcgatccataccaacatacttgccggcacgctcgttcattgatgcatcttcgttcattgtgttgatacgctccaagttgtggcggttaccaacaccaaagtcgttagggtcgtgggctggcgtaatcttaaccattcctgaaccaaactctgggtcaacgtattcgtcggcgataattggaatctcgcgaccaacaagtggtacgcgaaccatcttaccaaccaaatccttgtagcgttcgtctgatgggtgaacagcaacagcaacgtcaccaaacatcgtttcaggacgcgtcgttgcaatttcaatgtagtccttaccatcgtaagtgacaccttcttcaacgaatgggtacttaacgtggtagaaagcaccttcatcgtcttggtggataacttcgatatctgacaaagccgtacgagccttaggatcccagttgatgatgtactcaccacggtagatcaagcccttttcgtacaacgtcacaaagaccttgcgaacggcttctgacaatccttcgtccaacgtgaaacgctcacgtgagtagtccaaagaaagtcccatcttaccccattgtgacttgatggtagcagcgtattcgttcttccagtcccaaacttggtcaacaaacttttcgcgacccaagtcgtaacgtgaaatgccttgctcagccaaacgttgttcaaccttagcttgtgtagcgattccggcgtggtccattcctggcaaccacaacgtgtcaaatccttgcatacgcttttgacggataatcatatcttgcaacgtcgtgtcccaagcgtgacccaagtgcaacttacccgtaacgtttggtggtggaataacgattgagtaaggacgagccttatcgtttcctgatggcttaaagcggttttcttgtacccacttgtcgtaacggccagcttcaacagctgacgcgtcatactttccaggcatatcaatttcgcgcatgtgaaattctccttataacataatctctatttgtgtaacgatgtggcgagcaataaaaaacgccctgaccatacaataactgtatgatcagggcgacttaatcgcggtaccacctgatttaacgggacttatcccgctatctcgttagaacttaacgcgtttctcacgttaccgactactacaatttcaccggcaaggcccactaactaccttcagtcaagaattttgatgcgcttttcaccaaccgcgcactcgctgcacaatcctcattgacttactttttagtgcattgctataaacgtaattgtacggttatttgctttgaaaatcaaggtgaaagactagtgttcaaagaagaacgatatcatgcgatcaaccaagggcgtaagaaataaaacaacaatcatcatcttatagaacttcagtgactcaaagatttgatcaatacggacatttagtgacttcaattctcccctcatctcgcccttaaaatccgataaatccatgcgaatgtcattcatttcagagtgaatcccctttaactcagttcggatgtccttgatatcgtcacgtacctcttggaaatcatgcttcttaaaatcatcaaactccgcgtacgtcacgtaacgctctgtctttgtttcggccattttcgtctcctcctcgttgactattaacaccgtatccatatccccataaaacagataaagagacgccgaagcgtctctttatcgttaagtccagtatatcagatttagtggaagaacaacatctccaccgcttcatataataggtacaaaccgtacccgataacaatgaaagcggaaacgatgttcacccagaccagcgcacgcttaggcaagcgttctttcagcaaattcatggtgattgtaataccattgaaccaaatgaagctggcagtaataacgccgatgatgaatggccaaacttggttgtcagccagtgtgccgcgcaatgctccaagcattagtgagccatcgattagcgcttgcggattggcccatgacacaatcaccgccgttagcatcgcctttttcatcgtcatggcattttgctgcgtgttcaattgcactgagttggcaccgcgtagaatgccgtacccaatccaaataaccagcaagccgccgagtagcatgacaatcagtttcaacatttcatgtgaactgatcagtgcgcccatcccaaagaacgccgccattgaaaaggcagcatcggctagccaaacgaacaagacatatagaaaagcccgacggaggcgattattcatggcattgttaaacacatacaaattttgcataccgattggcgcgataaacgcaaacccaatcatcatgccctttaaaactgtcatcatagctttcactccccttcatcactgctatccagtatacaagaaatccagtcctggcactacctgaacaggcaaatccagctcatctagtttacaaaactagatgttaaggttatactatacttatcaattagaaatcagggggatttagttatgccaatcctaacaaaagaaaatcgcaaatacttaattacatatgaaacgttgaacgctgtgacccacggtttgggtgtgctagccgctgtcgttggtgcaacgctactcctctgggaaagcatgcacgcaaacttcaactggttcaccatggcggccctatggatttacgccatttcaatcatcacattcctactcgcgtcaacgctcttccacgccttggtgttcaccaaagctggtaagattttccaattccttgatcactccggtatctacctcgtcatccttggaagctacacaccatatacgtggctattcctaccaggtaaagttggctggccgatttggattactatccttctgttgaccatcgccggaattatttatgatttgttcttcgttgggcgctggccatggctgtcagtcttaatttacgtcatcatgggctggttaatcatcttggctttcccagcattgcacgcctcattaaccccatttgccttcaacctattgttggctggcggtatcacctacacacttggtgccggcgtgtacctcgttccaaaactgccaatgagccacgtttactggcacttgtttgttctgggtggcgcaacattgatgtacatttcaatctttagcatgttgttctagagacaaaataacgggcaagcacagtttcagtgcttgcccgttttcgtttacttcttaaccgttccagccgttacccagttggtaaagtcttggttttcatcttgttgttgaccaccttgttggtgattcgtgtaatcgttcttttgttgttgtgagaacgttgcccaaacagatccaccaatgtagtagcgacttgatgccaacaagacatccttcatgtttgcttgcttggcatccccaagtgacgctgcattcttgatttgatcaccagtccagtaactagcgactgcgtactccaaaccatcttgcaactttacttggcgggcgatgtacacgttttgcacatccttagccttggctgctgcttgcaccaccgttacaactgcagatgcatatgcgttggtgtacttatcaaaatcttgcgttgtgtcatcttgcaacacaatctttgccgtcccattgttaacatccgctgacaaaacagatggcgccaacttatttgccttaagcaccttcgtgacatcgaacgcaactggctcgctagatgacttagctgtcgtctttgatgaaactgttttattatctttgtgactcgttactgaagacttttcggatgattgcgtagattcagatttgtgtgaaccaccgtcaaccaaggcaaaaattgccacgattccaataattaatacaatcccagaaataacggcacgcttatacttagccatatgaataacctcttctattacttgctactttaaacattttatcacaaaaccacttgcctattatgtccttcgtagtgcataatattatttgttgacgcctccttagctcagctggttagagcaacggacttttaatccgcgggtccagggttcgaatccctgagggggtataaaccgtcagcgttaaaaagaccggtatcttttgcgagataccggtctttttgtctgcttattacttaccaaacaactttgagaagaacccaaatagtcctgatgacttttcgtgttggcgtgacaaacgtgaatcatctgccactgctgatgcctcttcaggaatatcaactggtgtcgtctcagccgctggttcaaatggctttggttggtcattggcctcaattgctgccgcagctgcctcattagcttccttggcagccttttcttgcgcaacgtactcagcaatcatgtcatccgtcaaagctggcattgccaacgtcttcgtcgtaacacccatcgtgacaatcgcttggccgtccttaccagaacgacggctcttagcacgtacctcaacttgtgatggtaccgtgtcagttggcaactcaagctcgaattcaaggctcttatcaacgagcaagaagatttcgtctgccccgtgcaactttacagtcacatcgacatccgcttggttaacgcgtccttcaagcaaacgcttatcgccttgcgttgaaataacagccgttaccaccggtgctggcaattcgattgtcaatgtaaccttttcttctgatgatgcatcgccgggcatcttaccagttacgataatgtcaccttctagcaagccagctggcgcctttgccatgaactcaccgtttggatcagacaccaacgtatcttctttaccgttaggatatgtaaccgttataattgctgctggtgccgcgtgccccataacagtcgtgcccaaactgtttgttaaggtcgaagcgaccaaatttacttttgtatcattcatgatgtcagctactccatctctaataaactgttaatattactaccattgtaacagattaaacactcaccgacgacctaatcctatttatataataaaaggccggaacataaatgtcccgacctcacaggtttctttacttagcacgaacaatcaacgtatcaacgtttgctgtacgcgttacgtattcagtaactgatccaatcaacaagcgctcaatggcgttcaaaccagtagcaccaatcataatcaaatcaacattcaacttctcaggtgcttggtgagcaatgatgtcctttggtgaaccatactcaatcgtgtagtccacgttcttaacaccagcatccttagcttgttgcaagtaagtttccaacgtcttcttagcagtttcagcaacttgctcgaccatcgtcgtcttgaagtccgttacgttttggaatgcgcgtgtgtcgataacgtgcaaaatgtgcaagttagcgtcttccccattacgcaatgcaacttgaattgccttccccaaagcagcttcagcttcctttgatccatcaactggaatcaaaatgttcttgtagtttacattagtatcagccatgatagttcctcctctaagtggctatttgcctatatgttcattatacgccatttgtaataaatttgataaataaaccatgtctaaaaaaaatagcacctatgaagatttcacagatgctacaacgaaaatatgactatttaaacaaacgcgacgtgaccacgactgccaataccgtcgttagaatggttgccaaaatcacgaagatccccgctggcaatggtgctgaaccatgcaacacaacactaatgatcaatgccaatgcgtcaatcgtgaagaaccaaccgaaaaatgtggctggcatgctcgcttgtgatgctgacaagttaaaaaatccttgacggtgcgttagtagataaatgcccattgcgccaatcaacaacgcaaagacaagatacataataatgatgcccatttcattcatcctctatctcaaaaaataataattgcaaaagaaaagcgctaccagggctaaccgtggtagcgcacgaacacttgattggcgccgttaacgattcacaatgagttgactccagattataggtaagtgggtgaataagtcagctttagcggctactaagtgaaatagcttgcctcgccggcttcccgacatccccggtcaatatggttgtaaagcaactacatatagtaggaatcatgcgtacgtccaaggaattcgcataccgttattatacgcttccaagtgcaaaaaagcagtagttaacgtaaaccatttttctgggcgtcacgtagcttttggtactgttccttgtaggcttgctctaccttagaatttcccgctggcacgaagtagttcgccccgttaagtttatctggcaaatattgttgcggtacccaatcgccgggatgaccgtgtggataaacgtattccacaccgtgcccaagtttttcagcacccttgtaatgcgcatcacgcaaatgatctggcacgtcgccagtcccacccttacgcacatcagccaaggcggcatcaattgcagtgtacgctgaattcgacttgggtgacaacgccaattcaatcgtcgcatttgccaacggaatccgtgcttctgggaagccgagtttctcagctgcttcaatcgccgtcacggcacgcgccgcaaccgccggatttgccaaaccaatatcttcgtaggcaattacacgcaaacgacgtgcaataattggcaagtcaccagcttcgatcaagcgggccaaatagtgcaacgccgcatcggtatcactaccacgaatcgacttctgcaaagctgagatgacgtcatagtggccatccccatccttgtctgccgtcaacgctttacgttgcactgtctcttcaacaatcggcaacgtgatgtgcaccttgccatcttcacttggcgccgtcgacttaaccgccaactccaagccgttcaatgctgaacgcaaatcaccgttcgttgcataaaccaattggcgttcggcctcatcatccaacaccgcatcaaagttccccaagccacgttctttatccgttaacgctctttgaatagctgtcttcatatcatcttcagacaacggcttcacttcaaaaatttgcgtacgtgaacggatggccggcaaaattgatagatatggattttcagtcgtcgcaccaatcaacacaatacgcccactctcaagatgtggcaacaaaaaatcttgctttgtcttatctaaacggtgaatctcgtctaacaacaaaacgaccgtgccagacatcttggcttcttcggccacaatttggaggtcctttttactatccgttgcggcattcaaaatgcgaaacgcatacttagttgaccccgcaatcgcactagcaatacttgtctttcccgtgcctggtggtccatataaaatcattgatgatagcatcttagccgtcaccatgcgattaataattttgccctcaccaactagatgtcgctgaccaacaatctcatcaatcgttcggggccgcatgcgaaacgcaagtggttgttgcatgctgcttcaccttctttcttattatccaaacaactttttgtaccaaggcttctgtggagcatctggcattcccgttttttcctcatcatcttccaacgtcagcgccaccacatcaatttgtgtgatgttaacagcttcattcgccgttaaaaccgcaacaacatctgaacgatcataaacatcatctgacttcaacgtaaagccaacattgtacttagatgccagtttgatatacggcgtcaacaattccatatcaagatgcccgtttaatagcaaagtcgcatccttatgctctttcagttgcgtctcccaagttggcatgtatttcgtatcaccaaaggttgcccgtgtctgcgcaacatagatacgctcgcgaaacgtgcccaaatagtgattttgttcatcagggttaatctttggcgtcccgtagacggccgcttgtacgtgtggatccatgtcaggcatattcgtgtcctccggtttcttattaggttaagtttaacatataacaatatgtaaacaaaaaagagcccacaaaatgcgaactctaacttgtacttatattatccgaacatcaaagttgaaatccccgctacaaaaacgtacatcatatatgcgccaaaaatccagtgtagtgcattaaacaacattgggaatggtcgcaagatgcggtggcctgcaaagtagaccaccgttggtacgatcaaaatcaacgcaaatatttcaaaccccattagccatgtgttcggtgccattggcatcaaaagtgtcatagcttctcctccaaatcaacatctgggtacttatccttaaaccagcgttctgcgaattggttttcgaacaagaatactggttgctcagcacggtcacgtactagcaagttacgtgatgaagccatacgtggatcaagttgctctgggttaatccagcgggcaatctttgaacccattggctccaaactaacttccgtgttgtattcgttttccatacggaattggaaaacttcgaattgcaacgcaccaacggcaccaaggatgtagtcccctgaatcccaggccgtgtacatttgaatcgttccttcttgaaccaattgggtcacacccttgtggaatgacttttgcttcaaaacgttcttagcgtgaacacgcatgaacaattcaggtgtaaacgttggcaactcttcgaattcaaccgccttcttaccggcgaaaatcgtatcaccgatttggaagttacccgtgtcataaacaccgatgatatcacctggataagcgttctcaacgttctcacgcgtatcggccatgaattgcgtcacgttagacaaacgaatcttcttgtttgtacgcgccaacgtcacgtccattccacgctcgaattcaccagatacgatacgcacaaaggcgatacgatcacggtggttagggttcatgttcgcttgaatcttgaacacgaatcctgagaattgctcgttaccaggttccacttggtcgccatcaaccgtgttcttagctgaaggtgctggtgcgaattgcatgtacgtttgcaagaacgtctcaattccgaacccttgcaaggctgacccgaagaagactggcgtcaactcaccgttcataaccgcttgctcgtcgaattggtttccggcgtccttcaacatctcgatttcgtcgcgcgtctcagcccaaagtgggttgtcttgcaacttgtttggttctgccaaatcagtgccagcttcgttcaaaggcaagaaacgggctgcttctgattctggacggaacacttcgacattgttgtgatacaagtcaaacaatccggccaaaatttgtcctgatccgattggccaattcattgggtaggcgttgattcccaacgttgactccaattcatcaaccaagtccaaggcatcgcgaccatcacggtccaacttgttgaagaatgtgaaaattggaatgtgacgttcactaacaatttcgaacaacttcttcgtttgtggctcaataccctttgcagagtcgaccaccatgataactgagtcaacagccatcaacgtacggtacgtgtcttcagagaagtcttcgtgtcctggggtgtccaagatattgatgcgcttaccgtcaaaatcaaattgcaaaacagatgatgttacggaaattccacgcttttgctcaatttccatccagtctgactttgcaaagtttcccttacgtcccttaaccgttccagcttcacgaacaacaccaccgagcttcaacaattgctcagtgatcgtcgtcttaccggcgtcggggtgggaaataatcgcaaacgtgcggcgcgtttgcatttcctcttgtaatgatgccatttttatcgccttaatttcttaatttatttagtgattctttaaaaatcttaacaatttagtataacgaaaaaacggctatgattcaacaccacaaccgttcttatatacattgtattttaattgattattgctttgtccaacccatttgttgcgcgatttgatccatcgttaacccaccgcgggcgtcgatgtagttattcattgctgcttgaatttcagttgatgacaaattagccacgtcgtagcctagtgctgcccattccccgcgagccgtcgcaatgtctttcgagtcaatttgacgttcaggcgaatctgagtcactagacgatgattggctgcttgatgtcacgctcgatgaagttgttgccgaatgtgcggccgcaactgatgatgaataagctgcctttgatgccgccgttgccgcttctgcaactgatgccgccgcctctgaggaagcctttgccttagatgaaattgccgcgtgcttaaccgaatcacgcttgagcttaatctcttgcatcgcaaccttgacgttcttattcacgattttaattgcgccgtcaaccgtcgttgctgacttgtacaatgacaatgcttcttgccagtcgctcttatcagcctttttgtcggcagaaatcgcaaaatccaattgttccagcgccgtacgtgcctcaactgaaaccttttgcttttgtgacgccttatagaattggcgtgctgactcccaatctcgttgcttcaaagcggcatgcgcatttcgaatatccgaactgtattgcttgttcttactcatcgtttgatatccgaaaacacccgccgcaaacgctacaatcagtactaccacgattacaatcatctttttcataactatccccttgtctatgccctcattataaaggaaaagcaatgtccctgggtagtccaggtgacattgcttttcaaaaacatattgcgactaacgatcactgcgacgcttgatttccaagtatctgcgataccacaagtcgatgtactcgtccgaaaatgggccctgatgcttattgatccaatcaactaggattttaacatgctcctttacgataaaatcaatatccgctgggtaatgccattgtgccttgtgcaattcatactcgtccgtatcaagcaagcgcttttcaccatctggaaagacctttacgtccaaatcataatccacgtacttcaaagcttctttatctaaaacaaacggagaagctaaattacaataataagacaccccattatctcgtatcatcgcgacgatgttgaaccaatacttacgatgaaaatacacaattgcgggttcacgcgtcacccaacgacgaccgtcatcttcggtcaccaaggtatggtcattcaacccaataattgcattttcactcgtcttaagaaccatcgtgtcacgccaagttcggtgcaaactgccgtcatgcttgtagctcttgatcgtaataaagtcgccctcccgaggtagtcgactatctttcattatctgagcccctttacggcttttcaccaaattattcttttttattgtatcacgctactacctataacgcactgccgttttggactcagactatattattgaatgtttatgcacctcattcgcgcgttcgttatgcaaaactctgtatattgttacgagttttgttcgaattcctttatccacttatccacaagagacaagtcatatcccttgcgaaaaagagctgccttcagccgttttttaaattcccagccttcatattgacgataccggttaaccgctgaactagcgtcccgattcagattttcccattcttgatcggggtcttcttcaatcgatgctccataagctttcagtgcttgattaactaaacgactgtcgtagccaagttgtgacaacttttgtttggtcttttgttcagccatgaaatgtgactgacgatggtacttaatcatcaacttttcaactttttcatcgagctgatcaatttggtcctcagccgtgtactcagctaacgcatcctcaataaagtatttatcaattccaagctgttgcaacttcgtcttaacgccccgtggtccaagcttcccagaatggatagcactacgaacgtactcctcagcaaaacgcgcatcatcaatgacattggctgcttccagtcgattgataaccttagcaatcactgcccccggaatctctgattccttcaacttaataataacttgcattttagaacgcatacggcctgtggcataaactaacgccttggtataggccttttgctcaaactcagccgcctcaatttcttttatatcttcatcttctagctcggtatctttgaacaaattatatttaatcaagattttttcatctacagccaaagcaaattcatcatctaaataaacgttataacgtcctggcttccgctgacgggttacttttgtcacttttttcatgtgcggattctcctgaagttagtttgttttttctggttaacgcaagcgctcaaattaagtttaacctaaaatcgcaaaaagagccaacgcaaattgcgtcgactctttcgtatcgttctgttagataaatgatgacatacctgggttcaattcaacaatcttacccgtacgcttgtagataatccactcagcgatgtccgtcacgtaatctgacgtacgcttcaagtaaccagcaacaaccaagtagtcagttgaggcggtaaccaattctggatctgacttcatagcatcgattgccatctcacggatttcacctgtgacgtctgatactgacatggcaacttgcgcaatggcttcagctgacacagcatcgtcattcacgtagtaatccaaaacatcagaaaccatcttcgcaactgttgagccagtcataccgaccttctcttcaatggcagccacacgcttgttacccttcacgtgaatcgttgaaagcgcaatgttacgtgcgttgtcaccgattcgctccaaaactgaaacggccttcaacaccgtcacaatttcacgcaaatcagtcgtcactggttggtacaaagcaatcatctcgaaagtcttcttttccaaagcgatttcgcgttggttgattgccttatcaccatcaataatctcttgcgcagcttggcgattgtgatccaagaatgcttgtacagcgttttctagcgtctcagaaacgagcaagcccatctccttaaatgacgtgtccaagtctgcaagttcttcatcaaaatattgacgcatgacctatctccccgtttttctgttaattcgttaattcagtatatcacaagactatccgaagcgacctgagatgtagtcttgggtttccttcttagcaggatccaagaacatcttctttgtatcgtcagcttcaatcaagtcaccattcataaagaacgccgtgcggtctgagatacgtgatgcttgtgccattgagtgcgtcacgataatcatcgtcaacttatcacgcaattgcatcaacgtgttttcaaccgcgtgagctgaaactgggtccaaagccgccgttggctcgtccaacaacaagatttctggtgaagtagccaaagcacgggcgattgacacacgttgttgttgtccacctgatagtgacaacgccgacttgtgcaagtcatccttcacttcattccagatagcggcttgcttcaatgacgtctccaccatctcatccaaaacagccttgttcttctcacctgaaatgcgcaacccaaaggcgacattgtcataaattgagaatgggaatgggtttggttgttggaacaccatcccgatgtccttacgcaattcaaccgtatcagttgatggtgcatagatatcttggcccttgaacaagaacgtgccgttaaccgtcacattgtccgtcaaatcgtgcatacgattcaaggcacgcaagtacgttgactttcctgaaccagaaggtccgatcaatgctgtaatcccgtacttatcataatccagattaataccgtgcaatgcttccttttcaccgtagtagaggcgcacgttttcagttgtcaaaattttttctgccatttgcgttagcctctcttaaccaaagtttccgttcacgtaatcgattgtcaattggacctttggacgtgtgaaaatcttacgtgtcaaatcgtattcaacaaccttacccatgttgaagaaggctgtgtaatctgagatacgcgctgcttgttgcatgttgtgcgtcacgataataatcgtgtacttttccttcaactgcatcaacgtatcttcaatcttagctgatgaaattgggtccaaagctgatgatggttcgtccatcaacaagatgtctgggttcatcgcaattgcacgtgcaataaccaaacgttgttgttgtccacctgatagtgacaatgctgacttattcaagtcatccttcacttcatcccacaaagcagcttgcttcaatgacgtctcaacaatttcatcaagttgcgtcttgtcacgcatgccgtgttgcttcaaagcaaacgtgatgttgtcataaattgacttagcaaatgggtttggacgttgaaacaccatcccgatgtgcttacgcatttcgtagacgtcaacgtcctttgagttaatatcaacatcacggtacatgatgtttcccttaaccgtggccacatcgtcgttcatacgatttagcgaacgcaagaacgttgactttcctgatccagaagcaccaatcaatgacgtaatcttgtagcgttcaaacttcaaatcagcctcttgcaaggccagcttatcaccgtagaagacttgcaagtccttcgttgagagggcaacctcatgcttctcttcgtccatatcgtagacgtagcgctctggttgctcctcatcaaaaatcaaatgttgctcttcagccatgacaatgtcctctttcttacttcgtagccgtcaaacgcttgtacaacacaccactcaagtagcgagcaaagaagttgaacaacaagacagcaatgatcaaaacagctgatgcaccagcagaaacggcagccgcatctggcatgataccttctgaattaaccttccaaatgtgaacagccaatgtttcggctggacgcataatgttcaatggacttgaaacattgaatgggttccagtccgtaaagtccaatgctggggctgattgtccggccgtgtaaatcaaagcggcagcttcaccaaacacacgtccagctgacaaaacaacacctgtcacgattgatggcaacgcagctggcaaaataacgtgaccaacggtttcccaacgtgacaatcccaacgcagcacccgcctcacgttgcaagtccggaatcgtgcgcaatgactcttcaaccgaacgcgttagcaatggcaagttgaagaacgtcaatgaaatcgcacctgacaaaattgagaagccaagcttaaattgcacaacgaacaacaagaaaccaaacaaaccaaccacaactgatggcaatgatgacaaaatttcaatggccgtgcgaatcaaagacgtcacacgactcttcttgttagcatattcgttcaagtagattcccgctcccaaggcaattgggaatgagataatcatcgtaataatcaacaagtacaatgaattaaatagttgaataccaattccaccgccggcagtaaaggccgtcgctggtgatgtcaaaaagtgccatgacaagtgtggaacaccttggtacaagatgtaacccaacaaggcagccaaaatcaaaataacgaagccggcaattgcataaagcaccgcactggcaatcttattcgcttgcttagcgttcatattacatggctcccttcttagcaatagcacggataactgagttgaagaccaatgacatcaacaatagaatcaatgccaaactccacaaagcgttgttttcaagtgatcccataaccgtgtttccgataccttgtgtcaaaacagacgtcaacgtagcggctggtgatgtcaaattctgtggcatcaatgcggcgttaccaacaaccatttgtacggccaaagcttcaccgaaggcacgtgccattccgaagacaacggctgtcaaaatacctggcgttgcagcacgcaagataaccttataaatcatttgccaacgcgttgctcccaaagccaatgatgactcgcggtagtgacgtggcactgacttcaacgtatcaaccgtcattgatgtaactgttggcaaaatcatgacaaacagcaccatcgcaccagctaggattccaaatcctgagccaccaaataggtgacgcatcactggcacgattactgacaacccaataaatccataaacaacagatgggataccaaccaacaattcagtaactggtcccaaaatcttagccccacgctttggtgagatttccgtcataaagacggctgttccaatggcaaatggtgttgcaatcaaagctgaaatcaacgttaccaagaatgatccaacgatcattggggccgccccaacgtaagggtgaccattcgcatctgtttgacccggtgcccacttggtaccagtcaagaaatcccaaatatttactttattagcgaagaacgttgccaaaccctttgaagcaacgaaccagaaaattgatagcacaacaacgacaatcagcaacaaagcgccgagtgacaagtaacgaccaaaacggtccttacgtgttgctgctgattgctttaatagtgattcacggatgtcatccatgttcccacactccttaatttacagctgtaatctttccgtccatcgaacgagagatcttcatatcgtgaattgaaatgtatcccaattggggaaccaacgtcttttgaatgtgctcagaattaatgtaattcaagaatgattgcacttccttatttggcttacccttcgtgtagatgtgttcgtatgaccaaattggccacttaccagtcttcactgtcgtgtcattagccgcaacaccatccaacgttggcactgaaactgtgtcgtccaagtaggcaaaggctgcatatgaaacagcacctggtgttgttgaaacaattgaacgcaccatacctgaagaatcttgttcttgggcatctgctgattcagcacccttcaagccccacttttcaaacgtggcacgcgttccagaccccgcaacacggttaaccaaaacgattggcaagtcagcaccgccaacttgcttccaattcgtgaccttctttgtgaagatgtcgatcaattgattttgtgtcaaattcgtaatgtttgcttctttattaatcattggggcgataccaacaacggcaaccttgtggtcaaccaacttgtcggcatcgataccattcttctcttccgcgaacatgtcagagtttccaaggtcaacggctccttgttgaacttgtgccaatccggtaccagttccaccaccttgaacgttaacgaaaactcccatgttcttgccggcgtaatcttctccggcggcttcaacaagtggttgcaatgcggttgatccaacagccgtgatattcacgccactgtttgtttcgcgcgatgcgtatccccaagtcaataggcctcccgcaaccaagacgattgcggcacttatcaaccaactgcgcttcataacgaacgcctcctaatatcttctgctactagaattattatccctaatctatgtaaatgtcgcaccacttttttgtaaaggtttcctttacattaagtatatattttcaattttacgcttcgaatactcattctactacttataagcttttccaaatagtcgtgtatttttggcgtcggcagacaatctcatgtgtttgtgtcttaacggtcattgtacgtgtcggccgtactcgcattttaccagctgccacttcaaaatctaagcgaagagcctcagcaccgaccaacgaaaaacaccactgtcccagaatgggtttagcaggtgtgccctgcaagacaaattggtcgttactgagatagccaccggacagccatttcagtaacccgctaatgcgatgtggtccatccccatccggaaccgactgatagaagtcacccgtcatatctgttggcgccacgtgtaacagtcgtgagaaatccgactcagatagcgtttggcgacagcgatataatgtccagcgagcatttctcaaccacccaaattccttcgtcgcattaagctgaaattgctcccaaaattcacgccaacgcgcctggttttgattcgccaacacatcaaaacggcagcgtgatcccgtcaaaaaaaattggacgaccgttaatggacgtccattgattggtttatgcgtaatcagcccctgttcattggtcacctgcaccaacccatttgtctcgatgtaatcaacatcagtcgccggcacacataattgcatcgtggccgtgccggtaatggttaagcgacgggcgattggacggccagcctcaaattcacgcaagacgcacatgctaactgacaaccagtcaccatcggttaattgatgttcgtaacttgttaaatgacagccccatcgcatatcctcgactgccagccagatttcacctggcgccggcttaatcaagaggcgctcctgatcaaccaacaatgtccaaccacacgccaagccaggaccgtcagcaatggaaatcgcattacctgtacgtcgcgtccaaaccgcgtcttctagtaaatccttttgtgattggccagcgattgccaccgataagttcagtcgtacaatccaggcatgaggccatacttcagtgaccagtcgccaaataacgcgattctgttccttcaaaccttcattgacgataatgacttgttcaatctccgcttcatggcacaaccattcagtcaccgccagataggtggcctgtaacgattgtgtttgccacgaaaacactttttgacgaccagctttaatttcagttggtgtcattttaaaacggattgttttcatggcttggctacctcaacaaaacggcaggcatcccccacataaatgattttctgaacttgaataattgccgagcatcgatcaaacaacactgcttgttgaataaacaccgctgaccctggcgcaatttttaacacttcagcctgtgctgcagtcgccacgcctaagacaatatgtcgaaccgcatgactggtttgaatgccaaagcgacaataaaagcgttcaattgatgtcgcatccaccaaatcacttaacttcggtgcatatttcggcattacaaaatgttcttctaaggccatcggtcgatcgttcaatagctttaataccccaatgtaaatcgtcggcaagctcgcccggtctagttttagaatgtgcattaagtccactggtatctgtccctcttcaaccaaacacaatttagacgtcagcgccgcattatgagtcatttgccattctgatagttgctttaattcgcaaactggcacagcaaaaacctgtcgttcggcaacatgtgccaccttgcccttttccggataatcaagccatccttttctaataatcgtaatgaccgtcgaatcgtctcacgcccacattcatagtgagtccccaactctgattcgctcggcaacggcatgccactttgatacgtcccgttgcgaatctgcatttgcagctcttcataaatctcttcgaacacatacttccccatagtaaaaagtcccccacaccgcagattatacggtaatgggggactatgttctagacaaggtgttaactgtcaacacccgctctattattgattaatacttagccaaagagtccaaaatcaaggcaacaaacttgtcgttatcaagcgttgtcatcaattcagcgttggctggcttgccagtcatatcgtgttggtcaactaccaaacgaccacgcgtcaattgaccttgtgtttccacatcaacgtagtatgccttaccagcaaacattgatgggtcaatcaagtacgcaatcacttcagggtcattcaaaacaaccggtacatctgggttgctgaagtcaccatagttttccatcaaatcagccgcagcttgagccactggattttcgattgcacgcatcttcgcaactgtttcagatgaaatcacaccttgctcagtcaaatcacgtgtaatcattaccactggcacaccgctgttcacgataatcttagccgcgtctggatcgattgagaagttgtattcaacacctgggtaacggttacccgtgttaattgccccacccatcaacacaatcttttcaatcttgctgtgcaattctgggtgtgccgccaacaacaaagccacgttcgtcacagggccactgataccaatgaccattggttcgtcagcttcacgcaacgtcttagccatcaagtcgataccggctagttctgaaggctcgaagccaggctctgggaattctgtcccgtccaagcctgtaaactcacgccagttatcagcaagaccgaatggctcaatcaaaggcttcgctgcaccgtgggccactggaatatccgtgcgtcccaaaagtgtcaacgccttcatggcattcttttgtacgttttcaactgtttgataagcaacggttgttgaaaccgccttgatttccaccttgtccgtgttcgccaacgccaacatcaagccgaagaaatcttcgtgacctgggtcacagtccaaaatcatcttaatcattatgtcgtcctcgttttaggcaaagtgttggatgtgtggaccttgctccttgaagccagcgtccaagatttccaattgcgtcaagatttgctcgtcagtaacttccttctcagcaccgtgcaaaatcacatccacacagttttggtacatcaaaccgtagttaccacgtggcgtttccatcttgtgctcaaccggatcaccgtaagcgttgatgtacttaatcacaccgtagttgtctgggttgtcagcaccaaaattaggctctgatggcgagataccagccaaaatatcgttttcttgggcatccataccgtacttaatgaatgaaccattcgtaccgtgcaagatgtacttaggatattggtcagcaaccaagaagcttgtcttcaacttcgcacgcaacttgccgtagtacatgttaacttcaaagttatcgtcaacaccttcagggttcgtcactgacttaatgtcgtacgcaaccgcttctggcttaccccacaacttgatgatttggtccaatggatggacaccgtaaccgtagaaggcaccatcaatttgcgtacctgggtttgaagcagcacctggacggaagtagtcgaagtgtgattcgaactcgattggctcaccaatgaaaccgtggtccaagatgtattgcaactccatgaactcaccatcgaaacggcggttttggaatggcgtaatcaacaatcccttttcgttagccaatgcaatcagttccttaccctcggcaactgatgtcacaaatggcttttcaaccatcacgttcttaccagcttccaacaaacgctttgctaatgcaaagtgtgaaggtgctggtgtggtaacagagacaaattggatttctgaatcattaaccacttgatccaaatcatccgtgaagacaattccacgtgcttccaaagcagcttgatcttcaggtcgcttgttcaaagacggcgtgtaaatcgtcttaatttgaacgttttcattttccaacaaataaggcaagtggtaacggtttgcactgttaccgaagccaaccaaggccataaccaacttttctgacatatcaatactcctaaaagatactttattgctcattaattaacaaagtttattgtaagcggttgcagttttgcgtgcaagcgatttcacaatttgttcaaaaagaatttttagtggtgtggattcggcaccaaataacaaaaagggtaatagcctcactgtgccattaccctttaatgttttgttactatttacttcttgtatgcccacttccagtcgaattgtgcgccaactgggttcgtgacaaccttcttaactgaaggacgtgacaacgttgccaatgaacggtagtacaaaggcaccacgccggcatccttttcaatcgcttgttcagcagtcttgtaatcgtcgtaacgcttgttttcgtcagttacatcagtcgttgaagctgccttcacagcgttatcgtaatccgcgtttgaccagcttccgttgttaaacgttgattctgatgtgaacagatccaagaatgttgaaggttctgcgtaatcagctccccatgctgagataaccacgtcaaagttcttgtcctctgacaatgccaaacgttgcttgaatggcaccgtcttgattgaaaccttcaaacctgacaagttttgtaattgtgattgcaagaattgtgctgtacgctttgcgccgtctgtgtcatcggtcaagacttgcaagttcaacttcttcttgccctcttccttcaatccttcagcaaacaacttctttgccttagccttatcgtatgaaatagcgccctttactgcagctgactttgcgaagtccttgccagtatttggatccttggccaagttagctggcgtcaacgttgttgctggcgttgccgttcccgtcaaaatcttgtctgacatcgtcttacgatcgatggcgtatgacaaggcttgacgaatcttgacattcttcaaagcggcaaccttcttctcgttcaactcaagatagaacgttgttgcttgtgggataaccttgtacgccttgttcttctttgaggcacgtacttggtcaggtgacaaattggtaaagtcaatcttaccagacttgtacaagttataacccgtgttttgatccttaatcgtttggatacttacctttggtgtcttaacagtcttagcatcccaataattgtcattctttaccaatgagtacttgttgtttgagccagtccatcccttttgaacgtatggtccagatgccaacgtgtactttgaagcagttccgtacttgcttccaaccttctccacgaacttttggttttgtggatagaatggcgccatcgtcaaaattgattcaagttgtggcattggcttatccaacgtcacttccaacgttgtatcatcaacggccttgacacccaggtcattcaagtccttgtccttacctgattggatatcatcggcacccttaatacctgagaacaagtatgcatattgtgatgctgtcttaggatcattcgtacgttgccaaccatatacgaagtcttgggcggtgattggttcaccattcgcccacttcaagtctggacgcaacttaaacgtatatgtcaaaccatcatctgacttttgcactgattcagccaaagccaattcaggctttgaatcttgactataacggtacaatccttcgccggtagcttgcaaagcgtcaaagtcaactgaagccgttacctttgatggatccatcgttcccaagtcagatgtttcttgccagttgattgtcttatacgttgctgcgtttgctgccaatggcgcaactgctgatcccaaaatcactgcagtcgacaacagcactgatgtctttaccaatttgttcatatcccgtattcccctgtttcttgcacttttagtatgtggattaatataaactaagaaaaaagaagtgtcaatgccatttttctctaatgttaataaacctaacatcacaaatgccgtaaacgcccgcgtttgggcatttcaaaaattagaaagttttaattttattttaggtaacagtcaaaatgtacaaaaaaagcgagcaattatgctcgctttttaaatcagattaaatttcccaatcgtccaatgaatcaacttcatgggttggttgttgtgcttcttgggccacttgctccttcgtagaaacaccggtgtaaaccaacaacgtatcaatgccagcattcaaaccggcacggatatccgtgttgtaattgtcaccaaccatgacaacttggtcagccgtcaatcctgttagttccaaagcaccgttcataataatggtctctggcttaccaacaacgactggctccttttgaacggcggtacgcaaagcagcgacaagtgtgccggcacctggcaacataccacgctcgttaggcaagttcgtatcaacgttcgtcgcaacaaatgcggcgccattttgaatggccaacgttgcttggaccaacttttcatagttgatttcgcggtccaaaccaattgcaacagcatcagctggggcctcactaacaagctcaaacccctttgcttccaaagctgtacgcaaaccaatttcaccaatcatcaacacacgcttaacgtttggcaaagtcgccaaataatcagcggttgccattgcacttgtgtagacttggtcagccgtcgttggaatgtcgtgattcttagttagattctcggcaacttcggctggtgtcttcgttgagttattcgtgacaaacaaatattgcgaatcagacgcagcaaggcgctcgatgaaacgcttaccagccgggaactgcttggttccttggtaaatagtgccatctaagtcaataaaatatcctgcgtatgtcatcaattaatttccttatcccttttcagtcgttgtttggcgctcacggatttggaaacgacgacgcttcttacgtcccttcgtttcaaccgtgtttgcgcgttcctttacatgcttagctttcccgttacctggtgctggcttagttgtctcagcaattgctgccgtctttggctttggcttgtggtgtccaccagccgtgttgccgttgccgttactgttgccagttgaacgacgttgacgacgacgcttacggtgtgccgtgtttggctcttcctcagcttcaggtacatcatgtggctcaagattttcaagcacaaagtacggtgcaccaaagtttacttcttcatataagtagtcttgtagtgcagaaatttgattgcttcgtgcaataccagctgtgccgtccttgtaaaagccacgtaaacgaagctgatcagccgcaatgtcaccaaccagaaaatcatacttttctaggaagtcgctaaatcgtgccgccattttttgctgattgtaagcttcacgatagtcttcaaccaaacggtaactacgatcattaatgaaaatgatattatcgtcaccagccgtgatggtcgtggcttcttgtcgctttataaattgctcttcagcaagttctttcatgcgttcgcgatccatgttttgcctccttcctaattaattttcttctttatttggtaaaaacgtttcggcaagatatgccgcaaagtcctctcgaattactgtatcatatgacatcacgttctgtcccgctatttccaaagttgggaagtacggaatgaacaagtaatgatccagcgaaccaattgtatatgtcgcgtctaaatcaattggctggtcatgaataaacacatccccattcgcatcgatgcggaggccagaccaaaccacttcaccccaggtatcaccacggaagcccataccgcgtaaccggttagggcggaggaagttacggttcttctcgatttcgtgagccaagcgccataaatcatggcccttcaatgttgaacgcatggggtgaaccgcgtgtggtagcaaggcatgtaaatcattggccgttacaataccagctggcaaatccgtcaaaaacaaacccgttgagagcatcgcaacatccgtgtgtgtgcgtgccttcaacgcttcaagaccaaggtcaatgaggcggtgctcgccttgcaatccgttggtgtaagctgttggcaattcagcaaccacgcgcttggccagttgctgttcaccactcgtttgataacccgcgatttcaacgcggtcttccggcaacgtcggcaactcgtccgtcacaaccgtcgtcgcttcgacagccgatagatggccatcctcaaccgttaaatcgatgcgaccaatatgatcaccatagcgtcctgcggcagccagcattgtgtcgccgtgacgttcaccattcaccaacaagtggtgcgtgtgagcgccgataatcacgttcagctcaggataatgcgttgctaagtaacgatccgttggcaaccccaaatgtgataacaacacaataaaatcaacttggtcagttaattctggtatctgtctatcaagggcgtcagtgaccttttcgggcatccagcccaacaaaggtaatgtcaaaataaacggtgctgtcaaaccaagcacgccaacgcgcgttccctttggtgtggtgataattttatgtgtcaccgcccagtcaggcacttcacccgtttgcatgtccgtcacattacctaatacaactgaaaaattagcatggtcatagagatgattcatatcatcatgagccaagcctagtccttcgttattgccaattgtgaccgcatcataaccaatctcatttaacaaggcgacattggcttgccccattgtcgcttccgtcaatgggtgttggcggtccaatgcatccccgatatcgaaggtcaacacactgcgtccttcacgaatcaaatgacgcttttgtgtttgtaaataacggcgaatttttggccagtgctccagatgcgagtggatgtcgttcgtatgcaaaattgaaatgttatcctgcatacgttttacctccgctttgcaaaatcatcgtgcttacgttgaatgatggtctcaatctcattgaaattgagtggcgtactccagaccggccgttcatctgccattaagtaatccaagtccgtactatcaaccccgacgttaatattttctggaattgccaccatcgtgtggtgaatgtgtccgtgcaagttaatactacttggcgtttgaccgaacaacattggatagtgcgtcaagaagaattggtggtggttcgccttaataatgcgaccaacatcctcaaactcatacttaggcttgccatcagacaacaccggattgtgggccgccaagtacttgaacaacgcgcgtgaatcgtggtttcccttaatgattacaatgtgtccgttcaattgttccaaaatttcggcaatcatttcgtgacccttacgtgctgggcgtacatgattaaccatcgcgatatcacccaagtggtacacggtgtcagtttccccaacgcggtcattccaggccttaatcattgcagggtgttcatcggccaaaaagtcgaatggacgtggtgcaaaattgttgctttgcaatagttcctcatggaagaaatgcgtatctgaagtaaaaaattccatttctctcgcctctcaattagcggagtcgaccgccttcgtaactcttaatccacttctcaaataattcaaaatctgccggaaaatcattgtacccaacaaaacgcaactcatctggttgatcggcaaacttaatccgaacaccccattcatcagttttgtcagtcacaaccccacgatattccggttgccaagttggcaaaatttccattagtcgacgttcaatattcggccactggaatgaaacatcttgccacattgatgcaaacgggcgacgcttatcgtcagccagcacctcatccgcatttgtgcgtgaaaaatcaaacgttgcgtctgtaatatcagcgaacgttttcatttcagctggcacgcgcaaataaaaggcatgttggtcagtctgcttagcataaatataatcgaacccagctgctaaatttccgcgataataaacaacgtattctaatgccatattacttatcaatcacaattaagtctgttagaatacccgccgtcaagttctcaaaaccgtcagccgtgacaatcacatcatcttcgatacgtacgccacccttaccagcaacgtaaataccaggctcaatcgtcaacaacataccttcacgaacgatgtcttcggcaggtgagcttgctgacaaaacaggtccttcgtgaatatccaaaccaattccgtgaccagttgagtgattgtattccttaccgtaaccagcttcagtgataatgtcgcgagcaaccttatccaggtcggcatctgcaacacctggctttacagcgtcaattgtggcacgttgcgccttaagcacaacatcgtaaatcgtctttgactcatcatccaattcgccaaacgccaacgtacgcgtgatgtctgatgtgtaaccatccacaaagtagccgaagtcgattgttaccaaatcacccgcttcaattgccttatctgagtacgttccgtgaggcaaagctccacggtaaccagatgcaacaatcgtatcgaatgatggcttatcagcacccttttccttgatgatgcgatcaagcaagttagcaacttgacgttccgtcatgccaatgtgcaattgtggaatcatctcgttgaaagcctcaacagccacttcagctgaacggcgcaacttagccaattcgtcagtatccttcacttcacgaatggcttcaagcaacgctggtactggtgcaatatctacgccaacaaagttttcatccaagtaatcgaagtcacggaatggcaacgtgtcttcaaagcccaagttttcaatcttaaatcgcttggctgctgccatcgcaacaccccagtagtcacgggtaaccaacaattgaacaccctcatctaggcgttcgcggtattcttcttcgtaacgggcatcggtaatcaaagcggcgttttcgcgaccaatcaaaaccaagccatccccagttccaccttcgaagccagtcaagtaacgcatgtttgtgccgttcgcgatgatcaaaccatcaattcccaatggttcgaacaagcgacggacattttcgattcgtgtgttcatgattattttcctcgttttcttaatgcttccattatagcaaatcccacctgtcacggctgataagtgttgtcttttcggttaaatcaaaaaacagtcactcattcacgagcaactgtttgttcttaggctttaaaaatgatgattggcgctgtttgtaaggcgtgaattgcctcccaatcaagtgcaacaccgatgccaggttcggttggcactggcaacagtccagcatgtaataccggcgcatccaaaataatatcccgttcaaagtaacggtccgcttgcgaattatcactcggaatactatttgcgcccggtatacttgctagcgtcgcatcaacagcgcgacccaggccagaacttagcatgccaccaagccaaggcaatttgccagccgctagcgccagctcgatggctgtttttgcagccgtaatcccaccaattttggcttgcttaatcgtaaaggcatctgccgtttgatcagccaatgcgcgtttcacatcagctaattcatttagtgattcatccaggctgatgtgcatttgtaaacgcgcttgggcttgttggtgtgcctgccagtcatcgattgcaaacggttgttcaatcatgaaaatgcctgcagcctcaagttgttgtagccgtgcaaagtcagccggttgccaagacgcattcgcatcaaccgaaaattgctgatgcgggaattggctaataaccgtctttagcatatccaagtcagtttgctgattgattttcaacttaatccggcggtagccttgtgaaacggcatcactaattgacgacagcaacgccgtcggtgagtcagcaatgccaatcgcaatccccaccgcaatctgtgatgccgcaccaccgatcaattgttgcaacgattggtgcgtcgccttgccataagcatcataaaaggccatttcaagaccagctttagcgaatgacaaagtcgactgttcagctaaccagttggctatgtcggcgggtgtcgcaaagtcctcacccagtagcatcggtgccaatcgttcaatttcagtaattgactccgcgtgtgattctgaagcataactgtgatcaatgaaagattgcacatccccatacccaatcacgccatcaaccgtcatagcaatcaatgttagtgggcggtcatatgtcacatcatgcgccgttttaaatggttgcttcaagcgcaacatcaacgggcgtagttcgatttgttcaatccgcatcgttagcataccccatcaggatgtctgtgacttcgactggcttttcaaagtgcacattgtgtccagcgcccgatacggcaacacgtactgcattgggcaacatttcagccatgctgtcattaatcgccgtaaactttgcgtcatcagcaccagtgataagaaccaccggaaactgaaggtttgttagttcaggccaatagtttggcatggccccagtaccaaaaccacgcaatgaattcgcgacattcaccacagtttggttaacgcgttgttcgtgcataaatgcttgttgttcagcggaagcattttgttggctcgcaaacagtggcaacttttcccaatcggcaacaaaggcaatcatgccctcgtgctcaattcggtttgctttctgctcatcgctcgccacccgcgcttcacgcgctgcttgatcagcgattcctgctgtcccgctctctaagaacaaacgctggagacgttcaggaaattgttgggcaaaggccaacgccaaacgcgcccccattgaataacccaccaagttaaccttgtcgattcccaacgtatcaaggattgccacaatatcaagcgcttgattagtggcgtcaaatcgttcgcgcgccacagctggcgtttgaccgccgaaccctagtaagtccaggtaaatccgcgtaccagccggcttaacctgttcgtagtccgctaaacttcccataaagccatggaaaaatagccacgttggttcgccagcaccttcaattcgtacatgatacggatactcgtttaccagcactagcttatccattgaaagcctcacgaatcttggccaacaatgcatcgtgttcagcaacgttttgcgtacgcgtactttgcacctcaatcaaacgaagtgtcgttgcaggttgcgcaatcaactcacgcaaatcatcttgtgacgtcgccaaatgatactctgcatcataaagggccgcaatcttctcaactgacaaggccaacggcgtcccgaacattggttcaaagtaatccttcgcagctgcttgtggtaggaatgagaaaatcccaccaccattgttgttcacaaccacaatcgtcatcgccaagttggcttgatgtgccatcattaaaccattcatatcgtggaagagcgtcaaatcacccgtcaagaatgtcgttggcttgccagtcatcgccatcccaaaggctgatgaaactgtcccatcaatcccatttgcgccacggtttgccatcacatgcacctttgtggctggcataaagtaattgtccatgtcacggattggcattgagttggcaataaacacttggctatcagtcggtactgctgccaacacgccatgcaaggcaacttcagacattcccgtcgttgcaatcgcttgtgcaagagtttgcttaaccgcttgccattgtgatcgataatcattttcggtacggccggcagttgccaacagctcatcaatcagcgccatctcatcaacagccaaggttgtggttgtttgacgtgagtggtcgtgaccagcatggttaataccgacttgaatgacttgcacttgcttatcacgtagccaagcaacaacccgggcagaaaccggtgtaccaccaaagcgcactacgacatcaggtacgagtgcatcatcaagcgcacccgcttcaagcaacgcatcaataccattaatggctgcgtcactggggcgcacgttactcaagacatccgctaacattggcgcttggaagtgttcagccagcgcaacaaacttttcggcttgccaccccgtctcatcaggtccgaccaacattagtgccttttcatcacgaagcttgttcgcaagcattgcgacagttgcttcatcggcacgcatcgttcccacggtaatcgtttgttgcgttaccgttggccatgcttcacctaggtcaggcatcagcggcttgcgcaatggcaaattaatttgcacgggacctgctggtgcagttgtcgccgtcacaacaagttgttgcacgtgataatcaatatacgccgtcacatcagcgtggtcatcttgcatctgcaatgcactaaatgccttggtgttgtcaccgtacatgttcgcttggttaaccgtttgtggtgccccaatttcttgtagttcttctggtcgatcagttgtcaacgcaatcaatggcacgtgcgaaatgtgtgcttccattatggctggcaagtaattggccgtcgctgttcctgacgttgccaacaaagccaccggttggtgcgttgcctttgccatacctagcgcaaagaaagctgctgagcgttcatcaacatctaccgtcacacgtacgtcatcacgaacagcttgcatttcagctagtaacaaagcgaatggcgttgtgcgtgaacctggtgataccacgaagtcatgcacaccttgggcaaccaagctggtcaataaatgtttaatgtttcgcgtcaaaatctcgttcattttgcttgtccttctaataaattcatcataggttgcatcttcaaccctgtctctgcatattcagagtccgcatttgagtcggccaaaataccagcaccagcaaacaagtttgcctgcgtaccagtcgcccacattgaacgaatgccgacaatcatttcgccatcgccatcaggcttcacaacgccgattggaccagcaaatagccctcgtggttggcgttcaatttgcgcaatcgtcgccattgcccagtcaaccggcttgccaccaagtgccggtgttgggtgcaaacgttcagccaacacaaaaacggtgttttcaccacgtagtttaccggcgattggcgtgtacaaatgttgtacttgcgggttcttcataatttgtggaccatctggcaaagttaagtcagccacgtcacctagtcggtcaacaattgtttcaacaacataggcgtgttcttgcagattcttagcatcatgcaacaattcatctgctaattgcccatcttctgtttcagtctcaccacgacgaatcgtcccagcgacaccggccgtctcaaattggccacggttcactttagccaagcgttcaggggttgctgaaataaacacctcatcgccacgcttgatgaccatgtgataactattaggttgttgatcagctaaatctgccaacaacttggccaaattcaattgaccagaaatcgtgacttgtcgttgccgaccaaggacaaccttctggtgagtgtcattttccgtcatatcttggatggcgttgttcacgcggtctggccaatccgtttcgtctgttgttgctacaattgcaaccggttcttggcgatatggcgcaccaaacggattggtctcgcgtccccacaagtattgatcagtgatgtcatacaacaccgccggcaaaacaaaataaccattcattagttggctatccggtaccttttggtcatcgaatgcaaatccaccaaagactggatagcgttgttgctttgcccagtctgcgacttcttcgaatgatgccccaattaattcttctgcgataccaaagccataatagcgtgaccgtttatcggccgttgcaaaataaacggcattttcagcttgcgcaaagcggtcgcggagttgtttttcagatggaaaactcatgtctatacctcacttctgttctactagtatatcactcgtttgtaccatacacgggccacattttaagtacgttacaatttatcttgttacacttttaacaaagtccatagtatactatcagtatgcagatttatcgcatcgatttctcacaattaatctcacaacttttgctggtaacccagcatttacctttcaaatcgaacgctgcatattagctcgcttttgccactctcttggcataggcgggctttttcgatacctacaaaaaagagaatgtcgcaacattctcctaccataatttattcaaattgggcatcgtacaacgtcttatacgtgccaccttgcgcaagcaactcatcatgggttccacgctcaacaatttgaccatcgttcaacacaacaatttgatcagcattgtgtaccgtactcaaacggtgagcaatcacaatcgttgtcttgtgggtcatcaaattatccaaggcatgttgaataatcttttcagattcgttatccaacgccgccgttgcttcatccaaaatcacgatttcagcgtcctttaccagtgcacgcgcaattgacaaacgttgcttttgtccgccagacaacttgacaccacgttcaccaacagtcgtgttcatcccgtccggtaagccacgaataaagtccgccaccgccgcacgttcagccgcatcccaaaggcgctcatcactaacatccccagaaccataacgaatgttatctgcaattgtcccatcgacaatcgtgacgtcctggctaacgattgaaatatgttggcgcaaatttcgaatatcgatatcttcaatcttcatatcatcaaaacgaatctcaccaccagtgcgctcatagaaacgcgtcaacaagcgaatcaaggttgactttccagcacctgaacgaccaactaacgcggttgtcttaccagctggaatcatcaaattaatcccgttcaaagatgctacacgctctaagtcatagctgaacgtcacattctccagctcaatgcccttctgcaagggacttgggaatggttgtgggtcatcggcatttttaattgtttcaactgcccccataatgtccttgatacgatcgtaagacacttgagccgtttgcagcatattcagcaaacgtgaaaatgaacggattgggtcttgtagcaacgccaagtaactcaagtaggccaccaattcaccaactgttaaatgcccttgaatgaccaacaagccaccaaacgccaaaacaatcgccgttccgatggtattaatgaagttgaccaaaggttggaaaattgcctgccaacgggttgcttcgagttgatacgtattttgttcttcaacgatatccttgaagcgacgcgtctcttcatcttccgtcgtatagctcttaatcaactcaatttcggtaatcgtcccttggagttgatttgaaatttgcgaactcgtcgcacgaaccttggtgtacgcttcacgaatgcgtgcacggaagaagcgaattgtcacaaacaacactgggaacgtgatgctgaccaacaacgctagctgccaatcttgaataaacaagaacgtcaaaacagccacgaacgtgaaaatattaccgataatgccaaaactatctgaactgatcaagttctgtaggctactgatgtcgctggtcaaacgcaccatcaaatcacccgttttagcactttggaaataatcataatcttgcttcaaaatgcggttgtacgtctgcaaacgtaagtcggtaattgaacgttgtgacaacacctgcatcaagtaagttgaaataaacgacacaacgcccaaggccaaggtcgttaccaacaatagtgacacttgcacggtcaaagcagagacacttttcaatgccaccgcatggtcaatcacgcgctgcgtaaattgcggcacgatgaaattcaagcctgcgataataagcaacaacaccatgtttaacactaacaatgacttacgctttaagacgctaccaaacacgaacttaagcatctccgtcaatgttgtatctgattcttttagataagccttcatttcagaaggactcatccggccacgattcatcatatctcgtcacctccacttcattttctccgacaacaatcataacaccgctgacgaaaagtgagtgcaaaagggttcgcataaaaaagccgaacccatgacgagttcggcttttcataattattgttgtggttgcaaaacttcaaccattgcaaccgtcgcttccaacggttgggccttcacaccttgatgttcaagcttaaagacctttggatttgatgcaacttcaatgtagtcacgcatctccaaataccagctagccaagaaatcaaactcaaccaacgtatccaaccatgacgctgcatcatgaccatctacgacttgtaggtgccagatgccttgcatttgcaagatacgaacttcgatgttgtttttgacaaccatcgcagccccgttcgccgtgcgcttcaagtaataaccactgtgcgctgagtgaacgaacaagcgatccaacaagcggtctggcacgtagctcggaatgagttggtagatatagctatcagctgtttccaaaatgttgtaatcaactgaataacccaacgtttgctccatgtagcgaccaaataccaagagcatcgctgcaatcttgcgaattgccgttgacgcttccttttcgcgcaaatcaacaaccagtaagttagtcaacgcttctgaattaaacaacaattggcgttgttcaggtagccaaaatgccacttgttcaccagtacgttgctcaaccaaataagcaccaccttgtgtccccagaacaaagcggaacgtaactggcgtctccagtcccttcacgcgcagtgtcaactcttcactgtcctcagacatcaaaattgtgtatgcatctgacttggcaaattccataaaacgattcatcgccaacatgtaaatgtcagccaaaccatactgacgtggcacctgtacccacttatcatcaagcaatcgttggttcaatgccaacagcaaaccatgcacctgggctggctcgtttgattctgacaaatcgtgcacgttagtaatcattgtttgaacacggtcaaggtccgcttgcaagtgtgccgtgtaccccgttacacggtcatgtaattccctaagcatgttatgttacttccctttactctttttagctgttggcttggttgtttctacctcaccagccaatgacttcacatagtctgcatatagtgactctgcctttgcagcaaacgtctcaaagtcaccgaaagtttcttcaatagcgtgttgttcataagccaagacagactcttccttttcaagcgccaacaattgttcttcgttcttagcgattaacattggcaagtcagcagccttcttatcagtcgcatccaatgcatccaacttaacttgcaattcagctagctcatcaccatttcgcttgaacaagcccttcttgttttcgagctcagtctttttctcttccagctcagcgcgttccttatcacgatcaggttggccagcaaccgtttcgcgcatacccgtcaaaagacgttcgatttcagcacgctcagttgcgtgaacggtttcttcagtctttgacaattcaactgactgcttcaataattcaaaggcagccttgttgaaaatgaacgtgactgaaaacggatcaagcacaccaaattcacgacggtcccaccagtcaccaaagaacaagtggaataccccaacttccgtttcttcatagaagaagaatgggaacttctctgacaaataagcaatcaaattcttagcaacatggtggctaatcttaggacgcaaatcatccacaagtgcagccaacacacgattgttatccgcaccagctgcatcatgcaccgtcatgttgtaacgccgtgcatcaatcatctcaaaaatttgacgatcatccccagccataatcgcctcttcaaacttggtcaaaaaggcttgcttcttttgcaaatcgccttgtagttcgtcggccaagttgccagtctctgtcttataatatggcgtttcttccatgacccctcatctccgtttttctcgtttttgttaattacaattttaccataggaaacttaattgtagcggtctccaccgagattcaacatctttgaaacaaaaaaggccgcacacctagcaaaacgccaagtgtgggccttccttatcaggaattaatcccttgtttaattattaatgcatcgtctgactaccggccaggctcaactcagtttgcaacggttgtacgcccgtcaacgcgattgatcgtgaatctggttggctaacaccaactgagatttcaaagcggtcactatcaataaagttgcgaccttgcgcatcgaacacttcaaagtcttgcggacgcaaatcaaacgtaattatttgcttagcacccttacccaaatagacgcgcttgaatcccttcaattgggcctttggcaccgcaaattctgattccaaatccttcacgtatacttgaacaacttcatctgtgtcaaaattacccgtattttgaatcgttgccgtcactgttgccgtatcttcatatgacttcacttgcaaatctgacaattcgactgatgagtacgtcaaaccataaccaaatggatacaatgcctcatccgtcatgtaacggtatgtgcgtcctgccatgttgtaatcttcaaacgctggcaaattatctacattcttgtagaacgtaacaggcaactttcctgatggacttaccgcaccaaacaagacatccgcaacagccaaaccaccacgagcacctgggtaccaaatttgcataatggcgcgcaagttagggtggttctccaaaccatccaattgcaatgatgatcctgaagccaacagaacaaccactggcttaccaacagctagcaaacgctccaacaattgacgttgacgacctggcaatgacaagtttggcttatcaccagcgccctgtgagttaccagcatccccttcttcgccttcaatcgttgaatcaagtcccaagactgccacaacgacatctgagtgttcagctgcaataaccgcttctgactcacgttcatccgccttagccaacggctcggcagcgtggtcttggaacaatcctgacccaatgctgtagtgaactcgcacatcatcaccaagacgctcttgaataccctccaagatggtatatgaacgtgatggtgtaccgaagtagttacccaacaaagcgatttctgagtgcgcatttggcccaacaacggcaatcgcttccatcgtttccttgtgaagtggcaaaacgccatcattcttcaacaaaacaaatgacttctcagccgcaatttctgacaagttattgtgtgcctttgtatcgttcgcttcgtacggaatggcatcgtactcattatccgttgcaaacattcctaggcggacacgcgttgcataaagtgaaataactgcattggtaatttcttcttcagtcaccaagccacggtccaacgcttcatgcaaagattgctcgatgtgaccagcaaccaagttcaagccggccttgatggccaatcccatcgtttcagcggcatcctttgtatacttgtggttctcatgcacatcttctggcgccatgtaatctgagacgacgtgcccttcaaatgaccacttatcatgcaaaatgtccttcaacaacatttcactcactgaagctgggacgccatcaactgcgttatatgccgtcatgatactttcaacatcggcttcttcaactgccgccttaaaagctggcaagtacgtctcgtacaagtccttgtctgatacgactgcatcaaacccgtgacgcaaaccttccggacctgagtggacagcgaagtgctttgccgttgcagccaacttcaagtacttagcttgcccttgcaatcccttgatgaatgccacaccaaactttgacgtcaagaatggatcttcaccatacgtttcatgaccacgaccccaacgtggatcacggaaaatattcacgttaggtgaccagaacgtcaatcccttgtaaatatcacggtcatcatgcttcgtaaattcgttatactttgcacgtccttccgttccaatcacatcggcaatttcattaatcaagtggtcatcaagcgttgccgcaagcccgattgcttgtgggaaaaccgtcgccacaccagcacgtgccacaccgtgcaacgcttcgttccagtagttgtattccggaatgttcaaacggtcaatggctggtgcttcatacttaatttggccaatcttttcatcgatcgtcatttggtcgacaatcgccttagcttggcggcgggcttcttcgtgcgtgagttgctgggtcatatcaatactcctaaacataaatcatttcaatatataataattttgaaagcgctttctaacaccgttatttataccatgtgttatgtttttcgacaaaccacctaaatgcttaccaaatatgaataggacgataaacgatatacaagcatcatacctgacacatacgttaatcgattttactttatttgacttgtgatacatttcacacattgtgaatgaactatgcacaaaaattgattaacataaacgtaatattttgcatgctaaaaaagcaacgacactattgtggttcgttgctccttcagactatcgaccaatagactcacttaaattttctgcccatacttcagcttttttactgaactctttgtccatatttgttacttcaaaaagcctgctaattgaatcactaaaaatagactttgaactaacaaaagattttccactaaagtcaccgagtttatttaataccagttcctttacattcgaaacgtctgactcaaactctgaactattttggaccgttacgtcaaatggcatgccaaaaaacattcctgccaacgtcgcgaaagtatatgcttcgccaaactctgttaattttgaatgattcacaaccgttttcccaggcccaattaaaccatttaaaatatatgctacatacattccacccaaagtaaccaaatcacgttcactcatttgaacaggatcagagcttattacagcccaaggatgtgctccgccagaagtccctttctgaatagatttccaaggaaaattatttcctaaatttgccttaactacctcagcgaccgtgtaaccaacatttttttcgacttcagaatcaagaaacatccattcatgataaccaatctgcttttcgaataaactttccatcgctgttctcctttttataaattggcattttctaaaaatcacttcgacataatgacatctttagcatttgaatcttcagtaaaactgttcacgattgtgtgtccattggctgtcatagattgattgccaaatgtaacgctatttccagtcacttgataaggaatacttttacctgtaccaattgacaaaataattgcctcatcactaatggtatacgtcgcattgttttttggattataacttccaacgctagtccactcgacattttgaccatccacaaagtagaaatacaaggtaccatcatgtagcaaattttgtggtgccccattattcatcgcttctgctgcatccatgccgtcataggtaactggcttttgcacaaatccgtgtccgattagcgcattttgcactaacttaatcttagattgagctgcattcgcactagattcgctggcagctttttcacttgccacctgttcgctcgcagctttttcactagctagtttctcactagcggacttcgctgatgctgaacgactttcttcgcgactagccttttcagcttcggtttttttctcggatgatgctttagccttagaagaagctgtttttgcacgctcagcttcggcgcctttttgttgtgaataagcaaatgccccaacgccacccccaacaattacaacagcagccaaagtggctaccaaagcttttttacgactattccggttgttcttaggatttttcgcaacacgatttgttgcttgtgattcctgttgattcatttcagccaacaagtttgttttcagcgtgtcgaattcttcctgcgttaaagtaccggaatccagcatttccttcaatcgatttaattcacttgttatcttgcttacatctgccatcgcataagacccccacatactcataaatcaaacgtccgtaattccaaggaaattttaccacgcacttaaaaaagtactgagcgaaacgacttgcaagcaaaacaaaaaagacagcatcacgacctaaatcgtaatgctgtcttttaacagtctattaaactgatttcaaatcttagttaagtaataaattacttagcgataatatataccgcctaaactgacaaacatcaccagaatatcgggcataaaacgccttgttttggctgcatatgtgcgatatatgcccgaatattattggctagtgaccaaagagtgaccacaacaatataacgatatccatactctattaatatcagtcaacacatgatttatcagctactggtaaattttataacctgtgcttgtctgaccccggtaaacacgttgggaaattttctttcgtgtaacgtggctggtgaaaaccagcctttttttgtacgactaaacccagcaacttgcatctttttgttgttgttgataagtctatacaatataaattctacattgtctaatctgcgcggattcatatctttaatttgtataaaaacaggcgaagtatcaagcgttaaaaaagtatgcaacataaaataaaatgcatcaattctagacctaatttcattaaaatttaaatctgacgtgacatgttgcattgtcaaagatccatcttttatggccgctattatatcctttgccctcgaagacttcacatatctttttaaagaagccattttatgtaccccgattagatgaggaaaattctctgcataaaaaactatatccacatgactaatctttctgtcgtttgtctcaatgacgaagttgacccccacaagctctacgtactcactatatagctcaattaactcaatattcttatatacttgttttcccataaaaaaatccacacatataaatgtgtggctccaaacattaaaagtatgtatagtagcgtgcggatttcacctccgcaggggtagacgtcattttttcatccaaatgacaggaagcatgctgccactctagcataccggaataacaaatgaacagctgatcagacactagctacatttgttcaataaaaataataacatatctcatttttcatatcaagaaataacacacccgtacagtcatttggtatatatcaggcatatacataaatagcttctaatttattatttgttacatgtacactgcctttaattattacaataaaaagcccgtccagattaagtacttttgtacctagtccagacgggctttatctatttgtgaccgacaatattgtcggtcacaaactgatcgaattcgacagtttaaatcctaattagcaaatgtagcttgcaaccagaccgactcaccattcatttctacttcgattgatgagccaacgcgttgcaataccttgtatcgtccattcaaagtgaagtattccggaactccgttgttaccaaggccgttttggttcgccactgggttaccatgacggtcggtcaacgttactgatacagccggcatgtcgttgtgataatctgctaccggaatagccatatcattgtttcgaacgtacacaccacccagttcatattcccagctatctagatagaatacaccgttaaactccgccgagtcagcttgcgcgttagcgtccaaaatttcgacattcttcttgtttacccatgagtaaatatcatcaagcaacacgcggtcaccatcaacttctagtactttgtgtggcacacccttaatgaaatctgggatagtttcaccagtcgcatagtgtgtagcgctgaagttaacctttacggtcattcccgctgcaatatctgacttcggagtgttgtcggcttccttaccggcattcacagctggcgtgtccgtgtttggcttgctaggattaccgttcttgtatccgttgtccgtgataccagtcaggtcaacattaccgtcaagtccaccagcgatatatgatgccgtgaattggaacaattgtacattatcaaatgaaggaaagtaattatagtttggctctggcgtaacctcgtaattaggatactgagccaaccaaagcgggtacttattagcaatcgcttgcaggtcaaggtttgacatcaagaaattcttgtacccgtatagcacagctgtctttccctttgattgaatataatccaatccgtacatgacgacgtcagtattcgttgcgccttgctcaatatccaacgcaaagattgcgccttgtggcgtttgactttttgctagatagtggtcaattactgccttcatagtcgcacggtcagtaacaccgtctacgaaaatatagtcatgcgcgcgttttccttgggcgattgcatactgaacttgcgttggatacgtgtattgatcaacatagccatgtccagcgtagtacccaccaatttgagcgatggcaaacttatcgtgaccatatccaaacttaccttgcgaaccttggtagattgaccaatcaacaccctggtcgcctttggcagcatatactgatggtactgagcccataattaaaagcgctccagtcgaaaccaaagcgcccttgagcaatttattcatttacttctcctttcatattctttactgcagtttcgatagcgtcatcgatctgcttgggtgtgaacagttggccaattctttgcttgaacaaaacatcgttaagttgcttgattgcctgagccttctgtgtctggccaccatcaaaggtcacctcagcccatctcacgacaccttctgcaatgccgagcaatttcgttagcctcttattgtttgcaaaacgctttgaaacccagccaatacccaaaattaaaagcgctggagcaatacctgactgccatagcgcttctgcaaacgttattaagttattcattgtcatcgtgatgctctctccagtcctcgattactctgatacgtgtttcgtggtcatcaatccgtctgtcataggacttaagggtttcctgtaatccatcgatagacttattcaaggcgtttatcgacttaacaaaggtcatcttgattacgaaccacattgcggcacttagggttgccagaactgtgagccagcttgctaaatcgtgtggaaaaaatcccatgcttatacctcactagttctttggtagcggatcacttgtgatgtaaataaagttaccttcactagcgccctttgctacgaatttattatcaggtgtaaagtacgcatcaaccccaccaccagctatcacattcactggatactctgtcggcgccttatatccatcattagttcccaccggaaatgtacctgcaaacttgacaacgtatcgccctgtaacaaggctaccaactcttgtatatgtgattttcaaatcgttagttgtaccgatagttctggtataaattttttgctttgaatctactgttccagaaacgtttaatttgttgaccttcacgtctccgagttcgatttcacccgtcgtatcgtcaattgagacgattgccttagcaagcttctcgaaattttgttgaatataagtaccggcattcgccataccatcagtaatagttttgaataggctcatgattagtcctcctgtgggttcttgtagccattattttcaataaggacaccaactgagcgatgtccttcggtaagcaagtatcgaccgtcgccctggtcaagaatgttaggcgaagtcagtgcaatgttatccggcaagtaaatcttcagcgtgcttggatcgatatactcaacttgaacgggatagctttttacgtgagacccaccaaacctcccctcaggttcttcacccaaaggcacaagtccgataccatattcccacgaccaaaccgatacgctcggatatccatcaaacgtatgagtgatagtgatacccgcgtcgttagttgccgccaagttgttgatttgcccttgcaaatttgccgcttggttgtcgtccaactggttttgcaagttggtcaaccatgtttggaatgtcgcttgcatagtttgcaaagccgtatgttgttgtgtgttatttgcttcagtatttgcttgtgctaactcatagatagtttgcagcattgtggtatattgctgttcaagccctgaaactggcacgtcaacgaatggtgaactatatccacctaacgtctcatctgatcgcatatcagtgatgtcagcattggtgattactgacgcgcctttattcactcgaaccttggccaacatcaactctcgaatagtatccgagttgacaattgcttcactgtccttcttgtagacgattgaaattgctcgattttccgtactcatctgcaaaacaactgcatcagttcggtcttgagtatttgacgcaaccggaaccgtcaacataaagtccgctgtgttcaagaattgacggccgcggatagttgcaccacccgacttcacaataacgttcattgaattagttggtgattgcgtaacctgcagcttgttcccgtaattgaagaacacaccatcagtgaacaggttggaatagaattgtgcgaaatctgcgtcggaataggtacgatcacccccgacgtcttgccatggaaaagtccaaactgccattacttggctcctctcttaataatatccaacatggttggtgactctttaccccaggttggtgttagtgtgtggtgcgaatcgtcccacatttcagtcattgaagttagaacaactgtcttggttacactaaatcgctttgacgtaattcgcacacggtctccgacgtcataatcaacgccatattcaaaaagagggttgtccagattaacgtcaccgctaatggtcaacaccgcttgttgctcgtttaatttacttgtaccacggtcttttagcgccttgatgtactgcgtatccgtgtaggttacttcttccgacgtctgctgcaagtcacgcgcgtcaacgtacagttctttcaagtacaaatcagatttgttaccttggtcaaccgtcgtattcttccgcacgctaccttcaccttcaccaaatatataagcgtaattcatctcgtcgtagtttgaactctcatatccttcatctaacaagttttcgaaatcagtgttgaactcaacatagttcgaaacgtcattacccttataaatctggatagtttgagttagcggtgagtatgaacttgcaacttccttgaaaccaaaatcataagtctcagttagatcctcgatttcagctaaaacattcgcgtaactcgcttgatagttgattgtttcgcccgtcaggctaccgggtgcgttagtcttcaaatagccaatctttcgcctggcagttgaaggactaacaacctgctgcatcaagtgattgtagacaattgtttccggtgcctggctggccgttgaatacgtcttgttgacgatacgaaaaccagccttgccgattaacgattgacctgaaacaatcattgttccgtcactaaccttgtcagcaataacttggtcaatgtagaaaaactcaccgttaatcatcaatactgcatcatcaactaaataacgaacactttcatcagtaatcgtcaccttcattgtgaacgtatcgtgcaggtagtaatttctaacaaccgtcagactggcgaagctatcaatagacattcgttgaacaaaattggtagaaccttcactctcaactccgaacacttcaatttcaactggcttctgcataacttacacccccagtttaagtggcacgaacttcaatgtaacaaacattccttcgataccgctctgtgcctgtgcttgaagatagttcgtttgcgaattgtcaagttgaaggaatgtagaaccaaccactcgaaactgcatggcattaactccttctccgtcaacgtcatacagcgtcattttcttcttgtttcgtgtcgttacaaccaccaacttctcaccggctacgaaagttcgattaaactccataaactcggttgttttgatgttgtaaatgcgcgggttaactacggttttagtgaaagtgaatgtaaactcaccaccaacaaccgcatcacccgcgttttcaacttgcacaatctgaccagttaagacagttgagaaaatgtatgcgtccgtaatttgcaacgggaacttaaaacgattatcagcagtcgaaagtgaaacaagccggtcgtaataagaaacatctcgccaatatggatcaagcgcttgaaactgcaatacagttgattgcgttagcgccgtattagcgtcaccttcatcaatccctttaatcagttcaacatcaatctcatatgatttgcctgccatcgtgtaggtcaacgtacccgccacctttggattaagaacgtgaattgcgttgtgcttcaaatcttgcaaatctgcgaaattatcggcagcaatcatcatctcaatttccatatctcgtactgcgagtgaagatgtcgttttcgtcgcaccgtccacaccgtactgtttaattgaacttagctcattttcagcctgtccaaatcctgaaatagatttatagacgaatggcgccacgtgagaaatcacaatagaatcgccgttcgtattcgtgtatttgaattttactaaacgtcccattagatacctcctagcaattgataaccaagttgtcgaattgcatttttagcctgacgtgctgcttcacgtgccgatgtatcaccagtcgtgtagaagttttgttgaatagtaaccgttggggtttcattaaccatgccacccattgcgtttgcaataccggcaccaataccgcccaacgtgtcagcgttcaatggcaaaactgcttcagggccagcttcaccaacacccttcataccacttccggtagcgaacagtgtaggctttgagaaaataccgcccttggcataccaatcaaccgaaacggacgggattttacccttaagcgggttaaacgatccgctcaatgaaaagtgtggcagtggaattttaggaatatcaattgacgggaacttcagcttgaagttgaacaggcttttgatgctgtcaataattccacgaacgacattcagtgcaccattcaatacgttcgatgccgcgctacgtacaccgtcaaatgctccactggcaattcctccaagcgatcccagaacgtttgataccgtcccgcgaataccgttaataatgcctgagatagtcccggcaatgccgttccaaacagacccagcaatacttcgtactgagttgaaagtgtcggatacagtgtctctgatgccgttgacgacattagaaatcgcattacgaataccattccatacggaattggttacaccgctaattccgctccaaatcgacgacacggttgcgtggatggcattaagcgcactactaatgaatgctccaacgtcattaagcactgtcgatacggtcgttttaatactatttagcgtcgttgtgaacgttgcctggatagcactccaaatgttcttgaaaaacgttcctatggccgtaaaaacagccataagggtggtctgtatttcatacatagcgtactgtacgttaactttaatagttgcccaaactgtgcctaaccattcaacaattgctccccaatttttaattatcgtgaccacgattgcgatcgctgcaactagccctgatattactgcaatcacgggcaaaatagcacccgtaccgacaatactgaatatcgtcaccaaactcgtgatgattgggagcaatactgctattactgcagcaacggctccaaacgcgccgattaatgtttgaataatcggatcagcattgagaaacttctcaaccaacttcgctacccaatcaataactggcgccatctgcgccacaacctttgaaagtgcgtccttcaatttgttgattgaagcctgcattttctcgccaggtgtttgttttgccaattctttcgaagcaccggtcacatcctgcgtgccagttgcagcttcaagcaatgctgctgacgcgttttgacccaaatcttcaaattgagtacctagtcctgacactgctgccttggcttggtcggccggcatacccttcaaatccttacctacggaagccataacttccgctgatgtcgcaccaccatctttgaacttctggaaaacatcttgcgtcgcctggctaaattgttgcattggctcatcaagctgtccggatgtcagtcgaagttggaattccttgataccgtcggcaaccttgtcagtgttgaacgcaccgttcttcaatccagcgttaagaacattcaacatgttttcgccagataagccagcatccttaaatgttggtgcatactcattaaccgtatccaagaagtcgtggttcttatcaagtcccaactgcaaacccttagcaacaatatcagtcgcttccgttccgctgacaccgaaccccttcatagcctgtgaactagcattaacggcatcttcaatatcaactcctgcacgattagcgataccttgcagagtgattgtcatgttggtcaagtccgttccgtttaagtcctgaaacgagttcttaaccgtcattacggctgtattggcttcttcaacgttatccaccaaacccgaatcaaacacagcgtgaactgactgcatggcatcttcggcttgcgattttgtcatccccattgaagtttgcatggttgcttgcgcatttgcgaagtccataccggtactaatcacttcaccgcccatttcggcagctttttcggcaataccacccatgaactcaccaatgtttaatttggtgattgtatcaacgttgtccgctgtatcttgtgcagcagttgaaacgttcttaaatccggcctctgctcgtgctgatgcatcttccgaaccgtccatgtacttatttacatcacccaagccacctttcaacttattcagttgtccttcagtagcttgaacttcacgttggaacgaacggtattgcgcttcacccaaatcaccactctcgaactgcttatcaacctgtgattgcgctgaacggagttgatctaacttgctttgagttgtctcaactgcgctcgatagcaacttctgtttttgcgcaaccagttcagtgttgccggggtcaagtttcagcaacttgttaacatcacgcaactcagtcgtcgtgcgattagcttgttgattaacgcccgccaacgccttatcaagtccgttggtgttaccgtcaatctcaatggtgattcctttaactcgtgaacccgccatatattctcctttctgctaaaaagcgtcgaaatcttgttgttgtgccttgcgcgccggtttcttatccgacttggcacgctcttgtgatttcatctcgctattagcgtattcgacgataaaatccatgacttgccccaagtccatcatctgcatttcatcccaggacaagcccgtctttttagcaatcagcaagaaactgtcagtatcaaattgctcgtcgctgacgtactcgtcctctaggctttttttgttgagattgaagtcattgccaaatcaaccaagtcccctagcacgtcaaacacagggaattcttcaaactctgcaaaccattgctcaataggcttgatgttttggtctgcgttcttggcatagacgtaagccatacgttgtacaagttgaatgttgtctggatccataatcaacttcatcttgtccatatctgtttcagcttcggatgcttgcgttgcgaactccaaaaacttcgtgaagtctgcgaaaaagtcgcgcccgaactcattgcgatagaagataggcgttgcaccagatgaaaccaaagtaagttcttgttgtcccaatacgaatgtctttttcatgattatttctccatttcatatttagatatgtatccggccggagccggaacccattacgcttctggtgtaggagctgggtttgtgaaagatgcgcggtatggcgtcgtgtgccatgcagcataagtttcagcgtctgtttctgaatcagtcttcatcttggcaatttcaagatatggatccaatgcagccgtgatgtcgaactccttggtttgcacatccaacttgtccgacttggttgcacctgcttcagaaggtcgtgcgaaggttacgttgtacaaaatgtgacgcgtagccttctggtcaccgtcaaactcgaaagtcaaagcaacggccttaccttgttgcagtgattgtgcaatgacaccgtggtcgtcgcgcaaatctccaagcacaatgcttgaaatagcgtatggcatgtttgccatttccaactttccagtaaatccttggttgttatcacctgaccagaaaattccgttgtcagcatagaagtcactcttatctcctgctgcatcaagtgaaaggttaacggctccaggatacttaatagccgtgtcgtacgtaatttttgttccgtcatccgtaaacgggtgaacgtaaacattcttaagtccaaattgaactttgttctctgccatgttcattctcctaacgtgaattcatacacccgtataaacatttgctctgtgtcgataaacgattcgtcccaactgaacgggatttcgttctcatcaaaaaaagactcaacacttttttctagtgctaagtcttttttgtcgaagtacagttcaaggtctacaacggttgctttgtaaaaattggtgttatctgcgaacaccgttccgtcatcattaactgccatgtatacagcaaacggtaacgacggtgcgtcgtctttaaactcgtaataagccagtggcaatccggtagctgacacaaacgccttggcaaactcgctaaacttcatatcaaccccctaaatccgctttctaacttcactctcaaacttatcacgtgcccaatcgtaaacaggttcaatgtgagtgtaaccacgcacacgttttccgttacgactggcgtgtccagcctctagcaagtgggttaaataccacgccttagcattccaaacgttaatggttttcttgtccttcttaatcgcccaccctttgttgtaacgaccagtcttgttcttgaaaccaccaccacgcttcaatcgtttaacgctttcctttgcaatatcagttttggctttttcaagcccttcctgtacatcttcggtataagctttgagttcagccattagctcactcgcaaaatttttatctgccatcacgtgtgtcccttgataggtacaaacgaatacgttcgcctgaaaggtcagctcgtgagacgtgcaagcgctcattgttgaaatatacgattggttcgttattgtactcaacacgcgcaatgacgaaagtgtaatcaggccggaaggttcgttgtcctgcctcatcatcaatctctcgtccatctgcgtatcgatttgcgaacaccttgcgttgcggttgttcaacttcgaactcctgcattagatcgtcgaattgcttttcaacggctacaaggtagataactgaatcatatctcattctgcatcccccgctgggtcgtacagtgagtgaagtgccagcgacaccttcaaatcttcatacgttgccaaaaaacgtggcgcatcaggattgtcataaccccaattggccttggtatacaaaataatcgcctgcttaattaatgctgcattctcagttgagaaatcagcactaactaaaccgacgacatgtaagtccatgcgggccgcctgaattaaatcattgatttcgttatccaaatcatcatctggaacagtcaagcgcaatgcagtcttaaccgctgggaacagttcgtccatgcgctatcccctttctgttaaatcaaagccagcaaatcagccttcttggtgatgccgtcgtgattaatctcgtgagtgtccaaatatgcagtgatttcagcaatcgtcgccttatctgtcaactcaacttcttgaacatcatcatcgtctggctcgtttcggtcgtcatcttccgtatcggcaatgacagggccgtcaaagtttgccaaatctccacccattaactcttggatacgctcatctgttggcaattttgggaacatatcgcctacttcatagcgcaccttcgtttccttatccgtaaatgcttgcaataccttgtaaaccttagtcatttgcctattcctctctaaattaagcttcttgcgctgcgatagttaccatgtaacctgcgtcagcgtcggccttttcaacgtcaaaacgcaatacgccttccaaaatacgtccgtaaatttcgttacgaacccactcaactgcaatatctgaacggtcagcgaacaatacggcacgacgcaaatcaccaacccaagccttttgagttccggctacatcagttgatgcgaattgcgtgtcgccgataacagcaacaggcaaaccaaacaaagtcttaccagttgcagttccgatttggtcttgcaacaagtaacgaccttcgccgtcctttaccttatccaaagtatcgaacattgattgcgtcataacaaacgacttgctgtaagctggatccaaatcaacattcacaacacccttcaatccgtccactaaaccagcagctgggaatgactttgcagtaaacgttgacaatgcaccagcaatcttcgcgttcgttgtgttaaccttcaacgtttgaatgtgtccagcaaccaatgaacccaaatcaacttgcgcatcatccaaagattcttgtgagactggaatagctccacgatacgtctcaacatcccagttcacgttgtcaaattgtggcttggccaatgttgggttttcttccaactcggcaacagataccattacagctgatgggcgcttcaaaattgggtacttaccagaaccagttgataccttagtctttgtaaccattgcagccaaatcaacaaccgtttccaactccaacgttgggtcatagataattgattcagggataacaacggcagcgtcagttgacgtcaaaccgtcgcgcttctcccccttagttcgcatgaacgcgttgaacgcgtcacgtgcttctaccttttgctctttatccttaatttcaacaggcattgatcgttcctcatctttcttcttttcgttgtcaccgtctgccagtgtgtctgtttcatctgtgttgtcttttgctgactcatcagctggcgcatcatcttccgtgttttcttcggatacagaagaacccgcatcaggagttgagctatcttcgctctcgtcttgtgcgggttcggccgttttatcttgttcaggcgttgcttcttgaagcttctgcaagtcctcaatatctttttggatttgcttcacctttgccatggcttcagctgaatcatcagcagttgagtctggatcatcaatcaaagcttgcgttgcttcaattgcttcaaccagctcagctttcttttgcttaatgctgtctgcaatgttcatctacatgaactccttccttactcgaatgattgctaactcatctctcaggcgctctcgtttgccgtatgcgggcttactggcgtcacgagatgaaatagcgatactagtatcttgatacgctggtaatggcgtaatagtgacctcaaacacttcatcaatcgcggtcacgtgtcggatgtcgggtgaaccgttcttaccaaacgtccacttatcagctttcgtcgtgaaagcgaagctcattcccttaatgttgccaactcgaatattttccaaaacgtcatttgccaccgttgtatttggcagcgttgctttgaagaacaatcccttgtcgtcaaccttgagtttgagagtgccggcatcaactcgtgcaagcggttgattcatatcgtgagcatagacaaggtaaacaccgtcgaaattaacgtctttgagcgctcccttatctatatactcaataaacccgcctaaatcctgcgacggcttgtcaaacataatggcgtatccactcactgtccgaccgtcaccatctgcacgcaattcaacgactgacaacaggctacgcacttcattctttgccatttgtttcgtcctccaattcttgcacggtagtcatctttgcaatgtcatctgtgacaatgtcagaagttgaatcgctcaaaaccttcactgcttgttgttgagagagtatcccagcagtgaatagttccttggtgcgcacttcaacttgtgaaccgtccaaatcaattgccgtgcgaacatctgcatcaatctcaacatcgaacgtcatttgcaactcatcaacgattggctgcaagtaacgaccaagtgtcgtattgtacgtcgctgtgatttgctcagcgtttgagtgttcactctctccacccaacatgtcagtcggcatcataaacgccttagcgatttgattacgcgtccaatcggttgagctgagcaacttcgcaacgtcagcactaacttgtgactgcgtgaaatcgaatagcgtgtccatgacgattacacgacctgcgttatcgccactattggctttctcaaactctgcacgtgcattttcacgggcttccggcatcaacggcttcttagccttcaaaacagcgctaggcatgatagctttacgcaagcttgtcagggtcaatttacgtgccgtctcttgcagtgtgagttcgttattcaacgcaaccagtggtgaacgtccaaccattccgccgttcaacgtcaacatgcgaagatgaacaacgtcgcttgattgaacgttcttctcatctggttcatcaactgcgtcgaaccggaaatcataagttagagtttggccgtcgtcggatagccagactgttgcatgatcaggttgcacaaattcaagaaattcttgtccttgtttcacgcgtcgcaatgcgtaggcattacctgaaagcaacattgatgccaccattgattgccagaagttgaaacgattggtcaaacgagacgggttagctagtaggttattcactttctcgtctttggccttgaatttcactctggcaatatcggatgccaagatgttaacggctgtccacacgtcactattcctgattgcctgttctgcgtttacgtagtctcctaagtaggcaaacccaccatcaactacacttacaccagagcctgaaccacgaataggaacgcttcgtttttcaaaaaacatgcgcaattattcctttccgataaagtacgaagcagcaaacgaaaacagaccaattgcgaacaggccaaaaaccgtgccaataaaaaaagcgccagccacaacggccaacgctcctactactgacaaaatattcgaaataatgtatcgcatatccatgtttaaaacccaaactttcccgacaaaatgtagttgttcaactgttcatcattcatgcgatcgtaatcatcatctcgttcaaggtctgtgaagtcctcaaagtgattaattgcttccactaatgcgtcaattaaagcgtccacaaggtcgattttgtacgttgctttgttcttatcaatttttatcccgttgtcggccgacacgataacggcattcatcaatgacttttccatcatcaaatcgttgtagtgcgtcactctgtgctcaacgaaagcgtcggttaaccactttgtcggctcattaagcgtccagataccctgacgcactggcaacattgtccacgttgtagcttcttcaaaagccttgataatggcgtatgtgtgagctgcatcataggcaaaatatataacattcaactcgttatctgatacgaaatcagttaaccaggtgaacacgaactcattatcaatcagtcctttttcatgctgtgtaatatcggcataacccaactcttgcatgtgggtatagttgatgccgtcttgcttttctttggcaccgatacttcctgccttgtgccatggaataaagctatgttgcatcaggtgccacttcttgtttccgtcatcatcacgatacgggaacacaaacgcaactgccgcgtcgtcagatgtcatggaattatcgaacccgatataaacatcacggcctcgaatatcgaactcacccgtatcaatcacggtgtctgtcacatcttgcagttcgaacgctgaattctcatctgcattcacccagacattcaacgacttaaccaaaaaatcattggtcgttccgtcgaacacagccacatcacggtctgacaccaagccattaagaatcgcgtccttcttctcatctaaccccagtaatggattagacttgatccaagtttcagggcgctcaatctcactcgcttcatcttgtgaccaaacggccaggaaattatcatcaagaactcgttctccactctgaattgcatctcgaacaattttaatatcctctcgcaatggagcatttggattttgataggcagttgaaatctgaatgaagatagcttctttgttgttcgtttgtcctgacgtgattttcttaaacgcttcacgcgtcttttggtctccagcttcgtcaaagattgctgtcgttgcgtgataaccgtcgtactttccaccttcagcagaaatacgtacaatttggttctttcgtcggttatcaaaaatatccatgaaacgaactgcaacgtctttcttgtgcgttcccttgaatgttgagttgagcattaactctacggttgctttggtgtagttaaacaactttttcgtctggtcagttgtatttgctgacaataaaatgtcctgattggacttctgatagctttgaacaaaaaaatcatatgctgcaattattgaagccaagtaagttttaccttgtgcacgtgcaattgagataatcgctcgtctaaatcgcttaccgccggtcttgttattgcgccacgcaatgattgaaccaagaatgaaaatttgccaaggcatcagcggcttaggcacaccatcatctgggtctggcactaatgcagcgaacgccaggaacttgtgaagtaactccacgtcaaagtggaagttgaacgcgttagtgtcctggcgttctaggtcgtctaaatgacgttgtgatgcaagtatgatgtcatttccagctagaattttacctttaacaacgtcgtttgcatatttagttacggggtcaagcggtttaaacatcatccaaacataccgacgacattcttgccgttcccttcgctttcagttggttcttcagcaagtaagtttgaacgactgattggatctaaccccaaagacgaaccaatcgatttaatgtttttagctgcgttatttttgatgtctacggccgggtttttcttaatgaccccgttgtcgtctgtataagttagaccgttagctgatatttcagcctgtgcatattttgacatctcaacttgttccacgtattccatcaataacggttcatctagcaccgttaagtatttgcgatttgctaattgaccgacgacacggccccaaagcgacttcccaaactcactcaattcttccggagcccggcctatcggctggaaccctaaattattctcttgcgcgcgttgtgcacgttcacgtctgtccaaattcttgtcattcgtatttttcaaactggcctttcgccctgaatttttgtttccagccataccttggtctcctttcaaacttctttttctgggaattctacaaaaaacgacactatcgtcgttggttcttccttagaaagccgtaggggggtctctaagcctgtttaaagattgtcttgattagttttacatcagtaataggaataacgtcagaacgcaatttacgcccgtttccggtaccgtaatacttttgctcccaattagtcttttgtcggtggcaccaattgcaagaagcaatcaagttatcttcatccaactccaactctatatcgaactctctcggtacaatgtggtctaccatgtcggctggtgttaccctgtcccacattgcacagtatccacacatactgttgtcccgttccataatgtaatctctcatctgccgccaaggtggcttgcgataccaggcattacgctcaccacgttcagggtcagccatgcgcttctcgtcatactgcttgtatgtcttcgctgacaccctgcgtggatgcaatggcgcatgaactacacaccaggtttcctcatatggaatcattgtccggcagccaacctctcgacacctatgaaccttctgccccatcacacccaccttgcttctgtgataccgtcaaccgtcttgacattggttaggatgtgaacctggttttcccagataacccgtgcaccaacccactccgcgttaggcgtcaactcatctgtatctgtggcgaacccaatctggtcagcgtacttgtccaacaacttattcactccactcatgttgagtgcctggtcatataatggatcatgccatttattctcaccaatcttcttggcgatgattaatgtataagtttctcgaagtcccatgttcttatcctttccactgcaaaataaaaagccaaccgtttccgattggctacttctttgaaatccattttaaaaacaaagcgatgccaataaaagcaataaccaacgcaatgagcaccgctgtcaagtattcatttaattgtccaaacatgattactaacctactttcttttaagtattaaaaaaccgtgtatccacgtctgcgtttgcctgcttagcatgtacatacttcttcatgcgtgcttcataatgtggctggcaatatgtccaacctggtttaatcaactcacggcaaccaatctctgcacacctatgcattctcatgtcatcactccttttcagcgcaaaataaaaaggcaacaatcaaataattgctacctgtgtgcccttttaaagccccaaattctcgtaaagagaatctgggtaataatagtgaccacttttatcattttttctataatttttatcagattcaggccaattctttaacgcataatttaaaatctttgattgaagagtagtagttattaaaagctcatttctaagaataggtggtagtaattgatcagtcttcctattcccattcagattaacaacaatgattggtaaacctagcttgatagctgtttcaatttcccatctaacaaatttgtataaattttttgttttttcaccaactaataggacgaaaattttagaattattcatacgctctcttaaacttcgcttaatagtttcttcactgctgctatctcttgaactttttaaatcatgggcattctttaaatcaaaatcaatattatcattagcagaccacattttaagagttagatactgcttcatatcttcatcgccatcaaacgcaacataaactttattcctgtaagccatagaatcttctcctcaattgaaaataatttatttgtctattagtattcttgtctaagagtatcactaactttgtcggcttcttaaatttaattcttctaagtttaaaagtccatagtatagtatctaatatctgtgtagaagtatatccattatggtctaatctagtaatacctgaaccaaataaagttatcacaactgttctgccagcatacaattcatcaatctcatcccaaaaattaactaaaaacttaacataatcttgtattgataaatatgcgcgattcttatcatcaaaatgcgtcagagccgttaaaaaaacatcatcagaaaatttataaatagatcctaattcgtatttcacctttttaccagatgttcgatcgttattcacattatctaatctgtgccttgaatttagtcttctatcatttttaattttgtcatctaataatggaacatcttctacttttttattaataaactgcccattcaacgaagatgctgagatgatttcatcatccaccagcgtgtcaaaatactcattaaaagcaaatacttttatatcatctttattgtcataccatttcttagcaaaaatatcaccttgttcaacagttatagtcgaatcatccacttttaaccccacagtacgtaatgcattggcccaaatccacattccaatgtaataaactatcacaaacactacaaatgcgatcaggatattcatacgtacctttttatcaaaatctataaatgataatattgccccaataatcccaaatatccagccactagaactgaaaacagactttcttaaatacgtgttccaaaatttgactttcactttcatcttattactactccatttctttgttatttacattatcaaatacaattatagtaatgcaaataacaaagaaataattgagaaaaatagtgcagtcaaattcaaaaaaaacagcgaaagaattatcattaatagcgataataatatcttaataatcttaaataccatcatccatctcctatccgatcacaaaataaaaaccgtgcactcacatatcaggagccacggcacgaagaacgaaattagaaagcatttatccttatgcttattgatatgtacaccagtcaccacatacaaagcactggcacggtaataactaacaaagttttcctttatgtagtttcatgtgtatgtatgccaggcaacgctgggcgctgtcatggactttcgtaagctagtcatacagatgttatagcatatcctggcaaccatgttgtcggttttatgcacatatgatgaactacatctcactatgcatgtggttaggatttgcacctaacatgacacctcaaggacttagaagctaccgtcgtcttttcaattaacataagttaattactttggcttaaagtcaagttattccaagagttataggtgtgtgcattatcgggttaacttaggcttcgtcatactagcaccttatccaccacctgtgtcttataacttcattagcgtctacctattccgccacacatgctttatttcaattattctactctattattttcacatggtttcaacggttaaacacaccaagttttggcaccattcgtgtcgtattttggcaccccttttcaaagatccacatagtgcgatacagaactcttgaactcacgcttccacctttgtaaggcagttacgctcttgtttagttctaaggctatcttgtaccatgtgtaacgcattccataatgcatatccaaaatatcgtattcatctctgcccaaaccattaagccacatttcaactatcatcttgttgtggttcaactcacgcaactcgaagtcttgttccaatgtgatcatctgactttcaacagcattattaaacttatactgtgctcgtccaccacccacgttctcatcaacgtcatttcggaacttcaaatacatttcacgggcctttatctgcttatccatggttccatcaaaataatctcgtagtaacctgtcaaccttatctgccaaaccgatgtcctccatgttaaaatgaacttaccttaaattcttttaccctgcgctggacttcggtctggcgcttttttagtgcgcctttttgatttcatagatactaagtaccacgaacgttataagccaaaatagcaaggccaccccgtttaaccaccaagcaattcccggcgtgttcattgttggcggataatctcccaaatttatccaagctgctgacaatccatatgccaagacaccaactccaaaacttataaaaaagttccacaaaacattcatctaatccacctctccctcttctacccagtagtaatacccaactaaccacttgctgaccatgtactttatgagccacttgctactcgttcgatatgcttcccgcttgttcggcgtccgcaccatcacgcgcttaccttctggcgtataagtgagtttgaagtagccttgcttatctctgaaatagtaatacttacgcatgattctccaactcaaatccacccaacaactctgcgttatcgtgaacgttcccgatcacttcaatcgtgtgcttatcttcggttgcccaatattcttggcgtgccatgcgtccactcgtgaagtgaattgaatatccatattgtggcgaatagctaacaacgccaaccttgtcatcaggcgacaaaataataacgtgcatacgcacaatatcgccttcgtaaatttcagttccgttcacatcgacaattcctgtgtattgatacacgtcagcatcaataacgtcataatcatcttttccatcaatagaccaagacctaaactttaattctcgtgccattacttatcctctagtaaatccgagtggtcatacagatccttcaaaaagtcggctaacgcctgtgtatcgtgctccataccttcgtaatagttcgctacgatatgattatcatcaattccgaaaaccgctgacccatctttagctacatttccaaatgtaatttcgttatctgtatacccattgaatgcctcgtctagataatccacaccttttagagagaaattaactaatgaatgttcagttgctacatcaagcttaacgagaaagtcagcaggtacacgaacatatcccacataaaatcccattgtattgaacaaaattggcgtgaaaaatggtagttgatccggattttcaaaaacgtccttcaaattgttcagcgtcattacttcccctccaactcaatccatgcatcaattccttcgctacgcttactgttacgcagttgattggccagttgcatgttcacaacgtgttggtgaatatccttcttcttgccattgatcactttacatcgatactgcttcaatttgaatttctttcgagaacataagaaaaccccatgagttagatttactccaactcatggggttcagttcagcgggtgcttttttgtattcttttattacgttggaggtcaaaaatctccgacattctcagcctgctttatatacatttttaccaattggataatatctgatttagttatataaattgaatgagatatgccgagtgtgttgttagggatgtattataggaggatatttcaatgtctatttatgggaattttgggaaacaagttctggtcagcggagtcgcattgctggccttcggaactgtcacgacgctaggaacaagttttgatctacctgggactgaagtttcagctagcacaacgaacggctattcaaacggcctttattacacgaacggtagcttagcaaatggctacattaatgatggccaacactggtacttgttcaagaacggtcaaaagttgagcgaaattcaacaatacatgggtggctactactactttgataagacgacgcatttgcgtactgacaatgcgttccgtgatgagtggggtaatacttactacttcggtggtgatggtcgagcagtgaccgggttgcaaacaattaacggtaacaagtattactttggtgatgacggcacgtacactttgcgcaagtcacaatggttgacgctaggtgccgctaagtactacgccacggccgatggttcattcgcatcagatgttacgaagattgacaacacttattactacttcaacccaagtacgaaggcactttcaacgaagcgtgactacattcaagcgcgttggggcagctggtatctagttggtagtgatggtactgtccaaagtggtttgcaatcatgggctggtaactattactactttgatccaagcacgtatcttaaggtgacgaacaagacggttaatattaacagtactgattggtactttgatggttcaggtgttggtactaagaagtcttcatctgccgatgctggtcaattctcagctgctttgaatcgcatgaaccaataccgtcaagcagccggcttgcaaccagtaacttacgatgctggtttggctagaacagcgcaatctcgtgcgcaacaaatggcgggaactgttgatcaagcacattacaatcaaacgtatggtaaagaagttgtagcaattcaatttggttcaggggcaacggctatggaagcttggtttaatgaaacgaatatgtatggtgcacctggtcaccataattggattctaaacagctctattacgcgtgttggtttcggttatgatgtagccagccaaacatttgttggtgaagctaagtagtttttgtgggtaaaaggggactgttacggcaacagccccttttgtttctataataaggtgaattaaaatgaaaaaaatgagcaagacagcaattttgacggcattagcgttggcatcatttggtgcgacgacggtcatcatccaaagtgatttcatgcccaatgcgcaagtttctgccaatgtggcaaatggctattcaaatgggctttactacacaaatggtagtttggcgaacggttatattaatgatggacaaaactggtacctatttaaaaatggacaaaagttgagcgaaatccaacaatacatgggtggttattactactttgataagaccacccatttgcgaaccaacaatgcgttccgtgatgagtggggcaatacgtactacttcggtggtgatggtcgagcagtgacggggttgcaaacaattaatggtaacaagtactactttggtgatgacggaacgtatactttgcgtaagtcacaatggctaacaattggtggtgcaaagtactacgcgacggcggacggttcattcgcctctgatgtgacaaagattggtaatacctactattactttgatccaagtacgaaggctctttcaacgaagcgcaattacattcaagcacgttggggtagctggtacctagttggtaatgatggtactgtccaaagcggtttgcaatcatgggctcgtaactactattactttgatccaagtacttatttgaaggtgacgaatacgacagttaacattaacggagttaattggtattttgatggttctggtgttggtacgaaaaaggcaagtagtactaatcaaggctcagtctatgatcggtttattgcggcgggtggtaccgatgcgatgtggcagtacattgtcatgcctgaatcaggaggtaatccaaatgcggtttcaccaaatgggtatcgtggcctaggacaaaccaaacaatcatgggggactggaaccgttgcccaacaaactgcggggatgattaattacgcggtgacacgttacggttcaatcgataacgcgattaagttccgccaagcaaatggttggtggtaagcccgatttaagcgtgacaatttcttcatggaaacgtacttaaatattcctgttacattcttgtaacctgtgttatgattacgttatcaaaaaagtcgctgaaaggggatagcgtaatgaagggtgtaaaagtaattggcgtggtggcgttggtgtttctgctaggcttcggaggagcaatggcctggagtacagttgccgacggacgtcatgcaacacaagaagaaatgagtcaatcaaagtcaagcaagtctagttcatcagcaagtagcaagaaaagctcaatatcgacatctgcagtgagctcagaatcatcagtcagttcatcggtttcaactgaagcggcaacaacaccttcagtgaagaatgacacttcagagacggtggctgctgagagttcttcatctcaaccagcagttgctgcgcaaactgcaccgtcaactgcgaatgcttcacaagatgcgattaatgcagtgattgcctacgaacgtgctaatggtggcctaagttcagacgtgacgtactttattacggctaacactggctcagtttaccaagtcgaagctcgtgtagataatccaaatgatccatcagtaacgaacatggctggattgttccgctatgatgcaaccactggacaagtgacgcacatggaccaaatgacgggtagttttaactaaaacaaatcaaaatagggagcgattgcgacaagcaatcgctctttttttctgaaatcgtgttacatagctgtcatttaacgcactttttgtgcataaaagtggataatgcaacgtaatcgaattttggaaattgtgaagaaaaatgtaaagatcgtgtttggaaagccaatggggatgcttgtttagtgcttttggaattgtgaacattgtgtgaatcacaagttgtcgcgatgttgttattgcgctgtcatgaaacgtctgtaatcttatacctgttgttaagttaatcacaaaaagcaacacacaaatacagaaactaagaagagacgctttacacgagcgacattaagaggagttaatcatgcaaaacgctaattcacacaagaagatgtacaaagcaggtaagaactgggtagccgcaatggtggcaactgttgcagttgcaatggtaccaatggcaatgacgacgtcagtatcagctgatgagtcagcacaaccaacgtcatcatggcgtgctaagacagttgaagacgtgcaaactgctgtgcaagctgcgggtgagacttacgttgtgcaagctggtgacacattgtcaacgattgcatcagctactgaattgacgactgacgaaatcgctgccgctaacggcatctcagacgtgcacttcattttggttggtcaagagatcaagttgactgctgatgcatcagttgcttcagaagcgccagttgttgctgaagaagctgcaccagctgctgaggttgcaccagttgaagcgcctgttgtagaacaagcaccagtagttgaagaagcaccagttgtggaagctcctgtcgttgaagcaccggttgcggaagaagtagtggctgatgagcctgttgcccaaacaccaaactacaacacggacatgacggccgtacctggtaactcatactacgctggtcaatgcacgtggtatgtaaagaacacgttgtcatgggttggtaacttctggggaaacgctaaccaatgggcagccagtgcagccgctgcaggtcgcttggttgattcaaacccaactgttggatcagttgttgtcttcatgccaggtgtagccggtgcctcatcatacggtcacgttgccgttgtgacgggtgttaacagtggcatggtaacgatttcagaaatgaacgcacaaggtgaatacgttgtgtcatcacgtacgatttcaccagccggtgtattgtttatccactaatattaagtactaatggagttatgtctgcttgcagatgtagctcttttttcgtattgtaagtagaagatgtgtctaagcatttttaattttgaaagttctatgtcggtatactagatataacctaagaaatcatgtatacttttatagataaagatttagcatttacaaggagaccataacaatggctattactgcttcacaagttaaggaattgcgtgaaaagactggtgtcggaatgatggacgccaagaaggcgttggttgagactgacggtgacatggacaaggcaatcgacgtattgcgcgaaaagggaatggctaaggctgctaagaaggctgatgccgttgctgccgaaggtatgacttacgttgccgttaaggacaacgctgctgcaatcatcgaattgaactcacaaactgacttcgttgctggtaacgctgagtttaacgacttgttgcacgctgttgcaaacgcaatcgttgaattcaagccagctgacgtagaagctgctttggctttgcaagtttctgaagacgctacgttgaacgaaatgatcatccgcacgacgcaagttactggtgagaagatcactttgcgtcgcttccaaatcgttgaaaagggtgaaggacaagagttcggaacttactcacacatgggtggacgtatctcatctgtagtattgttggacggtgctgacgaagagactgcaaaggacatcgctatgcacgttgcagctattgcaccacaatacgtttcacgtgaagaagttcctgctgatgtcttggcacacgagaaggaagttcaaatgaactcagaagacttgcaaggaaagcctgacaacatcaaggaaaagatggttgaaggtcgtttgaacaagttcttggctgacatctcattggttgaccaaccattcgttaagggtgacggtaaggaaactgttgctaagtttgttgagtcaaagggtggcaaggttgtttcattcgttcgctacgaagttggtgaaggtatggaaaaggctaacgttgactttgctgctgaagttgccgcacaaatcggttaatccggaactgaggctactataaaatggcagacgtaaagtacaagcgcgtacttttgaagttgtcaggtgaggctttggctggtgaacgcggctatggaatcgatcctgaaactgtcaacagtattgcggcagaaattaaggacgtatacgaccttggcgttgaaattgctatcgttgtcggcggtggtaacttgtggcgtggagaagctggcgctaagctaggcatggaacgtgcccaagctgattacgttggcatgttgggaacgacgatgaacgccttagcattgcaagatgctttggagtcacacaatgttcctacacgtgtacaaactgctatcgagatgcgacaagtggctgaaccttacgtacgtcgtaaggctgttcgtcacttggaaaagggacgcgttgtgatttttggtgccggaactggttcaccatacttctcaactgatacaacggctgctttgcgtgccgctgaaatcaatgccgaagctatcttgatggctaagaacggtgttgacggtgtgtacagcgatgacccacgtaagaatcctgatgcaacgatgtatgagactttgactcacaaggacatcattgagaaggaacttaaggtcatggactcaacggcctcaacgttgtctatggataacgacatcaatttggtaatctttaacatgaacacggctggaaacatcaagcgtgttgtattgggcgagaatatcggaacgaccgtggaggtaaagtaacatggcaaacccaattcttgattcagcaaatgagcgtatgggcaaggctgccgacgttttgcgtcgtgagctaggtaacatccgtgcgggtgttgcgaacccatcaatcttgcgtaacgttacggctgagtactatggtgctgaaacaccattgaaccaattggcatcaattacggtgcctgaagcccgcgttttgttgattacaccatttgacaagtcaattttgaaggacattgagcaagctatctttgcttctgaccttgggttgacgcctgccaacgacggatctgttatccgtttggtaattcctgccttgactgaggaaactcgtaagtcattggctaaggaagttaagggtgagtctgaaaaggctaaggttgcagttcgtaacgttcgtcgtgacgccatggacgatgccaagaaggcattgaagaacggtgacatgtcagaagacgaagctcgtaagcttgaagatgacatccaaaaggcaactgacgctgcggtgaagaacatcgacagcatcgctgctgaaaaggaaaaggaattgttgactatctaattaggttgttaatattcaatttaaaaagattgagattcataatgtgaactaaaccccgtgtgttggagcaaatctagcctacggggttttgttgtgttttcaaacgaagtacaactccaaagtatgaatcgcaaagcgacctgcttagataacgcaatggcctaaagcatcttccacattttgaaggtggaaacggtacacaacaatcactaataaagcgccgtaacatcagcattgattgatgttacggcgctttgtgtatagctgttatttctttgattcttcgacccttgaagaattagtatctgatttttgcttttgcctatcatcagacttattttgctttgattgggcctttttagctgacgaaagcgcattgttggcagaatcctgcatcgcctttaaggcatcgctagcactgctttgcagggcaacgatttcagagctctgttgtatgacctgatcagttaactgttgaactttttgttgggcctcaccagaattacggagagcgtcaacgtatgttttacctgtggtagcagccttattaagcaattcaacaccaccatcaacagttagtgcttgattatacatgttcacagcagattcccagttatgctgtttaatttcattgtcagcattctcaaggtaggttagttgttgacttgcggtacggttttcaactgatacgtgaattttgcgagatttttgatatgcggtgcgagcaatttcccattcatggccagcaactgcattgcgggcgatgctcatttgcttgttgtaagcttgctcatcgtagtaaattttaatgccccaaattgaacctgccgtagcaagtgtcaatacaataacagatacaatagtccatttgggtttcatgcgatcaaacctcctgtgataaatgacgtaataaatatacaactaacctatcatgtagcgacttcaaatgcggtaacggatttttcgttagatattaaaattatgaaatattgttttcttaacaatgtcagagatgatttgtaagcgcttacttattttgatatagtgattttagtaaggggaaccggaataaaggggattagtgatgtacaaatacgaggatgttaaagttgaatgggctgacaatacggtacgatttgattatgtggatcgttcagtgttttctgaagatattgaaattccagaacattggcatgaagaaattgaaattaactacacgatgacaggtgaagttaaggaatatattattgacggcgagactgagtacgtgcatggaggtgaatttattgttgtaaatccatttcaagtacacggggttcataatgtaagtcgagagcgacgaaatctgctattgttggtgtcgcaacgttttattcaaaaatttatacctcgcttatcagatactcgttttatcttgaaaccatcaatatttatgtcatctgaccaacaacgtgcagtggcaaggatggcggacttgatgattagtatatttgaagtgacgaaggccgatcatgagtatcgtgatgatgaatttattgggttgacagtgcaacttttggccttgctaggtagcaattttggtatcaaaaatgattcaaagatgaccaataatttggcggaaacgattgcgtatgtccaaaaaaattacaaggaggaactcactttggtcggtttagcgaatcgcgttcatttgagtgcagcatatttcgatcgtttctttaaggagcaaacgggttattctgtcatgcaatatgttggcaagattagatcaatgcacgcataccaactgttggctgttgaccaaaaaagtgttgcatataccgctacgatggttggcttttcttcaacgcaggcattaaaccgtagcctaaaaaagaattttggattgacggctacagctttaaaaaagcaaaaaacaacctaatttgtcgcaaaaaccacaggactaagtaagcgcttacatagtaatattatcttcgttgagatatagtaagtcattttaaatggctaagggggattatattgttatgaacaagcatggatggctttttaaggcctcgcttttatcaattgcaacattaaccaatgcggcggccgctgtacaagtgaccgtgcccatgattatgaaagacttgccaacgcagtcacaatcatcaatcgagctgttgatgtcagtcactagtttcgggattatgttgtttgttttgctgtcaaactttgtaacgcgtattatcggtaataagaagacggttgttctgggtgttctgattgcagtaatttccggaattgtgccaatgttttctgaaaattacacagtgctattggtatcgcgtttcatgtttggtgccggtgtggggttgtttaattcattggcaatctcattgatttcgatttattacgagggcaaagaacgtgacacgttaatcgggttcgaaaatgcaacggccgcggccgcaacgactgttctaacttggttggtggggtacttaatgtcatttggctggcacatgacatttggcgtgtacgcgcttggatttattccactaattatgtttggtttgtttgtttctgataagacaccaaccgtaagtggtgatagtaaacaaggggaagttgtaggcaaggcgcacattaatcggactatggtaggctatggggccttcatgtttgttctatttgtaacgtactttggtatgacggtcaagattgcaccactatttgaacaacttggttatggtactggcgcacaagctagtctgatttcaggtatcagcgcagcgacaggatttgttgctggtttgatttttggaaagattaagcaatggtttggtcggtacacagttggtctggggacattagccggtggtgttatggtattgctcttgagcatgagtcaaaatttgatttggtcaggtgtgttgatttctttgtacgggttggcctttggaatggcagtgccaggtgtgtactcagctgtagcggctcgtactgatgaagcgtcgcaaacattgggttcaactgttttgttagttgctgttaacatgggtgtcttcttaagcccgtatgtgttccaactggtttcaacattgtctggtaggtcaaccgctgccttcagtatgacagttgatgctgttatcgttttggcactagccgtgattacactggtcgttactggggtaaaacgaccagctagggttgatgaacaggtgaacgtaccagtaaagtagggagagttaatagcatgacaaaagattatttagcaattgatgttggtggaacgcgtttaaaagttggtctgattgatcggtctggtaacatcatcgaaaagtttagtgagcgtactaacacggctggtttagaggcatttttgggacaattgcgagatgttatcggacgttatgatggcaaaattcgaggtgttggattcagcctgccggggaagttagcgcaccctgatgacacaattaagggtggcggttcattaacgtttatggatggcgttaacttgcgtgacaagttagctttggatattccaattgccgtcgaaaatgatggaaaagcggcggccttagctgaattgtggttagggcaactaaaggatgtacaagatggtatggccattgttttggggactggtgttggtggcgggttagtcctaaatggtaatttagtttatggcacccactttcaagctggtgaattgagtttcattttcaatcaacttgaaaaggggatggacacgtcgattggattgaacggatcggcggtcgaaatgattaaacgtatcgggaccgagcttaagttgccagagattgatgatggactagcagtatttgaatacattaatgctggtaatccagtcgcagttgatatttttgatgcctatgcggctgaaattgccttgctgattcaaaatatccaagcaattgttgatgtccaacgcattgttattggtggtggtatttctgctcagccgattgtagcggaacgcattcgtgatcaatatatgactttcttcgaaggaaatgaagttgtggctggaaccttgacaccggttgaaattgtggccggtcaatttgctaacgatgctaatttgtttggtgccatctaccacttgttgatggaactcaaccaagaagtttaatataagtttttaaatggtcgtaccagctgtggtgcgaccattttttggcctataccacaatatgtaagcattcctaacaaggtttgctccgataacgaaaatcacgcctatactaatcgtaaagttaaggaacgattagaaagacggagggtgacgacatgagcggatcggatatagcatgggtattaatgagttcagcattagtttggctaatggtgccaggtctggcattgttttatggcgggttttcagacgttagatcaaccgttaacacgctggccatggttttaattgccatcgccattgggggtgtgttgtggtttacagtcggctattcattgacgtttagcggtaacggaccaattattggtgatttgaagcatgcctttttgaatggtgtttcaatgacgcaaagcacgcgtgggttatcaattccggatggtgcgtttgctttgttccaggggatgtttccgatgatcacgatggcaatcattgctggagcggttgtgggtcgcatgaactttaaagcgttcgtgttgttcctaattggttggatgatgttggtttacgtaccgttggcgcacatggtttggggtggcggattgctagctcaaatgggtgcaattgactttgctggtggtgatgtcgtgcacatttcatcaggtgtttcaggattggtgttagcgttgttgattggtaagcgtcagcatgttacccagctaacggcacacaacatgctatcaattgttattggtggtggcctgttgtggttcggttggttcgggtttaactctggttcagcactagcagccaacggcgtcgccatcttggcattcttgaacacaagtattgcggcagcgacggcgatgctaacatgggtaatgttcgatttgctggtatttaagcaggttaaggtatcgggtgctgtgtcgggtggtatcgcaggtttggttgcaattacgccgggcgctggattcattgaaccggttggcgcagctatcacaggtggaattgtggctttgatagtttacgtggcaacaacggttattaagtaccgaatgggctatgatgacacactagatgcctttggattgcacggtgttggtggtgttgccggtggcttgtttacgggtatttttgcaaccaaggccttgtccggtcaaagcggtttgctagctggtggctggcatttgttcggcattcaggtggcagcaattgtgctgacgatcatcttatcagttgtcatgacgtgggtgattgcgaaagtggttgccgtagtaacgccattgcgtgtgaacgaaaaggctgaggcaactggcgtcgatttgtggcaacatggtgaaacaattgtgacgcaaatccaaacaacacgctaatgactgttgacattgttcgatattaggagtaaattaatattacagatttgtaaaggtttcctttacaatgacaaagaacaaaagggggttacagtatgtttggaatgaatgtattgaataagaaaattgatcgcgccgtccgtgagtatcagaagctggatccggactatcgccccgcaaagaagtctaagaagcgttaagccgctaaacttgaaacgccgaaccacgaaagtgactcggcgtttttctgtgcgtgtaggaaattgtgagaattctaaaacgttttacggttcactaaattttgtatagtttcacctataccaatttataccaattaattcacaatagtccggtttttggttgaccgcgcttttatttgtgcaataatagtctttgtattaaaacgcaatgaaaactctaggtggtataccacttggtttataaaagtgcattagggggaaatatttatgttctgcggaattgttggatttactggtttgaattaccaatcagcaccaatcttgttgaaaggattggaaaagcttgaataccgtggttacgattcagctggtatcttcgtggctgaccaagctttagggactgaccaattggttaaggaaaaggggcgtgttgcgcaacttgaagccttggttgatacgaagaacgtgaccggtacgagtggtatcgcgcacactcgttgggcaactcacggtgtgccatcaattaacaacgcacacccacacttgtctgcagacggacgtttctacttggtgcacaacggggttatcgagaactaccttgagttgaagcaagagtacttgtcagatgttacgttccactcagatactgatactgaagtggccgtacaattgattggtaagtttgttgatgaaggaatgacgacttttgatgcgttgaagaagttgatcagcttgttggatgttaactcagcttacggattcttgttgatggaccgtaatgagccagagcgtatgtatgttgcaaagcaaaagtcacctttgctaattggggttggtgaagactttaatgttgtaacgtcagacgcggttgccatgttggaccaaacgcacgactttatcgaattgcacgatggtgaaattgctatcatcgatcctgataacgttcgcttgttcggtgctgatggtgttgaaacgtcacgtgagccattccacttggacattgatgcgtcagaaacggataagggaacttacccattctacatgttgaaggaaatcgacgagcaaccaatcgttatccgccacttgattgaaaagtacttggatagcgagggtggtgttcacgttgggcaagctatcttggatgacattaaggcagctgatcgtttgtacatcgttgctgctggtacgtcataccacgctggtttggttggaaagcgcttgttcgaacaatgggcagggattccaacagaagttcacttgtcatctgaatttgcatatgagcaaccattgttgtcagagaagccattctttatcttcttgacgcaatcaggtgagactgctgactcacgtgaagttttgcaaaacgttaacgcccaaggcttcaagtcattgacgttgacgaacgttgaaaagtcaacgttgtggcgtgaagcaacgtatgctttgccattgttggctggtcctgaaattgccgttgcctcaacgaaggcatacgttgcgcaagttggtttgcaagctatcttggcatacgcagtcgctgaccgtgatgcgcttggcttcaacttggagcaagacttgtcaaagattgccgttggtatccaaggaatcgtcgatgacaaggaaacattgcaacgcgtagccaacgagatgctggttgagtcacgcaacgcattctttatcggtcgtggggttgattcaacagtttcattggaagctgctttgaagttgaaggaaatctcatacgtacaagctgaaggattcgccgctggtgagttgaagcacggtacgttggctttgatcgaagaaggtacgccagtgattgcattgattacgcaatcaaagacagctggtttggttcgtggaaacttggctgaaacacaagcccgtggttcacgcgcctacacaatcgtgactgaagaattggctaaggaaggtgatgacttcatcttgccaaacgtcaacgaattattgtcaccattgctatcagttgtgccaacgcaattgttggcttactacacatcattgggtcgcggcctagacgtggatcgtccacgtaacttggctaagtcagtgactgtgcaataagaaacaaaaaacaccgttgtaatcgagtctgtgagctcggttgcaacggtgttttgttatgttcaagtctggtttaagtcgcgttcattatcatagcgggcaaagtgatattgaggaggctcctatgccaagtgaaaatgctgagaaaccgagaaaatatctatatgaggtcgatttgttgcgggtattgtttatcttcagtgtgattgcgacgcacgtgacaacgaagattaatgaagcaatcccgaacgacacattcgcttcgcagtatttgtttgcaacgcacatgacgctgcattttagccgattgggctttatgtttgtttctggactggtcatctttttgaactattacgcaaagaaactggagatttggcgtttctggcggaaacggttctttgggattatctgggcatatttgctttggattctaatctatacaagcattcaagcagctatccaaaatgcgacggctgccgaattctggcagacgctcacgaagaactggttgtacggggatgatttctacatgtactacgtgattgtgactttacagttctatctggttttcccagcattgcgatggctgttcaagcgatttaaacacgagcgattagttgcggtatcgctggcagtgcagctaattacgctaaccgtcatcaaatacgttattccaaacgtagatacgtcgcactggttgtggtggttcagggagtatgggtacaattttttgacgtaccaattctattttgtattggggggttacgtggccattcactatcatcaagtgatgccgaaattgatgctgtaccgacgccaactgagcgtggctgttggggtgttaggcgccttaacgattgctgtgtttggtatcaaccgtagcatactagaccgtacgatcgatcaagcacaaaacgtgcatcaaccatttgtcttattctatgcggtggttgtcattgcatgggctatgacgattggcatgagatatgcccaagcgcgcgaaaccaatgcgttaccaaagtgggtggtaagtgccgtggcgtttggttcaaagatttcgtttgggatgtatctgagtcaaacggtcattttgactgcgctaagtgcgttattgtcacggatttcagtggattcagggttgttgttggcaacggtgccagttagtttactagttgtcttcggcctcacgtacttgctctctggtgtgctgtaccggatgccaaagctaagtgttttagcagggaaatcaccatggcgttcataaatgaatattcattcttttaaaacatgaattgctttgattaaatgccgtacgagcggccatttcctggtatacttaaaggacgagtaagtccaaggaggacctttgaaatgaagttagaaaagatgcccgccgaattcgtggcggcgctaccaattcttgaaacaatcgaagcagccggttatgaagcgtacttcgttggtggatcagtgcgcgatactttgttgggcaagccaatccacgacgttgatattgcgacttctgcctatcctgaagaagtaaaggctttgtttgatcgcacggttgatactggtatcgaacacggcacggttatgattttggatcatggccaaggttatgagacgacgacgttccgaacggaatcaacgtacacggatttccgtcgtcctgatgaagttacatttgtccgttcattagaagaagacttgaagcgccgtgatttcacagtgaatgcctttgcgttgacgaaggatggcgaaatcattgatatgtttgatggtttgtcagacatggacaatcacatcttgcgtgccgttggcgaagcagaagaacgtttccacgaagatgcattgcgcatgatgcgtgccgttcgttttgcagcacaattggacttcaagattgaagaaaagacgctccaagccattaaggataacgcacacttgttggccaacattgcgattgagcgtacgaatgtcgaattcacgaagctccttcaaggtaaggcagcacgttatggcttgctagaaatgattgccacgacgttgaacaagtacatgcctggtctggaaacagtcgacattgatttgattggttatgctgacttgttggctgaccagcaaccaacaaacgatgaagaagcttggacactgttggtcttcgaacttggtttgacgcctgaagatgcaggtttgttcttgaagaagtggaagcactcaaacgatatggtgaagacaatcaaggcatctattaagttgttgaacaagttgcgcttgggcgacgttgaagcctgggacttgtacgaaactggtgcagctattgataatgcgctttgtgttgcgacgttgagtgagcttgtggtagatgtaccaaagctggaaagtcgctatgctgaattgaagattaagacaaagaacgaattggcctttaacggcggtgatttgaccaagggcatgggcctcaagccaggaccattgtttggtaagattttggcaacccttgaacgtaaggtcgttgcaggtgatttggcgaacaaccacgctgttttgcaagctgaagcacaaaagatggtagagaaagagacgaataagtaatgaagcaactacgcgcgactgatttgaagagtgtttatggtgaaaaaacactgcttgaccaagtatctttcctgattgaaacgggcgaccgtgtcgggattgttggtgtgaatggaactggtaagacgactttgttgaatgccatttctggtttgaaccctgctgatagtgggtcgatcgacacaccaaatgactacacgattggttatttgcaacaagagccaccactagatggcgacaagaaggtgatggaagccatcttcgctggtgcccaaccagtattccaattgattcgtgattacgaagcagctttggaagcttattcagctaacccaactgatgaaaagttgttgaaccgctacacgaagttggagcaacaaatgacgcaagaagatgcttgggtagcggagtctgaagtgaagacaattttgacgcaattgcacttgcctaatttggatttgccagtgtcagctttgtctggtggacaacgtaagcgtgttggattggcacaagtgttgattcaagcgcctgatttgttgcttttggacgagccaactaaccacttggactttgattcaattgagtggttggaaaagtacttgtctgattacaagggtgccgtgatgacggttacccacgatcgttacttcttggatatcgtcacgaaccgcatttttgaaatgtcatatggtaagttgtacgaatacatcggtaactacgagaagtatgtgacgtcaaaggctgaacgtgttgaggcggaagcagttgctgaacacaagtctgcccaactctacaagaaggaattggcttggatgcgtacgggtgctaaggcccgttctacaaagcaaaaggcccgtgaaaacgcctttgctgacttggcagcgcaacaaggtacccgtcaagttgaaggtgatgttgaagttaacatgggtcaacaacgcttgggtaagaaggttatcaacattgaacatgctagcttggcttttgatggccgtgtgattctggatgatttcaatgaattgattcaagccaaccaacgcattggtattactggtccaaacggaactggaaagtcaacgttgttgaacgcgattgcgggtgtacaacaactagattctggtgtaattgaaatcggtgagacggttaagatggcttactacacgcaagtcacagaaccaatccctgaggacaagcgcatgttggcgtacctatctgaagttgctgaagaagtgactgaccgtgatggaaacgtcgtatccgctgctgaactcttggagcaattcttgttcccaagcttcatgcacggtacgttgattcgtcaactttcaggtggtgagaagcgtcgtttgtacctattgaagttgttgattcaacaaccaaacgtattgcttttggacgagccaaccaatgatttggatattggcacgttgacggttttggaagattacttgcgttcattcgctggtacggttattacggtttcccacgatcgttacttcctggataaggttgctgaccaattgattatcttccgtggtgccggtcaaattacccgttaccgtgggatgttcagtgattacttagcagaatttggggcgccgacaacggatgcgccaaagcctgccaagccagctgctgaaaagaagacggttgttgagacgccaaagaaaaagaagttgacgtgggccgaacaaaaagaatgggacacaattgaagacgacattgctgaacttgaggggaagattagccaaatcgaggccgacatggtcgaaaatggcgctgattttggtaagttaagcgagttgcaagcacaattagatgaaacaaaccaagcgctcgaagataagatgatgcgctgggaagagctatcagaacgcgtagaggggtaagcgataatggctgaaaagattttgatctgggcacaaactaacaatgggacaattgcgttgaatggagcgattccatggcgtcaaaaggccgacatgaagttctttaaggaacaaacgattcaccaagtggcgttgatgggacgtaacaccatgctaagttttggcggacgtgcattgccagaacgcattaacatggtgttgacgcacgacgaaaatttggcagtgccagctggttttgacaaagtttatagcatggatgaagctgagcgtattgctgatgaaaacaatatgaagcttgcggttatcggtggtaaggcgatttatgatagttacttgccagtagccgacattctatatgtgacgtacttagacactgattttatgggtgacgttttgatggcacctgttgataagacgatttggcttggtgaggaaattgcttctggtccagctaatgacgacaatcaatacgattggcgcattgtgaagtacacgcgtcgctaattttggcaggcgtggcaattaacgtgtgacttttttcgaaaataggcgtaaactgttcaggtaaaatcattttggccgaaagaggctaagaggtagaaaaatgaagtacgtcgtaactttcttctggatgttcatcttgggtgaaattatcggttacatcggtagtgcccttgaaggaacttcatacaacgcaactactacgtcattgtttgcgatggtgattggtgtaatcggtacggttgcattttcagctatctcaaagtctgctgctcctaaggatgcggccaaggcggaagattaatagttgtacacacgactctaaaagaccatccgttctgcgggtggtctttttttcgggttatcgctataatgaaattaagttaaaacgaatttgaaccatgacgttcaggaaggggcagatatggtaccactacaaacaaaaacggcattcagtttgttacaaagtcccatgatgccaagtcaactcgtggcctctgcgaaagcaaaagggtacactgcggttgcaatgacggacaatgatgtcttatacggcatggataatttttaccgtgctgccaagtcagctgacatcaaaccaattcttggtttgacaatcacaattcaaggattggcaacttcacagcattatccaatggtgttgttggttgagaatcaaaccggttatcacaatttgctggcaatcagtagcttgttgaagacaacatctgaagttgtgacgtttgacatgttgacggcttatttggctggcctatatattgtgttgccaagtgttggtgagttgcccgttatcttgggagccgaaccggaacgtgcaatggatatggtgcaaagtattagtgcagtgactgatgcgaaccatgtctttttgggtgtgtcgacggggatgcgtgatgaattaattacgcaattacgccaattgtcagagaacaccggtgcccgtttgctagcattgacggaagttgactatgctgacccacaagatcaatttgcggcgcaagtgattcgcaaaattggtcaaggtgaggtcattgcgaatatcgcccaggcacaacgcgaacctgccacagcttatttggaatctgctgaagagtggatggctgaatttgtgtcacgtggtttgggggatgcggtcgcgaataccgattggattgctgagcacagtgaatttgaattagtgaagtcaaaggtaacgttgccaccgtttgaaacgccgaatggtcaaacgtcagccgactacttgcgtgaattggcgacaactgggttaaagaatcgtttgcatggtttgtcagttgatgaggcggtctatcaagaacgtttggcacacgaattggatgtcattgttgaactgggatttgcggattacttcctgattgtttgggatgtgctgaactttgcgcacaaaagcgctatccgcactggcccaggacgtggatcagccgccggttcgctagtggcatacacactttggattaccgatgttgatccaattgcgtacgatttgctgtttgagcgtttcttgaatccagaacgtgcgcaaatgccggatatcgatattgacattcctgacaatcgtcgtgaagaagtgttgtcatatttacatgagaagtacggtcatgagcgtgtggcgcaaattatcacgttctcaacgatggcacaacgcgcggttatccgtgacgtggcgcgtgtgtttggcttaaatccaacgcaaattgatgcgctatcgaagtcgatgccacgtgatgcagctaatctggaagcggcgtatgaatcatcacaacctttccgtaatgcgttgattgatttgccagttgatggtgaattgttgtatcaaacagcgcgtaagttagaaggcttaccacgtaattcatcattgcacgctgccggtgtcgtcctttcagctgatccgctagtgcaaacaatgccagtgcagctgggtgaagatggtcgtttggtgacgcaattaccgaagggccccgttgaagcgcttggcttgttgaagatggatttcttggcactttcaaacctgaacattttggatatcgcgttacgtgaaattcaaaagactgaagagggtgccaactttaacattgccaacattaacttaaatgacgatgcgacactacgtttgttccgtcacggcatgacgaatggggtgttccaatttgaatcagccgggatgaagaacatcttgcgtcagttacaaccagacagctttgaagatattgtggcggcgaacgcgctgttccgtccaggtcccatgcaaaacattccgcatttcgtggctcgtaagcatggacaagagaagcaagatgtaccagaccaaagtatggcggatattctagcaccaacctatggcgttatcgtctatcaagagcaagttatgcgtgtggcacaacaattcgctgggttctcactaggcggtgccgatttgctacgtcgtgcgatgtcgaaaaaggacggtgctaagatcgccgcgatgaagacggactttattgctggggcggtagcaaacggtcatgacgaaaaggtcgccgaacaagtatttggttatattgaaacgtttgcccagtacggatttaaccgttcgcacgcggtggcctattcaaagctggccttccagttggcttatatcaaggcacattatccagccgctttctacaaggccgttttgaatgatgctattgctgacaagaaaaaggtcggcgcgtatattgctgaagcgaaggcatctggcgttaagctgttgggaccaagtatcaatcattcatggcaaggttattcaatgaacaagcaaggcgagctccagatggggttggcttcaattgcgggtatgcgtcgtgatttccgtgaatcaatcctgaaggagcgccaagaaaacggagcgtacaaggatttgggcaacttgattggccgtcttgagagcaagtatcgtaaggttgaacaacttgagccactggtttatgcgggtgcgctcgacgaatttggattcaatcgcaaatcaattctagcgtcattgcaaggattcattgatgcgattggattggcaggtgagtcgatgtcgttgtttgcttcgttaacaccaaaggttcgtgaaattgaagactttacgccggctgaaaagctagggtatgagcgtgattacttgggtgtttacctcagtgggcacccaattgagccatacttggcggcgattcctgacaacagtcacactgatatttcgtcattggcagttggcatgaatcaggcgacggtcgtgatttacgttgaaaacgttaaaaagattcgcacgaagaagggcgatcaaatggcgtttgtggatgggatggatttgtcaggttcaatctcaattacgcttttcccgcaactcttccaacgcgtggcgccattattagtgcctgaaaaggttttggtggtgacgggtaaggtcgagcaacaacgtggtcgtgatgatattcagattgtcgcgaatacgattgttgaagcgagccagtttatcaagcgttttgaaaatcaaaccgagcaagttgcgacaactgagccaggtactggacgctggtatttgcgtatcacagcagctgcccaagcggccggtgcacttgatgcactgaatgcggttgtgatgtcgcaccacggtaataatccggtgttggcagtatacgaagccgatggtaaaaagttggcgttgggtcaacgcaattggttgtcggctggggatgcgacaatgaaggcgctacaagaagttttgggcgccaacaacgtggttttccaggcagattaaatgagtgtttctaatgaagcgagttccaaattatgagaactcgctttttgtttttctcagattaactgcaggaagaataaatgacttatgcttgtaatacgaataactattaaaaatgggtgtgaatgcgttacaataaacaataactatccggatggataaaccacgaatgacacgctgcgggttcgaatccccatcggcggttgtttggaaacagaggataaatatatggcagaagcaaaagtgttgaccgcacaagaagtgcatgacctcgttgctgggtacatgaacgaggaccatgttaaaaaagttgataaagcatacgactttgcttacaacttgcataaggaacaaaagcgtaagtcaggtgaaccttacattattcacccgattcaagtcgctggaatcttggctgacttgcatatggatccagatacagtcgtggcgggttacctgcacgatgttgtcgaggatactgaagcaacgttagaagatgttgaacgtgaatttggtcatgatgtggctgtaatcgttgatggcgtgtcaaagttgtcaaagattgaatataagtcatcacgtgagcaactagcagaaaatcaccgtaagttgttgttggcaatgtcacacgatattcgtgtcatcatcgttaagttggcggaccgtttgcacaacatgcgtacgttgagtgcattgcgtgaagaaaagcaaaagcgcattgcgtcagaaacgttggaaatctacgcaccgttggctgatcgtttgggaattatgacaatcaagtgggagcttgaagatatgtcattgcgctatcttgagccagaagcctaccacgacattgctaagtcaatgcagttgcgtcgtcaagaacgtttggaaattgttgaccaagcggttaacgatattgagcaagcgattacggaattgcatttgcaacatgcggaggtatatggtcgtccaaagcacatctactcaatctaccgtaagatggtggacaagaagaagaagttcgacgaaatctacgacttgttagcaatccgtgtcttggtagatacgattcctgaaacatacgccgtattgggtgctatccacgcgcgttggacgccaatgccaggtcgtttcaaggactatattgcgctaccaaaggcaaatgggtaccaatcattgcacacgtcagttatcggaccgggtggccgtccacttgaagtgcaaattcgtacgtaccaaatgcacgaagtcgctgaattcggtgtggccgcccactgggcatacaaggaaggtaactttgctggggcggatgtccaaaatgcggaccagcaaaagttgaatgtgatccaaggaattttggaattgcaagaagacgcgcgtgatgcggatgacttcatggagtctgttaagggcgacttgttcacggaccgcgtgtttgccttcacaccaaagggtgatgttattgagttggcaaagggtgctggaccattggatatggcgtacagcattcacaccaatgttggtaaccacacaacgggagccaaggttaacgaccgcatggtgccgttggattacccaattaagacgggtgacattgttgaaattgtgacgtcacaaaacgccaagccaaatcgtgattggatgaatttggtgtcaacgcgtcgtgcccgtaacaagattaagcaatacttccgtaagctggataaggacgacaacatcgaagctggtaaaaagatggttgccgattggctagctgaggaaggctttgatgttgaagagttgatgcaagctgacaacgaagctaaggcggctgaaaagttgcacttcctaagtgttgatgacatgtatgcatcgctcggatttggtgatttgaagcctcaaggtgtagcaaacaagttcacagaagaaaagcgtgcggagcttgaagaagcccgtcaagcagccgaacaaaaagccattttggaagaacaccaaacgattgaaaacgaaagcaagaagtcgaaggagaagccacaacacggtgaggatcggattgtgattcaaggtgtcgacaacttgttggttcgtttgggtcgctgttgtacaccagtacccggtgatgaagttatcgggtatgtgaccaagggtcgtggtgtatcagtacaccgtttgggatgcccaaacttgcgtgcggctgaaacggaaggtcaacgtttggttgatgttgcctgggaaaagccagaaggtgatacgaagaacgagtatgacgctgacttggctgtggcagcaactaaccgaaacaagttgttgaatgacgttattcgtacggtgaataacacaacgaagtcattgaactttgttaacggtcgcattgatcacaataacaatgtgaatatttcattgagtgttggcgtgcgcaacttggaacaattggaacacatcatggattcaattaagaatgtcaaggatgtctacgaagtaaagcgagcatttaagtaatgagagttgtcttacaacgagtatcatcagcgagtgtgacggttgatgaccaagagttgggtgcaattgcgcaagggtatatgttgctggtcgcgattcaagatgcggatacggaagcggagttggattacttggttcgtaagattactggcttaagggtctttgaagacgaagctggtaagatgaacttaagtattcaagatgttggcggatcgattctgtcaatttctcaattcacgctatatgccgatacgcgtcgcggtaatcgaccaagtttcacggatgcaggtgcacctgcgtatgctgaaaagatgtatgaccaatttaatacaaaattggcagcgacgggcttgacggttgctactggtgagtttggcgctgatatgaaagtcagcttggtcaatgacggaccagttacaattatctttgataccgataataaataatatgaattttgacgtggtcaaacaaaagtcatagtttcgccctacaattccctagtaatatgcaatgatattgatagtattgtctgttgcgcgtgtgctacaatacagatatacaaattaagacaattgcgaagggaagtatcgttatggcagagaagctgattcaattgcgcgtcgaggacaatgtcaaggacaaggcagatgagattttcaagtcacaaggtttgacaactcaaacagccatcaagattttcttgacgcaagttgcgaacactggtgagtcaccatttagcaacttgttctcacgcaatcaataatttgtagaagtgaatagagatttcggttgggcgtatgcttcaagtttcctgggtgggtaaccaggggaatttggagtgtgcgcttttttgtttttgttgaacttatattaaataagttgtgggaggtagagatggaaatagtaatgatgttgggattactggttgtgacactgggatttggctggattgccggcaagttaggatttgcaaaagttgtgggacagttaatcgccggtgtggttgtgggaccagcactgcttggattggttgccccatcacatttgatgcacgttgtctcagaatttggggtgatgttgctgatggtgaatgccggtttggaaactgatgcgcgtcaattattgcaaaatttcaaggcatctaatttggttgctttgatgggagttgtcgcaccgttagcggtattcccggttgttgccttgctatttggttacgagtggcaaattgcgttgttctggggtgtcgtgttcgcggccacgtcaatttcaattaccatttcagttttgggtgagcaagggaagcttggaactgttatgggagctgttgtactgggtgcagccgtactagacgatatcttggctttgctattggtgacggcttatgcagcctttattggtggatcaggactaggactaaacacggtgatgccaattattgcgtttgccattggtgtgttgctccgtcagctgccaaagtcagataagttgttgcatacgactgaattgtttggtgaatggacggtgttcccaatcttctttggatcaattgggttgaacgtcgtctttaataacctggctgaaacatggtggattatgattttgctaacagccttggcagtcgcaacaaagtactatggcgctggattcggtgcgcgtatggcacgactagataagtacaccagtaacgcaattggcgcggggatggtctcacgtggtgaaatggcgttggttattgctcaaatcggtgcaactggccacattttgtcgaaccaagtgtttggtgaaatggtcattgttattattgcgtcaacgattattgcacctttgatgatgcgtccgttgattgcgaaagttaaataaaattggaaaaaatgggcttatttgtctctttcttgtcgaagcgtaaaaaaacactgtattgcatacgtgttttttacgtattaaaatgaaggggcaggcttgtccaagaaacatgggatttagggggtggcttcgatgaaggatacagtggtttatccgattattgtgcacacacagaccgatgatgattactattttgtagaaattccagcggttaatggtatgacacagggaaagtcagtagcggatgcaatcgagatggcacgagaatacgttggagaaatggcggttgagttagctcacgatggtcaagatttgccggattctgtctatacgttgccagtagcaactgaagatgaagttgtaacgttagtagatgtaaacgtcaaagagtacattgcgttaagcgataatcgccccgttaaaaagacactaacgattccatatgcaattgatcgcatgggacgcgaggcggggattaacttttcccaaacactggctgaagcgattcaagaaaaattacagaattaaaaaacaggacctgagaactcgttgtgagtcatcaggtcctgtttagtttatatcttacaatgggtcaacgtcgtaacgcttcgtacgcaattcttgcttttgcgccttagttggcttgaacaagaagtcgaagtaagctgcacgccagtcatcgaaagaaatggccaattcagcaatgtcttcaggaatgtcggcacgtgggatacggtcgatgtctgggtgctcagcaacatagctttccatccagtcagcaatcttagcgtgaccttcgttttccttttcaacgttgaaccagttcgttggctcgtagtaaatcaagtcatcttcaacgtcgaacaattccatcgttccgtgaacgcggaatgggcgaatcaacttaacatcagggttaaacttccaaacgaagttacctggtgcagtttcttcaacgtcttcaagttgcacgacagcaccagccatgtttgatggcaaaccagcttgcttcaatgcgtatgatgtaacgaccaagtcgccacggtgatcagttccaaatgggtaaaccacaccaatctttgatccgaccaagatgtcgatcaagacttgtggttccataccaacagccttcataggatgtatctcactttcaaaataaaatatatgtctacttattttatcaaaactctgggaaaatgtcagaaatgaattcgaattagtttacatataacgcctaacttctggtaaactagagtagacagaaaatgggtttagtgacggcatgtcagttgaacaacggctttgccagcgctgtggcatcggactaccttaggttgatgcagctgatgcaaagagatatatggagaaaataatatgacacacaaaattggagaaatcatctcagccaaggtgacagatgagaacgacaagtattactacgcacaaattgacggtttgacatacgaaatcgacaagagtgaattgcaaaagccattgaagattggcggcgttgtaactgggtttgcatacgagaacgaaaagcacaacttgcaaattacgaagaatattcctgacgttcgtcttggtcactatgcatggggtgaagtaacggatattcgccgtgaccttggtgtctttgtgaatatcggtttgccaaacaaggatgtggttgtgtcactggatgagttgccaacaattaaggaattgtggccacaacgcggtgacaagttgatgattacgttgcgcattgataagaaggaccgtttgtggggtgaattggcctcagctgacatcctacaagctgtgcgtatcccagctaagcctgatatgaagaacaagcaggtcaaggcaacggtttaccgtttgaagatggtcggaacgttggttatcacaccagattataactttgggttcattcacccagatgagcgtcaacgcgaaccacgtcttggtgaagaggttgatgcacgtgttatcggcgtacgtgaagacggtgtgttgaacttgtcattgcgtccacgtgcttacgaggcaatttcagatgacgctgcgatgttgttgacgttgttgcaacgttcatcaacgcacagcttgccatttactgataagtcagacccaaagcaaattaagaagtactttggtatgtcaaagtcacaatttaagcgtgctgtgggaaacttgtacaagcaacgtaagattacgcaaaacgagaacggtttgttcttggtagaagaaagcgacggcgaataagatgctacatcaggtaggtccatatgaagataatatggttgactacctgcactatctgacggtggagcgggggttgtcagccaatacgcgggcatcctatcagcaagacctgcgtcatttctttacgtatttaattgaacaagaaaagtcgatgccgttggcaaatattgatcgttttacgattatggcgtttctaggtgaactggagaaaaacggcaagtcacgtaacacggtcattcacatggtgtcgacattgcgaaagtttttccaatttgcgaccagcaataactgggtggccattgatccaatgacacaagttgatccgcctaaaaaggcgcaacacctgccagccgttttaacgctgactgaagttgaagctttgttggcggtgcctgacccaaacacgccgttggggttgcgcaatcgtacaatgctcgaagtgatgtatgcgacggggttgcgtgtgagtgagttggttaatttgcgtttggataatttgcacctagaactggggctgattcagacgcttggaaaaggtgacaaagagcgcattattccgattggggatgtagcgtcacactggttgcaacgctacctagccgacgggcgaccattccttggtaagcaacaagatgagcaggtgattttcctaaatgatcatggtcatcaattgacgcgccaaggtgtttggaagctgattaagggttgggtgaaggcagcgggcattacgaaagatgtgtcaccacacacgttgcgccactcatttgcgacgcatatcttggaaaacggtgctgatttacgcattgtgcaagagttgcttggtcacgccgacatttcgacaactcagatttatacacacatttcaaataagcgtttgactgaagtctatggcaaaagtcatccgcgtgcttaattaagaaaggaggccacacatgctagttgtggtacgcaaagatcaaccgaaaattgcgatgggattattgtcatacttgccacgtttacatgatgtggcttctgtgcaacgtgaaatcgagtggtatcaagcaagcgaggcgcgtgaaatcttgctgtggcagtcaactgaaacgcaacattacgttgctgttttaggtgttgaagcagtgtttgattcaatcgtgttgcgcttggttgtgttcggaccggaagtgccggttacgtcacgcattgctgtcggttcagacatatatgaggcgatgaagttgcgataccctgacaaaacgattgttggcacgattagcacgcaaccaatcttgacggaatggcggaagtatttgcatggctgaagatttaacctatcgcttgaatgactttgaaggaccactagacctgctcttgcacctaatcaaagttaacgagatggatattatggatattccgattgttgaaattacggcgcagtacttggcgtttttgcatcaagcggaagaacggaacttggatatcgctggcgagttcttggtgatggctgctacgttgatgtcaattaaagcgtcatatctgattccgaagaatgaggaactaacatatgacgaagaattggcggagtttgtatacgaagaagatccacgtgaagccttgatggcacaattgctggagtatcaacgttatcaacaagcggctgatgacttgcgtgaacgtgaagaagggcgtcaattgcaattttcacgtgcaccaatggcgattccggacgatattgacgttgcgccgttgccagaaggacttggcttgttcgatttgcagctagcatttaatcaaatggtcgctaaccgaacgaagaaacaagttcgtccgcgcaccatgcgtggtgaaacgtggtcaatcagcgcgcaaatgaaaaccatcgtgtcacgaatgacacctggtgaaacaatagaatttgaaacattctttggggagcatgatagtcgcgataagatggtgacgaccttcctagctatgctagaattggtccgtcatcaacatttgcgagttgcccaagaagatgaatatggtgcaatttacctgacactaggtgatgtaccttatgacgaaactgcagatgagggagtcgattttgacgatgaagactagcttacaacaaattgaaggtttgctttttgtagccggggatgaaggcatcacggttgcggaaatggctgatgcgactggtttcgcaaagcccgccgtcattggcttgttagaagatcttgccgccaaatatgagagcgacgagaatagtgcgctcgacgttttgaagactgatgatcagtatcaactggtgactaagtcagagcttgctgagacgattcaccgttacttcacggcgccgttgacgacagccttgtcgcaagcgtcactggaagtgttggcaattattgcatacaagcaaccaatcacgcgcgttgagattgatgaaattcgtggtgtgcaatcacaggcaacgattcaaaaattagcactacgtaatttggtagaaggacgtggccgttctaatgaaccaggccgaccaattctgtatgggacaacggcatatttcttgaactactttggtttgagtgatttgcaagagttaccaccgttggtaaccgctgaggcactagatgccttacgtgcccaaaaggatgtggcattgcctttgatgccaggagaagaaggcgggtctgcatttgatgtagccttgccagaacttgctgaaacagcagaaagagattaagaatatggcagaacgattgcaaaaagtgatggctcaagcgggagttgcatcacgccgtgcatcagaacaattgattttggatggtaaggtaacggtcaacggtaagacggttcgtgaattgggaaccaaggttgaaccatcagataagatcgaagtaagtggtgagccaattgattcacgcgaaaagttggtttacttcttgttgaacaagccccgtggcgttgtgacgacaaatagtgatgataagggccgtgcaacggttatggacatcgttgatgagcctgagcgtgtttacccagttggtcgtttggactacgatacgaccggtgttttgttgttgacgaacgatggtgagttggcaaacaagttgatgcaccctcgttaccgtatcgacaaggtctacgtggctaaggttaagggcattccaacgaatgaagaattggaaaagcttcgccacggtgtcacagttaagacaaagcaaaacggtcgttacacgacgtttaacgctgcgcctgctcgtgctgaaatccaatcaacgaacacaaagaaccacacggcgattgtgaagttgacgattcacgaaggtaagtaccaccaagtcaaggaaatgatgaaggcggtcgggcacgaagtcttgaagttgactcgtgagcgttacggtatgcttgatttgactggcttgacaccaggtgagtaccgtcctttgcgttacgaagaagtacaagcgttgaaggctggaaagcaataccgcaagtcatcaggacgctggtaagctataatagaggcgtctggggcttcctggaggcctcttttttgtcgataaaggggaaggttatgagtaaaagtcgattagaagcgtttagtgatggtatctttgcaatcatcatcacaattatggtgttggatttgaaaattccgtcaatcggtacgtgggcggggattggcaatgctgcgtggctaagtacattcttggcttacttggtgagcttcattatcacggctagtttttgggtgagtcaccacttgattattagtaatatcgagaaagtggatagtggtgtgttgtggaccaacgccttgacgtttttgccgatgtcattggtgccaattacgactgcttggtttggtgaattcccgacccgtgtggcaccgagtgtgacgtatggcattgtgtatgtcatgtccgtgattgctttgtacaatttgagtcacgttatcgctaagcatttggatgatccggcgcaacaaaaaagaatgtggcgcgttaatcgcagtcgtctttggttgattggcatcggtctcattggtactggcttggcatttgtctggccaccgattactggtggtatggtctttgttatttcgggcggttggctatttttgcgtaatgtcatccacgttcgagctatccaggacatgtaaccgctcgacatttgttacaattacagtaagatgaagaagtgtgaaggctgattgattgcttcacagaaacgtttcacagtgattgtgatgaaatatgaatggggggatgcaagatggcaacaccagatacacgttctggccgtaattatatgaaaactggccctggcatgtacgcctttgcgaaggaacacaaagttgccggttggccttggctgttgaagccgatgggctggcttggccgtaagtattttaagaatattgagaactcgcttgctgatgacgaaacggttgtggtcgctttcttaacgaaaatggctggactgaccgacgcaggagaacctactggtcgcttcaagtggtatgcatttgcgcttggtgattccgggactttgtattttgcgcattggcggccattccatttggactctttgcgtatgacgcttgatcaagtgaacacgattaatccggacacgggtattgttcgtggtcgtttgcaaattcaaacgttgcaaggaacccaagatttgacgttgaagtggttcgccccacagattcgtcgtatctatgatttgttgaataatgagaagcacgcctacgacaagctacgtcacaaggttgacctagacggttgaccgttagttagtcgcgtgatagtcttaacctacaattgaatatcttcagggcagggtgaaattcccgaccggcggtaactgcgttttgtagaagtccgcgacccacatccgttattggtgtggctgacacggtgtgaatccgtgaccgacagtaaagtctggtatgcagaagaaaaaatagattgactggtcacagccggtttctttgtgtcgccctggcacgaaggaaccggctgtttttacgaccaggtggaggtttgttgttatgaataagacgcgtcgattgaccgttattgcactattggctgcgatatcatttgttttgatgatttttccgcagtttccattaattcctggggcatcatttttgaagattgatttttcatttgtacctgtcttgttgggtgcgttgatgcttgatttaaaaagtggttatgccattttattgcttcgctcactattgaagctactgttgaataacgaaggcgtgaacgactacattggcttgccgatgaacattattgcgatggcagtcttgttgacggtcatcatggtgattgtgaagcgtcaagatatttcgccgaagcgttatgtcgttggggctgtactagggacacttggtctaacattggcgatggtgattttgaactacgtgtatgcagtgccactatatgcgatgtttgccaactttgatattgcgaagacgattggtcttgggacgtacctattatggatggttattccgttcaatttgattgaaggggctattctgacagccgtctcaggtttggtctatttggggttgcgtcaaattattaacacgacccgctcacaacttaattaaataagtcctattctgcttgcaccgttttggtttcttcattacacttggaagaaatacatgagaggtggtcaagcagttgacaaatgatttcttgatcaccctgttttcggcgtctgaacctcgtcgtcacagggtgatttttggtttattgaagcgtcaggtgacagtgtcaacggaatattggggtttgcgctatgggttgttgcaaatttcaggtttgatgcctcgcctagataaggacacatttgatgcccgtattgccgcattggagcaagcaggattgctggctgaggcaggagaaggtcaacttgttttgacgccagccggtcaagaagcacaagctgagtatgccgcaaatcactatatgccagagcatttgagcacgttgcttaaggtcgatgtgttgacctttatgcaagccttttggttggcaaatcaagtggtgtcagaagtggcgtacagcaataagaagtactatccattgcaaattgatccacgtacgatgctgacggttaagacgtggtatggcaatatgaattcaccacgcttggttgcaacttgggcattgacgattcaacgattcttgcaacgtcgcccacaagaagatgcagatcgtttggttgcaacttgggtcggccatgaaacgccaggacttaactttgagcaattgggattcccagcaacttggaccgaagatgacttctatttctggcaaattgatcaatatgccatttggtcggaagagttgcaacgtggggccaacacgccattgaagttgttgtgggatttggttgcgcaccgcccattattgcctaatagtgtgcaagcttcatacaacggcgttatcgctggtcgaccaatggatgaaatggtccaaagccgccgtttgaagattggtacaattcgcgaacacttgttgaccgcggcaatttggctaccaatgaatgattttccatataagaactatttgacaccggatgtggttgcgcattttgaacaacacctaaccggtccaattaacgattgggagtttagcatggttcgtacgtctgacgacccactcgaattcttcctattccgtttgtacgagatttatttgacgaagcaagaggaggccgctcgtggataagacagctttgactgcggttttaaaagaaaagtttggcttcgactcatttaagccgggtcaagcagaagtgcttgaagcattaactgctggaaaaaacaccttggccatgttgccaactggtggtggtaagtcattgatttatcaaatgatgggtaacatgcgtgatggcttggttatcatcgtgacgccattgttgtcattgatgcaagatcaagttgcgcgtttgaattacgccggtgaaccaaaggtggtcgcgttgaattcaacgttgccacaggatgcccgccgtacgattttgcgtagcttggatcaatacaagttcttgtttgtgtcaccagaaatgttgggacaaaccgttgtgcaatctgctttgcgtaaggtgaagattaacttactagtcgttgacgaagcgcacacaattgttagctggggaccggatttccgaccagattacttggctttgccacaagtccacaagaaacttggacaaccacaattgctattgttgacggcaactgcgacgccaaagatgatgacggatatcacagtgccatttgggttgcctgaatcagattggtttatctatcgtcaatctgtagaccgtccgaacatctatttgcacacggaaacgctagcgaacgaaggccagaagcgtgaacgcttagctgatttggttcgccaactacaaggaccagggattgtttacttctcaagtcgcaagttggcaacgtcaatggcggattggttggctgagaataccggccgtcgtgtcgctgcttatcacgctggtcttgatacgatgtcacgttaccgcatccaacaacagttcatgttggggcaaatcgatgttattgcagcaacgtcggcgtttgggatgggtatcgacaaggataatgtccgttatgtcattcactaccacttgagtaatgacttggctaattacctacaagaaattggtcgcgctggtcgtgatggtgagcaatcggttgccatcttgctttatgtgcctggtgacgaaaacctacaacttaacatgatcgacggtacgattccgaaccgcgaagttgtcatgggatactatgataagcgttttggagccgatgaaattggccgtgacaaggcaaacttgcttgatttttacgcaaagcaaggtatgaatccagatgaggttgcgacgatgtttgaaacgcgccgtcaacaacgtcaacaagatttgtacaatctcgttaattacgcgaagtcagacgccgggttgcgacgtcaattactagatcacttcggcgatgatgcacagtctaacgatgatgctgagtctgttggtgtcgtagattggcacccagaaaaactcgcgttggtggcaactgaagcgcctacagaactagcaggtgtgacggattggcgcacgcaagtcgcaaaactttttaatttaggttaaggattaggtgtgacactcaaaattgaatgcgagttagtgtatgcttagaagtattcaaagagagaaagttaggagaccaatcatgaccgagaagaataatgaacaacagccatgggaggcatcttttaaagatgaagcaaccggtcaatactcacgaacgcaaaaccgacgcaagtctcaacgcgtaagtatggttgttgggattttggtattgattgtgattgctctgtcatttgtgcctgtctataagtatttgcaagcgttgaacaagccagttgatgccacaactagcactgaattgccagcaacgacttcaacaaagacaaccactacaacgagcaaagttacggaaactgcaaagtcagagtcacgcgctaagaaggcggctagtgcttctgagaagaaagccaaggcagcaagccaatcagcagcagaagcgtcaagcaaggctgcttcagagtcagctgcttcgtcatctgaagcctcatcagcctcaagttctagttcagaatctgatggcaatacggtgaagtttgaatctggtactttgtacagtttcgcagttgccaatgggacgacgcctgaagcgttgtactcattgaacccaggattgactgcctcaaattattcaacctactatggtcaagatttgaaggttaagtaatcccaaaaagacacattccgctgggagtgtgtcttttattttgtgcgaaattaacgtacaattagttggtatctaaatgagtgaggacaattgattatgaatccgattcaaatcgcaattgacggaccagcctctgctggaaagtcaacgattgccaagattttggcatcagacttaaattttgtgtacgttgacactggtgcaatgtaccgcgcaatcacgttggctgcttttcaagccggtgtggatccaaatgacgaatcaggcgtaacagctttgttgcctgacttgaccattacgttccaacctggtgagccagtgcaacgtgttttcttgaatggtcaagaagtaactgaagatatccgttcagttgaagtaacggctaatgtttcagctgtttcttcatacgccgctgttcgtgaagcgatgacagccttgcagcgtgacattgcatcagagaatggtgttgtcatggatggtcgtgatattggcacgacggttttgccaaatgcagaagtcaagattttcttgattgcttcagtggcagagcgtgcccaacgtcgctttaaggaaaaccaagctaaggggatggacacgtcacttgaagagcttgaagcagccattgagaagcgtgactatcttgattcacaccgtgaaatttctcctttgaagaaggcggatgatgcggttgaattggatacgactggtttgtcaattgacggtgttgttgacgcagttaaggccattattgcggaaaagacgcaaaactaacaaaaaacataaagaaagttgtaaaagactactagtaatttataaaaggattcggtataataactactagagtcgtgtgaccaggaggatatattgtaatgaacgaagagaacaacgagctattggcagctcttgacagcgtagccgaagttaaggttggcgatgtagttaagggtgaagtcttggcaattgacgatgctcgtcaagttatcgtaggtatcgaaggtgccggtgttgagggtgttatcccaatgcgcgaattgacggctgaccgtgatgcaaacgttaacgaccttgtcaaggttggagacgtattggacttggtagttgtatcaactatcggttctgacaaggaaggtggatcatacctattgtcaaagcgtcgcttggaagctcgtcgtgcttgggaagaaatcgcaagcaagcacaatgttgatgacattgtggaagcaccagtaacgcaagtcgttaagggtggattggttgttgacgttgaaggtgtacgtggattcgtacctgcttcaatgatcgagaaccgtttcgtgcaagatttgaaccaatacaagggtcaaactatccgcgcgaagattatcgagatcaacgctgctgacagccgcttgatcttgtcacgtcgtgacgttttgaacgaagagcgttcagaagctttgtcacgcgtattcaacgaattgtcagttggtgacgtcgttgaaggtaaggttgcccgcatgactaacttcggtgcattcatcgaccttggtggtgtagacggattggtacacgtatctgaaatctcacacgagcgcgtttcacaaccatcagacgttttgtcagttggtgaagaagttaaggttaaggttttgggattggatcctgaaaaggagcgtatctcattgtcaatcaaggctacgcaacctggtccttgggaagctgcagctgccgaagctccagaaggaactgttttggaaggtactgtaaagcgcgttgttgactttggtgcctttgttgaagtgttccctggtgttgaaggtttggttcacgtttcacaaatctcacacaagcacattgctaacccaagtgatgttttgaaggccggtgacaaggttaaggttaaggttttggaagtaaaccctgacaagcaacgtttgtcattgtcaatcaaggctttggaagaggctcctgcacgcgaagaaggttcaaacaacaatgaccgtcctcgtcgtcaacgtcgtcctcgccaagagcaagcaccaactaactactcaacttcagaagaagagggttcagctacgttgggtgacgcctttggagatatcttcaaggacttcaactaataagctttaaatagcgcaaaagattaagcgtgtgttgggttgtctcaacgcacgcttaatttcgttaaaacacgattttctactggtcacgacaacagacagtgccggtgaaaaccggtacaatagagaatagtaagtaaccgttagttatccatttgggtgactgacagaaaagagggtaacatgggatttcctgttgtggccgttgttggccgcccaaacgttggtaagtctacgatttttaatcgtattgccggcgaccgtatttcaattgtcgaagataccccaggtgtaacgcgtgatcgtatttacacacgcgctgagtggttgacccgtgaattccgtttgattgacactggtggaattgatatggctgatgagccattcatgacacaaattgtgcaacaagctgaaattgcgattgacgaagctgatgttattatcttcatggtttctgcccaagaaggtttgactgaagctgacgaacgcgttgcaaagattttgtaccgttcaaagaagcctgttgttttggccgtaaacaaggtcgataacatcgagatgcgttcagaaatctacgaattctacgcacttggatttggcgatccattcccaatctctggtgctcacggtactggattgggagatttgttggatgaagtggtatctcacttcccaacgactgatcaagaagaagaagacgattcgattcgcttctcattcattggtcgtcctaacgttggtaagtcatcattggttaatgccatccttggtgaagaacgtgttatcgtttcagatatttctggaacgacgcgtgatgccatcgacacgcgattcacatctgctgaaggtgatgaatttgtgatggtcgacacggccggtattcgtaagcgtggtaaggtatatgagaatactgaaaagtactcagttatgcgtgccatgcgtgccatcgatgactctaacgttgttttgatggttttgaacgccgaagaaggtattcgcgaacaagacaagcacgtggctggatatgcccacgaagctggtcgtgcgattatcatcgtcgttaataagtgggatacgcttgagaaggacaaccacacgatggctgacttcgaaaagcaaattcgtgatgagttccaatacttgtcatacgccccaattattttcgtttctgctaagacgaagcaacgtttgaacaagttgccagagttgattaagcaagttaacgagaaccaccaaaagcgtgtgcaatcagcaacgttgaacgaagttatcatggatgccttggcattgaatccaacgccaacggtaaacggaaagcgcttgcgtgtttactacgcgactcaagttgctatccaaccaccaacattcgtggtctttgttaacgatcctgaattgatgcacttctcatatgcacgattcttggaaaaccaaattcgtaagtcattcgactttactggtacgccaattcacttgattaagcgtgctcgtacttaatagatgataaaaacctcgtagcgattttcactacgaggtttttatttggctgcatacctaagaataccgaacaatagacaagtactgaaaaacaaacattcagtgaataaaacgtgaaaatgtgggaaaaaccgcgttatatcaacgtttttagcacattgtgggttgttatggggttttaactatgctattctaaataacgaaatcaaagaacgattcgttcaatttcgtacatttgggaaattccattaagctattaagcaggaggaacattagcatggctaacaagcaagatttggtagaaaaggttgttctttcaactaactttacgaagaaggatgcaaacgaagctgttgatgcagtattcgccgcaatccaagaattccttgcaaaggatgaaaaggttcaattgatcggcttcggtaacttcgaagttcgtgagcgcgctgctcgtaagggccgcaacccacaaactggtgaagaaatcgaaatcgcagcttcaaagattcctgcattcaagcctggtaaggccttgaaggatgccgtgaagtaagacttcctgagaaagagatgtgcctattggttcatctctttttttctatcagttctccatactctgacaatatattctgtgataaactacatgtatgacttgtgaagggaagcgaagttgatggagaatccaaagaaaatggtgacgattgctggctcggatattttagccggcggtgggatacaagctgatttggcgacctttaatgagtatggctattttgggctcagcgtgattacgagtattgttacggtgactaaggatgactttacgattcatcctgtgccgttggacgtcctcgatgcgcaactacagtcaatcttcgctttggatgatatcgctggtgtgaaggtggggttgttaccgactgtcggtcacgtacacatggtggcggattatctacgtcggtatgcgacgaacatgccggtgattatcgatccagtgatggctttcaaagaaacggacgatgtggatgttgccgagttggtggcagccttccaaaaggatttgttgccacttgcatctatgacgacacctaatctggttgaaggcgaattgttgtctggcattaagattaaggataaagccgatttagcacaagctgcagaaatcattcgtggttttggggctgacgcagttgttgtaaaaggtggggcacgcttagctgttaacgaggcgacggatgttgtcacgactggggcagaacctacctttctaggctctcagaagctcgatagtgcgtttaacaatggtgctggatgtacatttgcctcagccattgcaagtcaactagcgaccggtaaaacgccggtagacgctgtgaaagatgctaaagattttgtttattggggaattaaaaacggtgtcgcattaaacgatgatttttccgttggtaatgtgtggcaagctgcccgccgtttaaggggtaaataacatgaaaacaaagcaattaacgattgcagcggttattatcgctgttaatattgtgttgagttacgtggtgaagttgccaacgccaactggcttcgtgtcattggtcgaaacaggaatcttcattgcggcttggcattatggttcaaaaactggggcttttgttggtggattaacgggcttattgcttgatttgctagccggctacccacaatggatgattttttcattcattattcacggccttgaaggctgggtgcttggtaaatttgcgatggacgaacgcatcggcaagcgtgtctggggtaacttcttaggcggttcggtcatggttgttggttactggattgccggcgccttcttgatttggctaaccggtggcgccaagatgactatgccgagcgcagctttggcaagcttgactggcgtaccggcaaatatcatgcaagtcttggttggctttattctagcattgctgctaagtgtgccattccgcaaggtgttgcgtaaataatacagaaaagctgtcatttcgtcggatgacggcttttttactgcccgaaaaaatgatattctagaagtctaggttttttacgtttttgaaagcagggtgagtatgagtaataaaaaagtagcgtcaactggcgcaattttagcagcaagtgtcctcttgatcggcttgattatgcgatcacccattacgacactccccttgatgttaacgcagatttcaggtgagttgggtgttgataaaggacaactgggaattttgacgacgattccgttggtcatgttcctgctgatttctaattttgcgtcaaagacgatggcgttctttggcttgaaaaaggcgttggggttgtcattggcatcaatcttcttggggacagcgttgcgtttggtcgtgacgatgccaacgatgctgattggtacagtgctggttggtgcaggaattgcgcacttgaacgtctttatgccaacattcgtcgcgtcatatttctcacataaggtgggtgtatacacatcaatgtactcactcacgattatgattgggtcagcgacatttagtttgttgacggcgccggtggtggcaacgttcggttggcacgctgtcatgtggttgctagttttgttgccagctatcgtgcttggtttctggatttacacgtcaatgcgtgtgccggaaaaagtacctgcaacgcgtggtcgtcaccacgatactaacgcacccaagaagaagatttggaccaacattaaggcatggccattcttgattgtcttcggggtacaagcgattattaattacacgggtgtggcttggctaccaaccatgatggcgcagcatcatgtttcagccggatcaatctctgtgattatgtcgttctattcatttatcgggatgccaatttcaattttggtaccaaatattctggtaaacatgcgtcgcaaggggacattggcgactatcgcagtcgctgccgtgatgtcactaattggtgcagtgatgttgtttgatcaagaaacgtcttcagttgtgtactggttcttcttgacgattttgattggtttcgcaacgtcattcttcttcttgtacaccatgacaatgtttgctgctaagacatcttcgccagttgaaacggcccgtttgtcaggtatggcgcaagctggtggttactttatgtctgcattcggtccaatgctttacggtatggcttttaccgcaaatccgaatggggtcatccaaaatgtcgtttatttggtattagtgattgtgatgattgtcgctgccgtgatgatggcgatgactaagcatttgtttgactaaaataatgatgagatgttgttcagtggtgaacaacgtctcttttttgtataatgaacatacgacaaaaacgatttgggggatattatggcacgtaagattggaattatcggccttggaaacgttggggctgcggtagcgcacggattgattgcacaaggtgtcgccgacgactacgtctttattgatgcaaacgaagcaaaggtgaaggctgatcaaattgatttccaagacgcaatggcgaacttggaagcgcacggaaacattgtcattaatgattgggcagcgttggctgatgccgatgttgtgatttcaacactggggaacatcaagttgcaacaagacaacccaaccggtgaccgttttgctgagttgaagtttaccagcagcatggtgcaatcagtcggcacaaacttgaaggaatctggtttccacggcgtattggtcgtgatttcaaacccggtcgacgtgattacggccttgttccaacacgtgactgggttcccagctcacaaggttatcggaaccggtactttgcttgatacggcgcgtatgcaacgtgcagttggtgaggcatttgatttggatccacgttctgtttcaggttacaacttgggtgagcacggtaactcacaattcgtagcttggtcaacggtgcgcgtgatgggtcaaccaatcgtgacgttggctgatgccggcgatattgacttggcggccatcgaagaggaagcacgtaagggcggcttcacggtcttgaatggtaagggctacacaagttatggtgttgcaacgtcagcaattcgcattgccaaggctgttatggccgacgcgcatgctgaattggttgtctcaaatcgtcgcgatgacatgggaatgtacttgtcatacccagcgattattggtcgcgatggtgtcttggcagaaacgacgcttgattggacgacggatgagcaagaaaagcttttgcaatcacgtgactacatccaacaacgtttcgacgaaattgtggatacactctaaaaacacaaaaagtggcttcaatcaggtgattggaccacttttttctaattgtgcatgaaaggaaggcttatgaagcttttgcatactgccgattggcatatcggtaaagaactgggtggcttctcattgttagaggaacaaaaagccgcttttaagaagattttacagttggcgctggacgaacaggttgacggtattattgtggctggtgatttgtatgaccgtgccattgcaccgacaagtgctgtgacggcattggaggcgatgctacgcgagatgaatttgacgcatcatttgccgatttatgcagtctcaggaaaccacgatggggcaacgcgtctgggagccggtcacgaatggcgtgaacaaactaatttatacatcaatacgactttggcggaagcttttacgccggtcgaaactgaggaagcacaaattttcatgctgccattcttagaaccaacggctgcgcgtgtttactatcaagtggctgaagatgaaattgcggactatcaatcgattgaacaagtcatggcgcgtattgtgcccgagatggtcgcaaactttaatccagacaagcaccatattttggtaacgcactattatgtgacgggttcagacaacgaagattatgaatttacgagtgagacaaactcgcgtgtcggtggcttgaagggcattacggcgggacaatttgcagacttcgattatgtcgccttaggccacttgcacttgcgcgaagctagtccaacaaagacgattcgttattcaggttcaccggttaagttcaataccaaggaagcccaaactgaaaagggtgtttacattgttgatgtaactgaagcaagtgtgacgacaagctggcatccaattacaccgacaaaggatttgattgtcttgcaagaaacatttgaaacgttgactgatccagcattttaccaacaatatgaacgtgcccatgcaaacttctttagtattcgcattcaaggtgcggcgcaatcgtcaaacgcgcgggcggatttgacggagatttacggggatgtcgtggaattgcagtatgacatgccaaaaattgcattggatcagcaagttgtgccggaaccagtcgatgatgatatctcgaatgaagacttgattagtcagttctatgaagaagtaatgggggaatcgttgacgccgatgcaagaaacattggtgtcagacacgttagttgcgatttcacaagcggaagagggataatatgcgacctattaaattacatcttgaatattttgggccgtatgaggatacgaccgttgattttgaacgttttacggaatccaagctgtttctgattactggtgatactggggctggtaaaacaaccatgttcgacgccatgacatatgcactattcggtgaaggaacaggtgatcgcaagccggaagcgatgcgtagtgagttcgcaccgacgacggctgaaacggcggtgacgttctggtttgagcataatggtcagtactaccgtattgcccgtaagccaacacaacaactgaaaaagaagcgtggtgcaaagtcagatgacgacacgacagaacgcaaggctgaagtgtcatttgctgaagtggacgattctttgcaaacgccgattgccgatttgggtgaaaaggcaaccctagttaatgaaactgtccaggagttattgcatttgacagcggaccaattccgcaagattattttgctaccacagaatcaattccgtgaattcttggcggctcaaagtgatgacaaaattaccattttacgtagcctgtttggcacggaaatctttgatgcgtttactgaagcattgaagaatcaacgtaaggatacaaacaagcaaattgaaaatttgacgaatgagttgcgggcagcgctgaagcaagtcagttgggacgtgccaaacattgctgaaattgccccaacaccaacagaacaagtggcatatttagccactcaagttgctaacgcccaaaccgcggttgcgcaacaaacggcggttcatgagcaatcggccgctgctttgacgactgctcaagccgcattgcaggctggtcaaaagttggcgcaagcgattgaacgtcaacaaactttgcaggcacaagcagaacagttggccactttagcggaagatgtggtagcaaagcgcgcggacttagcgcttttaaactggggaaatgaacaacgtgacttagtggctaaggttgccgatgcaaagcgaacggtccaacgtttgactgacgaagcgacgcaaacagccaacaagttagtcgaagcggaaaagactgaagcgactgcacgtcaagaacaggcaactttggtagccggtgaaacggcagttgttgcgcaacgtgatcgattgacgttagtgacggaaacgttgctaccaaatgccaagcgtcaagccgatttacaaaagacgattaacgcatctgaagaacgtttgacggcattgcatgacatgcaagctggtacaacaaaacatgttgcagaagttacccaaaagatgacggattcaaatgagcgtttaacagcactagccgatgttgcaacgcaacaaacggcgctggctggttttgctggtcgtattgcatcactttcacaggcacaggcgcgcttgaatcaacagcaagctagcctggcaagcacacaagaatcatacgaatccgcacaacacaagttagccgcggcgcaaacaacattggcagaagtgattgcaatgcgtgagtccaaggcagcgcttcgtcgcgatgtgatgattcagcaattgcataatgagctgaaggtcggtgaaccttgtgccgtctgcggtcagatttacactggtgagaacgaagacccccacgctgtgcaaacaacgtacgaagatttgaaggtggcgatggctgccgttgaagaggctgaaacagctgagcaacgtgctatcgcggatgaagcaggtgtgaaggcatcggttaatgaactggaagacgcggttgcgaaggcgacgacatcgtttgaccaagcaaaggccgacctagcggagtcatatgaaacgctgtatgccgattggcgccaagcattcccaactgatttattgccagatacgtatgagtcagaggcggtgactgcacggtacgatgccgtgaagactacagttgaacagaacgcgacgttgcaggctaagacaacacgcgaaattgctgatttgacatcagaacttggtaagtataaagagcaagttgcatcaacaacggcgcaattgcaagaacaagaacgccaattgcaggctgatcaagaggcgttggcacaattgaatgcgcaaggtgagctaggggatgttgcgacgtatgaagatgagcgtcaaacattagcgtcagaaattgcgacatttgaaaagcgccaacaagccgtgcaagaagccgtccgtagcgcccaacaaacggtccaagcactgcaagcccgtcaagccgaactaacggctgaattgacggcagctaatgatcaatttgcgttaatgtcaggacgcttgggtgctgaaatcgtggccggtccggtggcagatgagacagccttcaatgatttgctggcgcgcttagatgccgataagtctttgattacgacgttgagtgctgaaatcgccacgtacgacacgcaagttgctgaaaataagcaacaattgacgtccgttactgctgaaattggtgaccaaacggcgccggatcttgtcgcgttgcaagaccagcaagagaaggctaacgaagcagagacgatcgcacgtgaccttaaggctaaattgcaatttgaattggataaattgcgcaaggaacacgaaacggtcgttggtttggaagaacaaattgcggcgattaccgcaaagtcagctgatttgattaagttgacgcaggctgtcgatggggtgaacaccaagaatcttcgacttgagccgtatgtgttgcgcagtttcctatacgaagtgttggcctatgcgaacgaacactatattggaaatttgtcagctggtcgttaccaatttgtgctctcaaaccgtcaagctggtcgtgccaaccaaaacggtttggacatcgatatttacgatcaagacgccggtaaggtacgttcaacgagcacactgtctggtggtgaatcatttatcgcagcgctgtctatcgcactttcgatggctgaagttgtgcaacaccgggccggtggggcgaagattgatgcgttattcattgatgaaggatttggatcgcttgacggaaccacattgtcacaagcaatggaagccttggcatcagtcgaacaaagtggccgcttgattggggttatctcacacgttgagtcaatgaaacaacaaattccacagcaaatggtggtcacaaaacaaggtagcggacgcagtaaattaacttatcgcatggtataagggactgtaaccgatttcatggaacttttagattgaaacgaccttttttctggttaataatggttttcgcacagagaaaaagtaaggtaaaaagtttcatgaaggaggtgcgctatgctttttctagttcaaaatcaggacggccaaatcgtattccacttccagggtgaaaatggctaccaagttgaaaaaattgacgcaaccgacttatacacaatgatgccacgccgtcgtgctgaattattggtaacgctaacggctggcgaaaatatgacggatgtgatgctcttgaagcatgaagcgggcttaacacatgcagacacggagattttaacgatccctcaactacgtgatataacattagtagagtacaaaaaggccgatgcacgacaaacgaatcgtgaaaatacgttgatgatgacgctaacgttggtgattgtggcgcctatcttgttcacgttgttggataatgttgtgttgcgccacttcggactctcgattttagattcagagattggtgcctttggtattttggtggtagtttatctggcatggtttatcatgacctacacgaagcttggtgaacgcattgaagagtgggtgatgattcacttagcgcaaattcgacgtacgggtgaacaatagcgtataataaccttattaactgaaaagaggcatttcacccatgaagaagtcagaaaagctagctaagaagcaagccactcgtttgacaaaggaaacagaattgcaattgaagcgtggattgattcacatcgaattagttgatacgccagatgaaattgcatcattcttgtcagaagataagtaattaaaaagcactggtaggcgattgttaaagtcgtctgccagtgcttttttgctagttataccaaccgtacggaacctcagcgattagctgatcgatagcgagttggtgttgtacgttatacattttcggatgactagcgagcggaacgaactctagggcaagcgtttcatccccatcagcctgcaattccccgccagtctgcgtgacttcaaataaaaacattgggatttgggctttgtcaccactcgggaagacgtggtggaagtttgtgtcaacgccgactaatgcagcaatttcaacatcgataccagcttcctctttgaactcacgttgcaaagaggtcatcgctgactcgccaagattttgcatccccccaactagactccaaccaatctcgccgtcgccacgcttctctaggagtacctttgtgcgtgtttcgtcgaataaaataccagccacgcccggcataataatttcatcgtgcccaattttggcgcgcaggtctttgaaataattctccattaccattgtgaataccccgaatcgtcgttttctcaattgtatccgttcggtcgcagaatttcaaaaagcacttttgcctgtgatacaataagtgcaacaagactactaacctttacacaggagattttggcatgacttttgatgaatttaacattgaattgggaacggtactctaccttgatagtgtttccgagcgcgaggaggccgaagtcgctaagggaaagttgccggaagctgacgtacgtgccgactatcaagcacagcgtgaaatgattatgcgctcattcttggcgttcgctgatttgtcagctgacgacagggcggttgccaaggctttggcgaacttgcacactgatttatcagatggcgagcgcacaacgttgttaaccattcgcaacctacacaatcgtgaggcggttggcaactttactgaagatgatgcagaagagcttgaggatgcagtcgaagcagccgaggcttacttgatgaaccgcatggccgatgtgctagctgattaatagaacgaggacaacatgatgaaagcactgattgtgccccaaccaattgcaaatgacgtgatgcttggccaacaagcgctcattgcctttccgtatgcacctgatgaaggggtaacggaatttttgatggtatctggtaaagagccactaccagaagaatattcactgggcttggcaatggggtaccaacttggcattgtcacgattaaccaagtgtcaaagtcacgtgacgttcctggcttttacgagtgggaagtcgcccctaagatgctagtggcgcctaaggcaatggacattgcaccagatacgtttgttgacgttgcgccaactgattacgaagaacttgaattggaaacaattggcttgttcgcttggattgctgaaccgcacgctgactttagtgaggctcttcaagcccatgcggatgctttgattgcgattgggtcaaagcaaatgccagcgaagtaccgcgaaattttggctcgtactggctcatggcaagaagtggatgcggcatgggaagatgatcaatttgaacaccgcaatcaccacatgttggaacacggtattccagaaattaatttcggtcacacacacgcacatgatgacgtgccaacatttaagttgaagtcaaagcacgattctgaatagtaacaaaacgggcgtcccacgcggatgtccgttttttcgtctagtaactcagggcggtttaagctaaaattaaacctatcacaaacgaattacaggagttcttatgctaacctcatttttggttttagaaattaccgccctaatctcattgatatgggctttgaagtttaagattacaaaattaacatggattacgatgttgattgtgacaatcttgaacgcgggttatgtgtactggttgatgccagtaccaacgttgtcacaattggtgatgccggttgcggttgaatcggcaattgtcgttgtgtgggcgttgattaccggcgcatcagcgcaagttgtgcaacgtgtaacgaagcgtggtacgcacatcagccttgaagggttgacgatttggccattcattattccaatcgtcgcgttcttgatttcattgggagctggtgtttcacaagcgttgacggttcgtccaatgtacaactctgtgcaagcgacggttaagaaggaagcccccttgactaaggatgatcaaccaatcgccttgtcagcccaagcctcacaaaacatgatgaagaaggctttctctcaagtgcctgattcttcaatgtaccgtttgggtgatttgtcagctcaatatatcaacggtaagccatactacgtggcaccagttgagtttaacggcttcatgtcatggttaatgaaccggacgttgccaggatactttattatttcggcaacggatattaatgacacggcacactttgtgaaggaaaagctggattactcagagactagctggttctcacacaatatcgcgcgtaagatttacatgcgtaatccaaagtacgcccaagtgggtgaaccaattttggaaatcgacaacaatgaccaagcttactgggtacaaacgctgcttaatgtgcgttgggctggtcaattgatgtacgatgatatccacgtgtcattgacgaacgcagatactggtaagacgacggtctacagtaccaaggatttgccagcatgggttgatgcgggtgtgtcaccagaagcagcaacgcgtatgaaccgtgcttacggtaacccatatgcgtttaacttccgtcacaagaatcaaatcaagccaaccgaaaatggttcagagagtggtgtaacgccagtcttcaacaacgaccgttcaatttcatactttgatgatttcacaacggtgacgtcaaatgctgattctgataagggatactcattgattagcacacgtacgggtaagctgtcattctacacgggtaagaacgttggtatcatggactctgatggggcgattaaggttgctaagcaattgcatccccaaaacaagtggcatgggtcaaacccagtcatcatgaacattgacggtacaccaacttgggtggtttcaatgatggatcagaatgaacgtttccgtgagtacgcttacatcaagggtgctgaccaaaacgtcattggtgaaggtgctaatgcctcagacgcgttggctgcttaccgtaatgcgttggctggtagtgttcaaacggccagtgctaacgatgcatcaattaagactgaaagcatcactggtaaggttgcgcgtgttaacgccaatgccacgttggatgataagcaagtggtgattttcaagcttgaaaatgatgagacgatgtacacgctggatccttctaagatgcaaaacgcgttgttaatgcaagcgggtgacgatgtcacattgaaggtgaagacggttaagggcgcttcagttgccaatgttatcaatttgacgaacaactctttgaagtagtttggcaatctcgggtataatgtaagtaacgagattgaaaaagaggtagacatgatgggcaagggaacaatcaagtcaaatgattttgcacgtggggcagcgtcaaagggcgctgttacccgtgatcaaaagctgtctgcacgggaggctttgttggccaaagcacgcgcaaaggcaaaggctgcatctgaaaataagtagcatttagcgctaggtacctttttattggcattcctagcgctttttatgtatgatatattattgactttatacaagaaggaagagtggtacatatggcaacatttgcagaacgaatgcttgatgaattgtctggtggacaattggaagatgcgaagaagtcattcgcctcatcattacgttatgatgatgacgacacgatttattcattagcggaagaattgtatggtttgggattctcaacccaagctaagcgtgcataccaaaagttgttggagaagtatcccgacgaagatcaattgcgtacggctttggctgacattgcgattgatgaagataagacggatgaagcgattacttatctagccgagatttcacctgattcaacagcttacattgaatcattgttggtgttggctgacttgtaccaatctgaaggtctaaacgaagcggcagaagccaagttgcgtgaagcctttgatctagcacctgaagaaacgattatccaattcgctttggctgagttctattttgctacgggtcgttatgagacggctattccgttctaccgtgacttgttgaaggccggtgagcgtcgcttctcaggtttggatatcgcatcacgtatcggtgttgcctacgctttgacgggtaactttgcgaatgcattgggttacttggagcaaatcaaggatgccgatttgacgcctgatgtccgcttccaattgggaatgacgtacgcagttgatccagaaaaggtcgacaaggccatcgatacgttggaagagttgcaagaacttgatccatcatacgctggtttgtacgagcctttgggacaattgtacgaagacaagaacgatttggaacaagcgttgattacgtaccaagccggtattgcggttgattcatttaacacgcaattgtacacgcgtgctgctgccgttgcacaagcacaaggtgaggacgaagaagctgaccgtatttaccgtgaggccttggagaacaacccagaagatttgacgttgacgattggatactcaaacttgttggttgctatgggagaccatgttggaaacatcaacttgttgaacgagttcttggctgacgacgatgctgaagctgacccacaattgtactggaatttggcacaaagctacacggctttggaagacttcgaaatggcaacgaagtactggaatgccgctttgccattcttcttggacaacattaacttcttgaagcctgcttacttctacttccgtgaagagggtgaaacggctttggctgaagaagctttgttcaattacacgcaattagcacctaatgatcttgagatggctgaactatacgaccaacttaaggaagaaaagggactataattttctaaaatttaaaaataataaccggatgggtattatcacttctttttaagcgataatacccatcctttttttattcccgttagaatgacaacgtacatattaaaaataaatagcgtacaaatacaatcagctatttgttttgaagggggatgagttgttttgcataagaaaactgttatcgggatcacgattgcgttggtatcagcgatggcaatgccagttttagtggaagctaatactgacacagtgacttatcagacacaaggcgttgcacgatttacaggaagttatacgtatcctgctgatagtgtggtcaagccgactgacacgcataatccattctacggggcagcaaatgaacaacatggccaaccagtgttgccaaatacaggtgcaccatcatttgtggaacagtttggattggcgctcgcgactttcgggctcgccatcagtcttgcgttctatcgcgtgacacgaatgcattcaaatcatttttcaagccattcttaacaatgtgtctgagctaaatgaggaggagtaatgaagatgcgcaagatgaagtcgttattttccgattctagtccggggattggcgcagtttataaagtgtcgacaaacgacaaaggttaattaagaggagcacataatgggaaacaaactgtttgctaccgccttggttgccacggtttctctattaggcgtgtcaactgtgacattcgcaagttcatcactaccaagtcagggaacggtggcctttacgccgtctaacggtgtgatgccaccttataacccaaatcatccaaatcacccagttggaccagttgatccaaaacagccagaaccggggacggctggtccgctttcgttggattttgcatcgaattttgattttgggacgcataagattcaaaatgcggatgcgagttatgcagcgaaggcgcaaaaggtgaatgacggtggtacccagcaagaggtaccagattatgttcaggtaactgatgatcgcgggactcacgctggttggtcgttgcgcgttgcacaaaacggtcaatttaagtcagacgatgccaagcgcgctaaggtgttgacgggtgccactgtgactttgagtgggtcacatgctattgggcgtatggtgacgcccgcaccacaaacgcgtgatgaaacattgccgccggctggtgatcaaaccgtagtgatgaacgcaaccaaaggtgagggtgccggaacttggttgatgccttggggtgcagatgacattttgaaatctgaaaaccaggtcctagctaataatcagcccaccgctgtcttaacagatccggatgtcattttaaatgtgccaggatcaacgccacgagaagcggttgcctatacaacaacgttaacgtggacattgaacaatgtccccatgtaattttttaaggagtaacacaatgaagaagcaatttacactatttgctgctacagcattggcagctatgacggttgtaccaacgattggattcgctgatgatacggcatcaaagaccccaattacttacgattcaaagggaacggttgagttcgttgcaccaacaacaccaaacaagccattggatccaaccaacccagatccaaacaagccacttgacccaaaggaccctgatggtaatgatccaaagccaggtacagccggcccattgtcacttgattttgcgtcatcatttgactttggaaagcaagaaatcacgtcagttgacaagacatacaacgcttcagcgcaaatgattggtactggtaaggatgctaagtacgtaccagactacgcccaaatcactgataaccgtggaacgtttgctggttggaccttgtcagttaaggaaaccgattcattccacacgtcaagtaacgttgagttgaaggcaacgcaaattaagtttgccgacttgaaccatgcaacgactaacaccctaaagactgacgttacaatgccaagtgctggctttacaattaacccagccggcgcttcagtaaacattatgtctggtgccaaggctgctgacggtaagactaacggtacttcaggtacacacattatccgttttggaaatgacaacagcttgaaggctgacacccaagctaacggcgaaaagcgcgataacacagttgacccatctgtaacgttggctgtaccaggttcatctgacaagatggcgcaaaagtacacgacgactttgcaatggacgcttggtgagacgccaaccactatcgattaattcaattaatcaataaaaaacgaccgagacaattgtgtcggtcgttttatacatacttagaagaaaggaacagaggaatagaaaatacagctaagtggaccaaagtgttgggggccactgttctggctatggcggcaccgttggtaattgcaactggtgtttcggctaatcaattgacgttctccgtgacgccagctttgccggacaatcaaattgataagacggacggttttttcaatcttaagttggatcaaggcgcatcagaagatttgatgttgcattatgctaacaacacgaagcaaccgattgaagtctcaacgagcgtggcacctgcgtcgacaaatcaaaacggggtcgttgagtatggaccgaacacgattaagccggatgtttcattgaaatacaatatgaaagatttggtgaacgtgcctgacaaggtggcgttgaatccgggcgaaacgaaggagtgccagtccatgtcacaatgccaaatgcacaagtgccaggtattattgccggtggtctaactttttctgataaagccgctgataaggctaacgaagcaacaaagtcaaagggaacatcaatcaaaaatatttattcattccaacttggtcttttgatgcgtgaatcaacggatgcaccatataaagaccagatgctgttggaaaacggattgaaactaaagtcggttaagccaacacaagtgaattaccgaaatgtgattgcggctaatttgcagaatccggacggcatctacttgaacaacttcgcggttgacgccaaagtgatgaaggcgaacaagtcgaaggttttgtacgagtcgaaaaacaacagcatgcaaatggcacctaataccaactttgattacagtgtgccacttggggatggaacacgtatgaagccgggtaagtataagctggatttgacggcatatgcggacaaggataatacgggtgcgttcaagacggtcatgtttggtgaaaagacggattaccgttattcttggcacttcaccaagacgtttacgattgccggcgcaacggctaagcgtttgaacaagcaagacgtgacgattaagccatttaactggttactagcagctgtcatcgcagttgtgattgcgttgctattgcttttgttgttgctaaagcgtcgtcgtgataatgaaaagatcacgattgaagaaatggcggagagtgctaacggtgagcaagttaagattgttcgtgaggtcaaccagtcagaataccgccgtttgaagaagcaaggtcacgtgatgaccatcgttagtcacaatgcgaagtaagcacgaaaatcgaacggatcgattgattaaatacgctattattgggttagttttgattgccgcggggtttgccatttggacgtttttacaaaagtcacttgtgacaagcaaaatcgtgaatcagcgggtgacttatactgagcaaatgccgaaaagtataccggcaactgaaacgattcatgcgtttgacggcggtaatccgtttgctaataataatcagtcaaaaacggcgattggtcaggtggcgattcccaaagtggatcttgttacgaatgtatttgcagggttaacaaatgctaatctgagttttggtgctgtgtcattgtttcctgaccggccgattcaaaaccacaacgttgtattgattggtcacaatatgggtgtgcgtcatctacattttggggcacttcaaaatgtttcgattggtgataaggtgtatttacgatatctcggtcatagctaccagtatcaggtacgacaaaaatcaacaatcaaagagacgcagattgatcgtgtcgcagatacgatgacatcaaagttaacgctagtcacgtgttcagcagcaacccgaacgcctaaccgaattttggtttcggcggatttggtgaaggccttacctccgcgacaggcgcaaatgaaagtagcgggtgttctaaaagaacaaaagcaacaaatttgtcatgatttatggtggcgtaattggttaccaattattgtgatatgtttactcgcattgattattatcatgcttgtgatgcgatttctttaatctttagctaaagccagaactagtcacggttttggctttttttgacatgatggcgataaagatttttaaatattaaaaataaacaacagcacgcaggataatgtactaaaaaagcgggaatttaatatcgcatatacggtgcatattaaactgaaattaaataaatatgtataaggggattcaggtatgaatataatgcaaaaagcaactaaacatggcctgtctggcctgttgttagcagttaccgtgttggggtcggtagcaccgttagcagcgataagtacaccgatatacgctgataatagtcaacaaaacggaaactccgatgaagtgagtggcaagccagcattggctgatcaaactgtttttggtgttccacaaccggattataagtcatatgaagacttcaccaaagggtttaagagccaaggtcaagcgttgcctatggaaaaggataaaacagtaagtctgacacaaaataaacaactgcaatttggaagtttaacgttccgacgcgcaattgatatgtctcatgactttaccttcactggtagtctgaacattgatcagccaggaaatactttgggagattcacttggatttattttggcaccagttgagccagaccaaattgataacggatcaagtggtggatacctcggtatcggaaagcttgcccatcctgaaatgtatggtgataaaggatttgacaatgctttttattggggtgctgatttgcactataacgtcgaaccttgggatgtggatccaaattcaaacccggatacaagttttgatggaaaaactgaatttggagatccaaatgttatgaatagtggcagttacccaggcaaaaactttgtgatgtttcgtcgtactgatggaaaagggcaattggataacattcgtaatctaacccctgatgcccatccagaaattctttatccggtgcagttaaataagcacggatcaaacgaagttaccttgacgtggacaccagacaaagcagatgagaacaaagaaagcggtccaatctcaggtacgctaacagcgactggttggggacacacgtggacagaggaaatcacaactgctcacgaaatgtcactagctgtcaacgctgctaccggtggtgatacgtcaaatatggggctgactgccggtgagttcaagctgacagttggaactgcagatgttacgtttaatggagcggctgtatcagatgctgacaaaacagcatttaaacaacccgattttggaaagagtccaaaggaagcagttgttggtacgcacattaccgtagttgattctgccgagggtctagccgctgctaagagtgatccattgtttgagtctgcttatgtttatagggtgcctaaagtcgcgggatatggttatgttggaaatggtaaaggttaccaaatctttactgtcacgcgcactcccgaacaaacatttacgttgatatataaccgtaagtcaaccgagcacgtggattatcagtttgctaaccaaccaggtgtttacttcaacaagaaagacgactctggtgacgacgggcaaacgtacactgaggacacaccaactgttcctggattcacacctgataaagcgactgttacaggaatctatagtggtgaccacaaggatttggtgacgtattacccaacgccaagtttgccattgaatgcgggcgcaaacggtgtcgttgatccaacaaagccagtgacaccaaccaatggtacatctactaagcaaaatctaaacacgtcaaatggcttgtcgctagattatgtgcctgattttaatttcggaaaacacgaaattgagagtggcacaacgacttatgcggctgatgatttgaagacgaatcaaggtgatatgccgttgtttgcacaggtgactgatgtgcgtactgccccaggcaactggacgctagacgtgaaagctggtccaatgaccaataaggcgacgcagagcgttttgtcaggtgcgtacatgacgttcgggtcatctgacgtcaagacaacatcgaaggataacgatgtttctaaggtaaagacgaactttgctggtcaacaacttaattttgatgacaagaccgagatgaatgttgtgtcatcaaccagtcctgaacaagcaacgtggctaactcgttttatcaaaaaagatcaaacggatgctgtaacgttgcatgttccaggcggtgcagcccaaaagggagactatcaagctgtcttgacttggacgcttggttcaaagccaggcgacaaccaacaatagaatataagttagaacacgcaatgcttgtcactgcgtgttttttcattgaaaaatcaatttcctgaacagtttatgaaaacgagggttatcgttttaattcggccattgtgacgtgatacaaaagaagtatagagaaaagcattttgtattaaacggaggtatacatactatgtcacatgatttgctacgtcgtcacgacgcatttggggatttgttggataagatgaacgcgtcattgatgcaagcaccagcgtttggggctgatgtaaagtcagacgttgttgaaaaggacgatcactatgacgtggttgctgacattcctggcgttgataaggatgacatcaaggtcgattatgaagatggcacattgcaaatttcagcaacgcgtcacgaaatcaaggatcactctgacaaggatgggaacattctgcaatcagaacgcagctttggttcagtcggccgttcttactacctaccaaacgtagatcgtgagaacggtttctgccaagtacaagaacggggtgttgcacatcacgttgcctaaggctgaagtcgctaagaagtcagcgattaagattgaagattaaaaccatatcgaaaacgtcggttcgtttagcagaccggcgttttttgtgctaaaattagaatattatcatattaggaaacgaggacactgccatggatgcattgcaattatcacgacgattggcgactgtagcgtcatatgtgcgcgatggtgcgcgtttagcagatattggttctgaccacgcttatttgccagcaaacttgttgttgaacaagcacatttcattcgcgattgcgggtgaggtggcacaaggaccactggacaatgtccaaactgaaattaaccgtcaccgccttggggatgttttggtaccccgcttggcaaatggcttggctgctgtcacgcccgaagatttgattgatacggtcacgattgccggtatgggtggtcgcttgattgcacaaatcctggcggacggtcacacggacgggcaacgttaccaacgtttgattttgcaaccgaacatcgatatcgatgtcgtacgcacttggttgatggataatgattatcaacttgaagacgaaacggttgttgaagatgacggccatttctatgaggtcttgattgcagtccctggtcatgccgactactctgaaacagagttgaagttcggaccattcaacttggaaaagcgttctgaagcttggcaaaccaagtggcaacgtgaatatgaccgtgtaaagacaatcatggctaagttggaatcagctaacaagcaagattcagatgcataccgtgagtatcaacaacaagtgactgaaattagtgaggcgttggggctatgaaagcaactgagttaatcgccaagatcgaagcctatgcaccacgtgacctagcttgggaacgtgatccaatcgggcttcaacttggtgatccaaatcaagagattcatacagtaatgacggcattagatgtgcgtccagaggttgtggcagaagcgattgcgaataatgttgatttcatttttgcacaccacccaatgattttccgcccagcgaagaatttggatttgtcggtgccacaaaacaagatgtatgcggatttgattaagcatgacattgtcgtttatgcggcgcacacaaatttggatgcagcagcaggtggcatgaatgattggttggcagaagcacttcagctgactgatgtggcaccattaattccgaatgctgatggcaagacaggccttggtcgtatcgggtcactagcgacgccacaaacagtgacagattacgcaacattcgtgcgtgatttgtttaatgtggcgcacgtgcgcgtgattgcgaacgacatgaaccgttccatccaacgcattgcggtgcttggtggggatggcggtagtgaatacccagatgccttggcagctggtgctgacgcttatgtgacagctgatttttactaccacacggcgcatgacgtcttggccgatgattttgtggtgattgatccggatcaccacatggaggccattgccaaggataagctagttgaactggttaatgcttggcaaaccgaaaacaattgggacctagaccgtgtcttcgcctcaactgaaaacacggatccatatacgtatatttaatttaaggggaattactattatgtcagaagaactatatccaaacttggttgaccgttttatccgttacgtgaaggtcaacacgcgttcaaacgaagagtcaacaacggtgccatcagatcctaaggaagttgctttcttagctgatttggctgaagaattgaagggtcttggcctagaaaacgtgcgtacgatggctgacggttatgtctttgccgaattggcttcaaacattgacgctgatgtgcccgcagttggtttcatttcacacgttgatacggctgactttaacgctgaaggtgttaacccacaattcgttgaaaactacgatggtgagtctgacatcaagttgaacgacgactacacgttgtcaccagctgatttcccttcattgaagaagtacaagggacacacgttgattacgactgacggaacgactttgcttggtgccgacgacaagtctggtgttgctgaaattatttcagctgctgaatacttgattgcccaccctgaagtaaagcacggtaaggttgtctttggattcggacctgacgaagaaatcggtattggtgctgataacttccacgttaaggaattcggtgctgacttcgcttacacagtcgatggtggcccattgggtgagttggagtgggagacgttctcagctgcagctgctaacatcaagattcaaggacgtaatgtgcaccctggttcagccaaggacacgatggttaacgccttgcaagttgcaatggacttgcacgctgctttgccagccggtgatcgtccagagttgacggaaggtcgtcaaggattcttccacatcttgaagttgaacggtacacctgaagaagctgagatgtcatacattatccgtgaccacgaccgcatcattttcgaagagcgtaagcaagccttgcgcgacatcgttgaaaagatgaacggtgaattgggcgttgagcgtatcaagttggatatgtacgaccaatactacaacatgggtgaagtcttgaaggacgacatgacgtcagttgacttggctgaggctgccatgaaggctttggacatcgagccagttatcgaaccagttcgtggtggtactgacggttcaaagattacgttcttgggattgccaacgccaaacttgtttgctggtggtgagaacatgcacggtcgtttcgagtacgtttcaacgaaggtgatgcaccaagcggttgatacgatcttgaagattgttgaattgaacgcagcaaagtaattttaaataatttcaaaaggctaactagttaatctagttagcctttttgttacaaaaagtatggtaatggtaacgcttacatgttacactaatcctattaactggatttatttccagcgtattagggagcatgaattatggctaagacattagcaattaacgccggatcttcatcattgaagttccaactattggaaatgccggctgaaacagtgattgccaagggacaaatcgagcgtattggtttgtctgaaagtgtattcacgatgaagtttaacggggaaaagactgaaatcgtccgtgacatcgctgaccacaaggaagcaattgaagaaatgcttgagcaattccgtgcacaaaacgtggctgacaagagtgaaattacaggtgttgggcaccgtgttgtggctggtggtgaatggttcaacaagtcagttatcgtggatgaagaagtgttgcacaagattcaccgtttggcggactacgcaccattgcacaatccagccaatgcaacgggaattgaagtattccaagagttgttgccagatgctatttcagtagcagtcttcgacacggcgttccatcaaacgttgccacgagagaactacttgtacccattgccatacgagtactacacgaagtacggtgcgcgtaagtatggtgcccacggaacgtcacaccgctacgttgctgaacgtacggcggatattttgggtaagccacttgaagagttgaagattatcacgcttcacttgggtgccggtgcctcaatcacggccatcaaggatggtaagtcatttgatacatcaatgggcttcacgccgttggctggtttgatgatggcaacgcgtgctggtgatgttgatccatcattgatttactacatccaagaacgcgaaggcctgtcaaacggcgaaatgttgaagattttgaacaacaagtctggtttgcttggagtttcaacgttgtcatctgacatgcgtgacttggaagaagtggctgataccaacgagcacgctaagttggcattggatatgttcttgaaccgtgtcatccgttacttgggtcaatacacattcgaaatgggtggcgttgatgccatcgtattcacagctggtatcggtgagaacgctgcaaacgttcgtgaagatatcatcgatcgtttggacttcttgggtattaagttggacaaggaagcgaacaatgttcgtggtgttgaacgtgtcatttcaactgatgattcaacagctaaggtattgttggtaccaacgaatgaagagcttgaaattgcccgcgatgttgaacgtttaaaggcacaagcaggtaagtaatcgttaaggttcgcctgttagactattgtcattgaaaccgaaaagggggagtctaagatgtttacattgattatcatcgcagtcattggcctctggttctacggcaagcaccgcatcaagcgtgcggtggcccacgttgagcaacaaatgccattttctgatcaaagcatgaacggttcccgccgtgatgcctttgaaggacaattcgaagaaattaaaactacgaaaattaagtaagcaaatacgccataacgtactcgttatggcgtattatttttgctataatggttagaaagttctgatgtagatgaaaaatagattaatctgcgcgtatgggacgttttaagcggtcgtcagagaacggccaaaacgatataaggggacacttcatgaagaaattgttgattgctaaccgtggggaaattgccgttcgtttaattcgagctggtaaagaattagggattaagacggtagctatttttgccaaggaagatgagtttgccgttcaccgtttcaaggcggatgaatcttatctagttggtgaaggtaaggcaccgattgccgcttatttggatattgacgatattattcgaattgctaaggaaactggcgctgatgccattcacccagggtatgggttcttgtctgaaaacgacgaattcgcggcggctgttgaagcggctggcattaagtttgtcgggccacgcgttgaacacttgaagatgtttggtgacaagattacggctaagcaagccgcaattaaggctggcgtgccaacggtaccaggaactgatcacccagttgaatcaattgaagaggcgttggcttttggtgctgagcacggctatcccttgtttgttaagtcagcagccggtggtggtggtcgcggtatgcgtgttgttgaacacgatgatgaactacgtgaagcctttgaacgtgctgcttctgaagcccaacaaagctttggtaaggctgaaatttatctagaaaagtatctacaagatcctaagcacgttgaaattcaaattttggcggatgaacaaggcgaagtgatgcacttgtttgagcgtgactcatcaattcaacgacgtcaccaaaagattatcgagtttgcaccagcggtttctgtatccgttgatatgcgtcgtcgtatccaagatgctgcggtcaagttgatgcaaagtgtcgattatcaaagtgctggaaccgttgagtttttggttgatggggacgatttctacttcatcgaagttaacccacgtgtgcaagtagagcacacggtaaccgaagagattactggcgtggacattgtgaagtcacaattgttgattgctcaaggttacggcttgcatgaagcgccattaaacattccagcccaagataagctgttggcagtcggcgtggcaattcaatcacgtattacgacggaagacccagccaataacttcatgcctgataccggtaagattgattggtaccgttcaccaggtggaactggcattcgtctagatgctggtaatgtgtacgctggtgccactgtgacaccattctttgactcattgttggttaaggttgtggcacacggaactgacttcactgaagcagttgataagatgcaacgcgccttgaacgagtttgccattcgtggagttaagacgaacattccattcttgaagaatgtttacgcacacccaacgttccgtgcagctgatgcgccaacaacgtttgtggacaagcacccagagttgtttgaaattgcgccagaaaaggaaccggaccgtaagttgttgcgctatgttagtgagacaacggttaacggtttcccaggaattgatcacgattaccagaagctctatgagccattgcattatcaagcaaacgctgatttggtgttgccgtctgatttggtaacggccaaggacatcttggacgcccaaggaccagatgcggtggcacaatgggtgaagaaccaagataaggttttgttgacggacacgacgatgcgtgacgcgcaccaatcattgttcgccacacgcatgcgtacgaaggatatgttggcaattgcggatgaaacgcaattggcgatgccgaacctcttctcaaacgagatgtggggtggtgccacatttgatacggcctaccgtttcttgggtgaagatccatgggagcgtctccgtgcattgcgtgagaagatgccacgtacattgatgcagatgctgttccgtggttcaaacgccgttggttatcaaaattacccagataacgtgcttgaagagtttattcgcttagcagcgacgaacgggatggatgtgttccgtatcttcgatagtttgaattggttgccacaaatggaaaagtcaatccaatatgtgcgcgataacaacaagattgccgaagttgcgatggcttacacgggtgatattttggacccaacgcgtaagaagtacacgcgtgattattacgtaaacttcgctaaggagttgcagagtgccggtgcgcacatgattgcgattaaggacatggcgggcttgttgaagcctgaagctgcttatgagttggttagcgcgctgaaggatgcggttgatgtgccaattcatcttcacacgcacgatacaactggtaatggtgtttacacatatgcacgtgcggttgatgcaggggtggatgttattgacgtcgcgatgtcagctttgtcaggtacaacatcacaaccatcgatgggtgcaacgtactatgccttgagtggcaacacacgtcaaccagaattgaacatgccagctgttgagcacattaacagctactgggcccaagttcgaccatactacggtcagtttatgagcaagatggttggtgcccaaacggacatcttcgaagtcgaaatgccgggtggtcaatactctaacttgcaacaacaagcgcaagcattgcgtttgggtgaccgttgggatgacgtgaagacgatgtacgctactgttaaccaaatgtttggtgacatcatcaaggtgacgccgtcatcaaaggttgttggggacatggcactgttcatggttcaaaatgatttgacgccagaaaaggtgttggcggaaggtcaaacattggacttcccacaatcagttgttgatttctttgcaggtgatcttggccaaccggttggtggtttcccagaagatttgcaacaagtcgtgttgaagggtcgcaagccattgacggtgcgtcctggttcattgacaccagcggccgactttgaggcgatgacggctgaaatcgaagcgattttgaagcgtaaggcaaccccagaagagattatttcgtacatcttgtacccacaagtgtttaaggattatgtggccaaccaagaaaagtttggtccaatgacgttcttggatacaccaacattcttccaagggatgcgtgttggtgagcgtgtggatatcgaaatgggacctggaaaggttgttatcttccaactccaagaaattggtgaagttgatccagagggtatgcgtacgttgtactttgatgtgaacggtacgccaattgagattgatgtgctagacgaatctgtccaagttacaacagttgcccgtcgtaaggcagagccaacgaatccaaatgagattggcgcaacaatggctggtaatgtgttgtcagttcacgttgaaaatggtcaagcggtgaagcaaggtgacgtcatgattgtgacggaagccatgaagatggagacgactgtgcaagcgccattcgatggaacggttaagtttgtccacgttgctgctggtgaagcagtggcgggtggtgacttgttgatcgaagttgaaccaggctaaggagagttcacataaaaatcatattctttggctagaatgtacctaaagtaagcgatgtaacatactttggggaacagagggaaggacatgttttttaagagacgcgaacgcctatttcggaactggtggaacagtggtttgcagcctgatgatgttgaaaacgagcttaaaacaacgtaccacatccatgaaaaattgctgattgtagcgaatatcgtgctgttttttctaacagccggactattctacggggaattgtggccctacagtggcatctcattagttgcgctagtggttgcgattgtattactcgctatcaggctactgatgcgagcggtcttgtttaacgatatcgtgcgttaccgtgattggtatcatgtgcaaacacagattgaaaagttaatgaaataacataaaacgcagtcaactactagttgttgactgcgtttttgcgtaaaatagaattactgaaaaatgatgaggtgaagacatgcgacaatggtggcaaagtaaattaattttaggcgttggcatggtaggcatgttgctatacgtcttgcaaagtgtgatcgcgacgattatttggccagcgtatcggatggtcgcctatccattggctattctcacagcgcctgattcacaatatgcgacagcatttaagggattgcaactgattgctggcttgttgattgcggtgagtttagcagcgctatggcgttattcacgctataaggactacacggacttggtaaaaacggttcaacagttgattctggtttggttggctggcgtcttgctaaactttatttggccattgaacagtatcgtggaggcagtgctgcgaccagctgtatcagcccgtaatatcgtgtttggactgttgatcatcctgctgggctggacaatctggcgcgtggggagtgctgcgcaaatacacgacatgacgacgttggccaatggcttaaagctctttgcaattttgtacgtcctatttaattttttggaatttgcagtgacgttaattggctggcaactgtcaggattctttgatgtgttggcgattgacgtcttggcggttgccatgggatacatcagttggtacttcatgcgtttagctgaataacccttttttctaccatccgtttaacacagtgctacactataagtgttgaaagagatatgaaatgaataaattcagactaactctgaaggaggatggaaagatgtatttgacaattactgacgctgcaatggaaaagattaacccaattttgaaggctgagccaggtcgtcgtttgattatgatgtatgaagacggggtttcaccttactcacaccacggtgaagttgccatgcaagtttcattcgtgttcgctgttattcgcggtgatcaacctttggagccatggtttgacgagacaatcgattcaaacatcggcccattgccaatcaagggttactcaaaggactacatggtgccaaacatggttttggacgttaagaagttcggtggggttgtgttgcgtggtgacgctggtgttatcgatgatacgccagaaattcgtgacgaaactaaggcaactgattaataaagaattttaattaagcatctcgcttttgcggggtgcttttttgtaccctgtgttgaaagtttgatttgggttcgtggcttacaatgtgtaaacttgaagtactaggacacattgaaagacggggatgttcatttggcaaaaaagaaaattgtgattgcagggggcactggctttgttggtcaaggtattatcagtgcattatcaccagaaaaatatgacattcatgtgctgacgcgccgacacgtaacaaccgataccgagtcagtaacgtaccaccaagttgattatcacgtaactgatcaggtgttagcggtgattggggatgcggattgggtgattgatgtgattggcattctgttgccgaatccgattaagcatcaaacgtatgccaatagcagcgttttaccggcggaatttttaattgacgctgtacgcgcctgcccagaggttaagttcatgttcgtgtcggccaattacgcacctttcttcatggcaccatacatgcgtgcgaagcaagaagtggagaattacatggctttgcgtttgccacagcgagcaacgacgctgtatccaggtattatttatgataggaaacgccagatgagttattacgttggtcgtatcttgtccaagcttcccgctaagcgacttagaccaattacgttggctgacttggcgaaggaagtgacgcgcattctagatgggcaaaatagtggtttggaaaagcgacgctaattatttcgaacttataaatctatagtctggtataaggttggcctgtttcaatataatatatacaaagattttgaaacggagtgtagcaatgattaatcaacgagcttcaacgataaacgtcaaccaaatgcgcgacatgctaagtacgtcgggcctaaatatcggggtagaagtcgaagaactcacgaaatttgcccgcatgtatcaaacgtacgagtctgcgcaacatgagattgcgacgaaattagaaaatcttgatgctgagtttcaaatgaactataaccataacccaatccatcatttggagggacgcatgaaggatccgcaaagtttgtttggcaagttgcaacggaaaaacttgccaatgactgtggatattattccagataacatctttgatatcgcgggcattcgcgtcatcacgaattatattgatgacatttacacggttgaacgtttgttagtcgcccaagatgatgtcactttgttaaagcgcaaggattatgtcgaaaatcctaagccaagtggctatcgcagcttgcacttagtggttgaaattcccgtcttcaggtcgacgggtgttgaacgtgtaccggttgagattcaaatcagaacaatcggtatggacatgtgggccagcttggaacacaagttgcgctacaaaactgacgcagaacgtgctgaagagtttgctgataacttgattggttatgcgaatgagctgaatcaaattgagcaaaatttccagaatattcatcgcgaattataatgaactgccacgttaaattaaaattacattagaaaatatgttgacattttttaatgtagcaaatatacttactttatcgacaacgacgagatgaagtaagtcctgaaaaaatcacagagagccaacggttggtgtgagttggtatttggcaaggggtgaaaatggtctttgagtcagagttaatgtgagcagatttgcaagcattaaccgggtgcgcccgttatcgcgcaaacgtatatccggcgaccgttgactagtccggtcagaaggcgtacgtatgaagccctttttggtgataaaaagggaaaactgggtggtaacacgattatgtcgtcccaggatgtccatttggatgtcctgggactttttttgtggaaaatccaaccgacagcatcgaattaacgcgggattcgatgtgagttaatgaataaatgagggaaacatggatgagtagtaatcgagagaaaaatttacaggtattatcggatttagttgcgataccgagcgtttcggctcgtcgagagggattagatgttgcagcaaaatatttaagagatgtctttcgtgacgccggtgcagaagttacgtatgatgacagttttccagcgccgtttgtcctcgctaagtttttaagcaatcgaccagatgcgaatacgttggtgctctataaccactacgatgtacaaccggaagatccaattgcgctatgggaaactgatccgtttacgttaaccgaaaaggatgggcgactatatggacgtggtgtagcggacgataaggggcatatcacggcacgattggaagcagttgaagattaccttgcactgcatgaaacattgccagtaaatgtgtactttgtagttgaaggtgctgaagagtccggatctgaacattttaaggattacctagaaaagtatgcttatgaatttgaaaatgtcgatttagttatttgggaatctggtaccgtccatggtgatgatcgtttggaggtgttcgggggtaataaggggattattacgttcacgctttcagcacagacggcggcagaagatattcattcatcgtttgcagcagtcgttgattcagcggcttggcgtttgattgatgccatcgcgtcactaagaggacaagatggtgaaattttaattgatgggctttatgagacagctcgcgagccgaatgaacgcgggcaagctttagtacggggtggtgaagtcacaccagcaagcttgaaacgtgactttgggttgagacggccgttattgactgagacgacgggtgaggatttctatgacaatttgttctttaagtccaacctgaatattgagggaatccaaagtgggtatcagggtccgggcgttaaaacagtcacaccagcaagcgcgacggctaagttggaaattagattagtaccaggccaagaaccacaagatgtgtttgacaaactagtgggtcagctaaaacgaaatggattcggcgatgttgaagcgacgttaacattagcgacgccaggataccgttcagacatgtcagcaccacgaattctgtcgttggtcacattggctgaacagctgtaccacaccgtcgaagtgtcaccaacatcggctggtaccggcccaatgtactgggcgaacaaatacattggcgcaccgattgcagcagttgggttagcttatgatggcagtcaaatccatgcgccaaatgaaaacattcggttaagtgattacgagcatcatgtggcattggtagccgcacttattgcggattattcggaaaaagattaaggggaaaacagatggttaataagaagatttggcttggggctgctgtaacagtggtaacgacgattgcggtaggtacgacagtaattaatcacgtgaaggctgatactgatgataaaaccgttacagttggtattgttggtgattcatcacgtgagctttgggaaaatgtgtctaagcgtaccgagaaaaagtatggcgtgaagatcaaaatcaaggttttcagtgactatgtaaagcccaaccaagcccttgtggacggaagtttggatttgaatgcctttcaaacgaaggtgttctttgatgatcaaaacaagaagctgggtaataagttggtctcgattggtaaaacggtgatttcaccgattcgtttgtattcattgaagcatgacaagcttgctgatttgaaggatggggcacaagtggtaattccaaatgacgcgacgaatgaacaacgcgcgcttaatttgttagtacaagccaagttgattaagtataatgagagtgttgatacgccaactgtaaaggacattacagataatcctaagaagttggacattgttgaaatcgcgtccgaccaaactgtgtcagcattgaagtcagcagacgcagcggtgattaacggtaactacgcacaagatgctgggttaaagacaaaaaatgtgttgttaacgcaagatgtatctaatccaaagacggcatcgccatacatcaacatcattgcggcgcgtaaggataaggccaagacgaaagcctatcgtgaaattgttaaggtttatcagaccaagacaactgaaaaagaaattaataagttgtacaacgggtttgaaagtgcggcttggaatttgaagtaattgcattgaaaaaatgcgtattttccttgataaatcaagcttaaaacgcgtcaagtaaaattacttgtcacttttttagggaaaacacttgaattttctcaataaactgtgtaatataattatttgtaatttactagctatattgtaacggcgcaagcttggggattagcccaatgcagctaatcctgtcgttcaaattagtggtgaggggcacctcacaaattaaattcaaggagttatgttaatgcgcattaacattttgttggaagccgccgaaactggtgagcgtatctacttgacttctaagaaccgtcgtaacacgccagaccgtttggagttgaagaagtactctccaaagttgcgtcgtgtcactgtgttcaaggaggttaagtaatcatggctaagaagtcaaagatcgctaaggctaagaagattgaagcaactgtagagaagtacgctgcaaagcgcgctgccttgaaggctgctggtgactacgtagggttgtcaaagttgcctcgcaacgcttcacctgtacgtatgcacaaccgtgataagattgatggacgtcctcacgcttacatgcgcgagttcggaatgtcacgtttgaacttccgtcaattggcacacaagggcttgatccctggtgttaagaaggcttcttggtaatctgcattttaccttaagtcttaaagagagcatctactttcgagtaggtgctctttttttgtcccatcgatttggaaaagcgttaatataattgtgttggaaggcgcttacaattatttccaggaaaataaacctttttatttgtcttaagtgtttgaaagcgtcatactaaacgtaagtaattatttaattaatcatcttcatcggcctagttgtttggctagggtggcggagaataattgtttttctaaacaggaggcttatctcatgtcagataagaagattacagccggtttggctgcattgaaggttatggaaggttggggtatcgacacaatgtacggtattccttctggaactttgagtggattgatgaacgcgatgagtaatcctgagaacaacatcaagttcattcaagttaagcacgaagaagttggaagtatggcggctgccatgcaatacaagttcagtggtaagatggccgttgctgtcggatctggtggacctggtgctactcacttgatcaacggtttgtacgatgctgctatggatgcaacgccagttttggcaattttgggttcaaagccatcacgtgaattgggaatggattcattccaagagttgaaccaaaacccaatgtacaacaacatcgctgtttacaacaagcgcgttgctgttcctgagcaattgccatacatgattgacgatgccatccgcaacgccatttcaaagaagggtgttgctgttcttgaagtgccagccgatttcggatttgctgaaattgacgctgagatgaactacgctaacccaatttactcttctggtgatgtttacaaggaatacgacccagttgcacctaaggctgctgatgttgatgccgctgttgaaattttgaagaatgctaagcgtccagtaatctacgctggtttcggaacaattggtcacggtgagcttgtacaagaattgtctcgtaagttgaaggcacctgttttggtaactgctaagagctacgaagcattcgattacgactttgagggattgatgggttctgctggacgtgttgcttggaagtcaggtaacgatgttatcttcgaagcagatactgttttgttcattggtaacaactacccattctcacaagttgagaacttcatggctggtgttaagaactttatccaaatcgacagcaacccagctcgtctaggacgtcgtcacaaggctgacgttgcgatgttggctgatgccggtttggcagttgaagcattgttggagaaggttgagccagttgctgagtcagcatggtggaacgctgctttgaaggatgctcaaaactggcgcgactacatgcacaagattgagacgaagacggaaggcccattggaggcttaccaagtctacaacgccatcaacaagtacgctgatgaagatgcaatcttctcaattgatgttggtgacacgacgcaaatgtcaattcgtcacttgcacatgacaccaaagaacatgtggcgtacgtcaccattgttcgcaacgatgggtattgccatccctggtggaattggtgccaagaacgtcttcccagatcgtcaagtatttaacatcgccggtgacggtgcctttgcgatgactgattcagatattgtgacggcggttcgttacaacatgcctgttattaacgttgttatgacgaacacgcaatacggcttcatcaaggataagtatgaggatacgaacacttaccgtaacgatgaaatcgttgactttggtgacgttgactacgccaagattgccgaagcacaaggtgccgttggtttgacggttaacagcattgcagacatcgataaggtgatgcaagaagccgttgactactacaagcaaggccgtgttgttgtggttgatgctaagattacgaaggagcgtccaattcctgttgaaggattgaagcttgatccagccctagcatctgaagaagaaattaaggctttcaaggagcgttatgacgcacaagaacttgtgccattccgtaagttccttgaagaagaaggacttaagtcacaagttgttaaggttaacgacgaagacacgaagtacaacttctaatttaagatagtatcgaagcagctacaattatgtggctgcttcttttttgcgttatggggcaaattgccaaaatagctaagtcaactcgatttcgatttgttatagtaagtatgggggttattatgcgtactttttataacattgcagatttgagtttgccggtaatggccgaacaccttggggctgagtggaatcagggggttatcattcgtcaccaaggcttcccacattttcattggttacaaacgcaatcaggaatgggggctttttgggtacgagataaacgctatgaattatcgcccgggatggggattttgattgcaccgggtgtgccacatcggtatgaacctttgggtaaacggccatggcaagtacgttttgcgacattccaggggcaactagtggatgacttactgaagcaaatggtgaatagcgagtttgttttagttgaagcaacagaagccaaattatatgccgcattgcacgagcagttaatgcaacaattagcaactgatccggtagatgatttggctgtatcaacgacggcttatcgacttttgttgggcttaacgcgtcaacaaaaacaaaccatcgatcaacaccaaccagactatcaacattatgtcggaccagctatcacatatatgcagaatcattttgctgaaaatatgtcgattgccgaggtagcggaagccttatcggtttcaacgcagtatttgaatcgtgtattcaaacgtctcgtccaacaaacaccgaatgagtatttgacgcaaatcagaattagtaatgcgaaaaaattgctgatttctcagcgtcatttacgtgtcgaagcggtcgctaatctaagtggttatcaagaccccacgtatttcggcaaagtttttaaaaagcaaaccggtgttagtccgttaaattatcgccaatggcaaacatgaaatagtgaaccagcagttttctgctggtttttttgtgcgacaattcacacggtttcaataaatcatgatatttggttataaaagtgcctttttagcaaatgaaagcgctttattataagtgagtaggttaattatgaaaccaaatatcgggggatataagcatgaaaaatgtgaagcagtatttgtcttatgcggcaggtgcgtttggacacgatgcgttctatgcaacgcttagtacgtattttatgatttttgtgacgggtcaattatttgatacgccagataaagcgtttaataatcaaatgattggttgggtgacaacgatgattgtcgccattcgtttgattgaaattgtgtttgatccaattattgggggaattgttgataacacacggacacgatggggaaagtttaagccatggctgattatcgcaggatttattagttcattcttgctggtggttatttttactgactttgggggcttagcaacatcacacccattcctttacttggtattgtttgggattgtgtttgttacgttggatgcgttttactcatttaaggacattgctttctggtcaatgttgccagctttgtcattgaatagtagtacgcgtgagaagtttggaacggtagcccgctttgggtcaacgctaggtcaacaaggtgtacaaatcgtggttgtgccattggttatgttcttctcaatggcctttgccggggcacatactgaaacaaagactggttggttctggtttgctgttgtgattgcggtcatcgcttaccttggtgctttgctgactgcagccggcactaaagaagaggacaatgtcgtccgtcaaaatacggagaaagttggtgtactcgaagtctttaaggttgttgcaaagaacgatcaattgatgtggcaagccgtttcttacattatgttcgcgcttgcgtatgttgtcacaaactcactattgttgtactatttcaagtacgttatgggtgcagacaatgagttttacttggttggtattttcacagcaattgaagggatgatttcagttgccatcttcccaacgttaacgaagtttttggctcgtcgcactattttctttagtggagcggttgtgatgttagctggttacttgttgtttatggtcgcaggtaacaatttggcgttggttttgacggctgtcacgatgttctttatgccatatccaatcatgttcttggttgtgttgatgaccattaccgactcagtggaatatggtcaatggaagcttggcactcgtcacgaatcagtgacattggcaattcgaccattgttggataagttggcaggtgcgttcgctaacggtgttgtcggatttgctgcggttgtagccgggatgactggtagcgctaagccatcagatatcaccgcacatggcctaagtatgtttaagatgtttatgttctatggtccaatggtcttgatcatcgtatcagttttgatttactggcgtaaggtgacgttgactgaagcacgtcacgctgagattgtggcggaattggaagcacgtttgaaggagaattaaaatggtttatgaattaaatcatgagttagcacaatcattcgagaagcgttttggctatgagccggcgaagttgtacttttcaccaggtcgtgtgaatttgattggtgaacacaccgattataatggtggtcatgtttttccagctgcgattagtgttgggacgtatggcgcgattgcaccacgtgatgatcaagagattcgcacctattcagcgaacttcccagaggctgggattcaattgattgcattggatgatatcgcattgcgtcaatatgatacatggattaagtacttgcgcggtgtgattactgaaatggccaagtttggctaccctgtgacaaaagggtttgacttggcaattgttggtgacatgccaacagcatcagggctgtcatcatcagcttcattggaaatgttgctcattaatatgctagctgatttgatgggatatgagattgataagttgacaattgtgaagatggggcaagcagttgaaaatgattatcttggactaaaaacaggtattatggatcaattcgctgtcgcctttggtgaagacgaacaggccatcttcttggacacgaacacgcttgaatatgagatggtgccagccgagtttggtgagtatcgtttgttggtcatgacgactaataagaaacgtgaattgattgattcaaagtacaacgaacgtcgtgcggagacggaagcagcattggctttgctccaagaaagtgttgatatccaaacgttgggtgatttgacgacggaccaattcttggcagcgtcagcgtcattaacggctgataatgaggtcattatgcgtcgcgcgcgtcatgcggtgactgagaaccaacgtacggtagaagcaaaggcagctttgcaggaccacgatttggaaacgtttgggcaattgttaacagcgtcgcacaattcgttgcgtgatgattatgaggtaaccggtgttgagttagatacattggtcgacgcagcgttggcacaaactggcgtgctaggtgctcgtatgactggtgctggatttggtggttcagccatcgcgttagttgaagaagcccgtgtacctgaaatcacggcagcagttggtgaagtttacaccaacaaaattggctaccagccatcatttttcgtcgccgaaattgttgctggtacgcatgaaattaagtagaggaagtcgttatgttagattcacatagtagtcaattggtcttagatttcgtggcatggggtgttaagctacaggcctattcagaaatggaaacagtctatcgcactaacttagtcttggctgaactcggtctagatgggattgttgatggacagacagggaatactgagcgctcgctaagtgaattgacgacattgttgctggatatttctgataagacacccgatgagcgttggcaactagatgtgatgcgagcacgtttgctgaacattgtgacgccaacacctgatcgactacaaagcaattttgaaaagttgtatgcccagagccctgaaaaagcagttgcttattactatgacttaagccgggccgttgaaaacgttaaagtagctgatattcaaaagaatattgcctacgaagcgacatctgattttggtgatttggaaattacgattaatttgtcgaagccggagaagacgccggcagaaatcaaggcggctgcggctgcaccaaaagcggcgtatccgccaactgccttggattatacgaatgaagggtacgccggctcgattacacaagcaccgcgtgcaacacatcgctttattcgtgaatcattgcaagggcaaacatggggctggcattattcgccatatgcatactttggggagcatgcgatttttgttgactttgaacgcgagacgatgatgatcaatcaagcgacgtttgaaaacttgctgacgattgttgaacgctatccaatgtactttgtgggctcgaatgcggatttgccaatcgttggtggatcaattttgtcacaagaacattttcaaggtggacgccatgtttttccgttgatgaaggcgccgacagaatgcgaaattccaatgccggcctttcctgatattcgagctgatattgtccgttggccgatgacaatcattcgtttaacggcaaccgataaagagaagctagtagcagccagcgaatttattcgtgaagcttggcaaggatactcggatgaccgtttggatattcatgcgacgagtgaacgtggtgaacaacaacatacggtgacaccgattgcaatgaagcgtccgggattatacgtcatgtatttggttttgcgtgataatgggacgtcagctgaatacccagaaggcattttccatccccacccagacgtgcaacatatcaagcgcgaaaatatcggcttgattgaagtgatggggttggctatcttgccagcgcgtttgaaggatgaactcggtgatgttgaagcattcttgcttggtgaggtaggcatcgaacaggtcgctgaagggcaccgaccatgggctgaaatgttggcccgtgaacatacggtgacgcctgacaatgtccatgaaattgtgcaacaagccgttggacaggtgtttgctgaagtgctgactcatgcaggggtctataagtatgacgccagtggtcgtgagggactgaagcgctttatcgcacatctaacagcagcaggtaaataacagtcaaatggcacttccaacagtgttggaggtgccatttttcaaaaatgatttgtaagcgcatacaaaagaggagggaaacatggaagcgaaacttgaatggttagatgatccacgtgtattccgtgttggcaaactgccagcgcacagtgatcacgaaatctatcgagataaggcagattacaaggcgggaaaccaagctgatacgttgtcactggatggtgagtgggattttcattacggagcatcaccgcgcgaacgaacggcacagttttatgatccacaggcggtagcgacgcgggcggaatttaataaaatttcggttcctggccacatccaattacaaggatatggtcaaatccaatacattaacacactgtatccatgggatgggcaacaataccgtcgtccaccatttatggatggggatacacagggtttgccgggcattttcagtgacgcaccggataatccggttggcgaatacgttaaggtctttgatttaccaacgcattttgaaaataagcggatgcatatcacatttgacggtgtggaacaggcgatgtatctgtgggtgaacggtaacttcgtgggctattctgaagatagttttagccgagctgagtttgacataactcagcagttacatgcaggacaaaatatgattgcagtagctgtctataagctaagtacggcagcgtttattgaagatcaagatatgttccgcttctcgggtatcttcagaagtgtgcgattgcgggcattacctgaaattgacgtgacggacgtcgctattaagccaactgtgcatggtcgcaacggcatgattgatgtcacgttgcagttatcagcaacaacaccagtgacgggtaacgttcagattgcaattttagaccataatcagcaatcgctattagaaacgaagattagtgctgccgagcaagtgcgtctggcagacttgcttgtgccagacattgcactgtggtctcaccaacagccaaatctttatcgtttgcaagtgacagtgaccaatggaagcggtgacgaggttgcttttgtggattatccatttggcttccgaacgattgcaatcggcgctgataatcagttgcagttgaatggacaccgcttgtatctgaatggggtgaaccgtcacgaatggtcgcctgaaacggggcgtgcgcttaacgaagccgatatgcgccaggatatgcgtgttattcaagaaaatcatatcaatgcggtgcgaacatcccattatccaaaccaagtgccttggtatttcatggccgatgaagccggtatttatttgatggcggaaacgaatttggaatcacacggtacctggcagaagatgggacaagttgaaccatccgttaacgtccctggttcacatgcggcttggcatgatgtcgtaatggaccgggcacagagcaactatgagcaatttaagaatcacgtgtcgattctgttttggtcgctgggtaatgaatcgtatgctggcgataacatcgcggatatgaatgcgtactttaagcatgtagatccaacgcgactaacgcactatgaaggggtcttccataaccgtgagtatgacgaccagatttcagatgtggaaagtcggatgtatgcctcgccggctgatattcggacctatctgattgaacaacctaagaagccttatctaaactgtgagttcatgcacagcatgggtaattcagtgggcggctttgacgaatacatggccttgtacgatgagttccctgcatatggtggtggtttcatttgggatttcaaagatcaggcgttgtggcaagacgatccaattacggggcaacgatttttagcctatggtggtgactttaacgagcgccattctgattatgaattctcaggtaacggtattgtctttgccgaccgtcagttgaagccagcaatgcaagaggtgaaatatttctatgagcgatatgaaaacaaataaattgaaggttgtgtatggtgatggcgtccttgggattcatgcagccgatacgcattacctattcagttatgaaaaaggtggcttggaatcgttgcgtgtgaacgacgttgagtggttgtaccgtgtaccaaagccggctttctggcgtgcaaccacggacaatgaccgtgggaatggcttttcaactaagagcgcacaatggtttggcgccgaccagttcagtgcggccgttgatttcaacgttatggtcgacggggttgaaattgccaagcctgtggcgcctgaaaacaatcgttatgataatcagcaaacagccgaccgagtgaagattacgtttacttatcagacatcgacgtcgccacaaacaacagtgttggtgagttatgaggtagttaacggtggtgagttaacgattaccgcaacttatttaggtcagtcggacttgccagaattgccagctttcgggttgcgactcgtaatgcccgagccagttactggtttcacgtatcaggggttgtcgggtgaaacgtatcctgatcgttggcaaggtggtgaccctggtattcatcaagttgaaggtcaaccagttacgccatatttggtgccacaagaaatggggatgcatattaagacggactgggtgacattaacccacaatactggttctcatttacgtgtggataagacagataatcaatttgccttttcagcattaccatacacggcggttgaattagaatcagcaacccatcaaaatgaactgccaccggctcgtcgaacggtgttgacggtttacggcgcagttcgcggtgttggtggtatcgatagttggggcagcgatgtgcaaccagcatatcgattgccaagtgaccaggattattcggtgagtgtgacaatatcggttaactaaacaaaaggcgtgccaatcggtacgcttttttcttatgccttgttgtcgaatgtcgttaatttcgatatatttttcaagtgcaaccgtcagttgcttggcgatataccggcattcttgtaaagttaaggggtaggaatgaggaggatacgaaatgaagattggtgaaaatattcaactgcatcgtgagcaacatgagatgtcacaacaagagttagcggacaaattgggagtaacccggcaatcaatttcaaagtgggaaaatgacacagcgctgccaagtttcaagagtgtgttgatgattggggatgtttttaatctttcgctggatgagttggtgcgtggggatgatcggttgattgaggagtatcaaaaggataagggattcaaactttcaccgacagaaaaagttgtcttttcaattattggcattagcatacttgcttttgtatcagttagtatgtggccgagtctttttcaagacgtttgggcacaaggattatttgagtttgcacaacttgttgcgtttgtggcattgatgatgaatattccttggcgagacgtaaacaaactgcttcgtaatcgtaagttgttttggttgttaatggtatggctactgctagttgcgacaccgtacatcgtttcagcaacgcaagatactattgcaggatttaaacaaggtgttcaggaatcgcagcgttactaaattgcgtgactgccatgcaaaatgttaccattaacgtacaatctgaaagtgagaataatcatgaataatgacgttgaagtgatgttgtacgtaagtgatgtgatccgtgaagctgatttttgggtgtcattggggtttgttgagcgtgatcgtcaagatatgggcgagactgaaatggtgcaagtagcaccttcagaagacggcgcatttgccttgaatatctttgaccgtgagttcatcaaggagaactcacccgaagtcgttgataacgtgccatcaatcatgttccactcagacgacgtggaagcgttgtacaacaagatgactgaattgaatgtcgaaaagggtgaattagtcgaaatgggtctccaaaaggtctttaactttgcgaacccagatggcctatacttcggtgtgtcaggaatctaaagacaaaaaataaaggacttggtatttcaccaagtcctttattttataggttcgcgtgttgtgcgtcagtcatttcagtggcaatcttggccatttcatcaactgattcgtgcatccccgtagcaatccagcggatggccaaagccaacataccagaagcagtaaagtcagacacatagtcaattgacattgagtgactagcttggctacggaacaattccgcgtacaagccgtgcatgatatcacgcaaaggtgggtagaattgttcgcgaaggccggcatttagcaaaactgcaattgccataccattagcttgcacgaatccgaagaattcgcgtgcaatgatttcgctttccaacggtagggcagcggcttccttcgcaaagtcatctgtaagttgttctacaatcgtcttgatgactgcttcctttgtaccaaaatggcgatagaaagccatccgtgacacgcctgccatgcgggtaatttcagtaaccgcaagttggtcataggactggctttgcaacaaagtcagcgttgcatcaataatttgatcgtcagtctgctgacgaatactctccgttaacatgttcttcatgcttctaatataccgagtaaaacgactagctgtcagtgataaccggcaatcgcaaggtgacctttactcgctttactaatcctttgaaaatgccatgaaaactaaaaaaacaaggctacaaacgtaaccttgtcttaatgattcgttaatcaaatcggccgcattaacggcgttgatcaatatagtttttcaattcaggtgacaaaaccgtcttaaccttcgctaagtcagcctggttcgtcgcaccaaccatggcgtaaagctttgccaagtggttttgccaacgagtgatttcggtaatcaaaccatcagtgccttcatttagcacagtgtgcaagaagtgaccggcaacaccaaccgctttggcaccaaggatttgggccttcatgacatccaatgggtcttgaataccaccagtagcaaatacagtaggcgcgttttcgaccaattgtgcctcaagcaagctttcagcagtggtttgaccccagtcgtaaaggtaaccgtgagcagccgtcatttcacgattgcgacgatcttcaatcacagcgaagttcgtccctgaacgaccacctaagttgacgtattgggcacctaagtcacgaatttgcgcaatcgtttcttgtgacataccgaaaccgacttccttgataatgacaggaacagacacggtttcgataatgcgctgtaactcttcagcccaaatgtattcacgatcaccttcaggcatgaccacttcttgcgcaacgttgatgtgaacttcaagggcgttggcttgaatcatatcaacaacttgttgggcgtgttcagccgtgtgaccagcaccgatgttggccatcacgaagccatcggggttaatttcacgaactgacttaaacgtggtgattgcttcaggatccttcaaagcgacactttgtgagccaacggccatggccaaaccagtttccttagctgcggttgccagttgagcgttcactttaccagtcttttggctaccaccagtcatcgcttcgatgtagaagggagttgtaaagttaaagtaagggtccatcacacttaaatcaacgtcggcgacgcgtgtttctggcaacccttggtgaataatgcgaacgtcgtgcaatgatgacgttggggcattacgacggaattcggcttccgctagagctaggtgttcatctttgcggtgtgcgtgggcagattccataatcattttctcctataaagttgcaattgagagtggtagcggttggatgccagctgcaagccaggcttgcgtgagcgttttagcaaccaacggattgttcgtaatggcaatcccgttatcaccgccaccagcacctgatattttagcacttgcaccaagctcactcgcagttgaaaggagtgttaacagttgaggtgtcatgtatgataacccaacttgactggtataagtgaatagttgttcttgattcaaacgaagcgccgtggcgaccttatcgtagtccatccgacgcaggccctcaactaacatgttaacaagtggcgccgtgttttgggccaataattgtttagcatgttgcttatcaactgttgtggcgccttgtgccaacagttgttgcgtatccgctggtgcgcctgtccaaccaactaacagttgccaatcggcaggaaaaccaagtcgttcaagacgaaggagtggccaatcacgcgcaatgatttctgagaaataacgattactgtcagtccattcagttataacctcagtatcaaatttgctgtacaaaatcacgccaccgagactggcagcagcgatgtcgcccattgaaccagctttgaagtttggcgttgttaacgtaattaacgcagctaacttaaagcgctgttcaggggtcattggcagttcgtagtcgtcaatgacggctttaataagcgcgactacgacggcggctgatgaaccaagaccaagtttttgaccattgtcggcatttaaatgactcttaatggaaacggtcaaccctgtgacaggttgaccgttgtcaagaagataatcatttaatacctgcaaagtgcgaatcacaaggcgccaatcatcagtgaggggcaaagctggaagttcgctaactggccaactttgctcgcctaattgatcgctggcaaccacaaattggtcatccgtgcgacgcgtgacatcagcagtgacaaatcgatcaactgcgataacaacactaggttgaccactaagcgtgaccgcgtattcaccggcaagataaagcttgccaggagctttagcagttgtcattaaattttatctccttcaacgattttgattccagggccaggtgttgcaaccttaatttgcacacctggtaactcggctgtaagtgccgtaagaatcgtgtcagtatctgatggttgtgaaatcaacttaacgtttggaccagcatccatggttgcgtacacagggacaccttgttcacgtaacttctgcgcgatagtgatgattgtccaagacgtatccgttaagtagttgaaaggagggactgatgtggcattggttgcatgcatcatcagtgcatctgtttcagcaagttcaccaattgcggttaggtcatgtgccttaattgcagttgtcatatcgtcaacgtgattattcgtgtagtcaacccacgtttgatacatcggtgatgtcgtgagggcatgttgcatgccaccacgagagtcgaccttcttaggttgatcacttacgataaccgtcaataactgaattggccaatcgacgttttcttgaaatgcgtgggcaaccgacgtttcgctatcagtaccacgttcccagatggcaaaaccaccaaagatagaacgtgaagctgagccggaaccctgtcgcgcaaggcgtgacaagtctgcatctgacagtgtcaaaccggcagctttactggcagcaccagctaacgcagcaaatgctgaagctgaagaagctaggccggcggcagtagggacgtggttgattgagtgaacgtgggcgaaacgggtttcgccagctaagtcacggaccatatcaaggaaacggataactttcgttgcccctttgccagtcaatggttcaccatccaacgtcagttcatcagcgctcaaagtatcgtcaaaccagactgttgtatcagtataaaattcatccaacgtgagggacacagaggtcgtagttggcatgatgagtttttcgttttgcttaccccagtactttagcaacgcaatgtttgtgtgcgcgcgggcagttacatgcatcatgagttatctcctacatttgtgggtaacgttgagcccaaacttcttgtgcgccagccgcttcaagcgcttggatgatgcgttgtacatcttcatcgctttgcgcaagggcgagcatagcaccgccaacaccaccaccagttaacttagcgccaagggcaccagcttgattggcagcgttgattaattcatcaagctttgggtgagaaacacctaaagctgacaagtgagattgggcgtcgttcatgtgacgacccaatgattgaatatcgtcattagctaggtcttcgcgggtttcacgagcgatttgacctagtgcgtcaatgtgcggacgcgttgcttcaggttcattatcaagttgctcacggacaactgagacggcaagaccagtttggccatgtacgccagtgtcagcaatgattaatgtcccgtgaagcgccattgacattggctcaggcttttcaccctttacaaaccataccggtacatcgtgtgcggttgtcgcagcatcaataccagatggtgagccgtgtgtgatggcttcttcaatgttggcccagcgttgtagttcagcatcgcttaattctgtctcgaagaacgcaaagaaagcacgcacaatggcgatcgctgaggccgcagaagaccccataccacgttcttgtggaatgcttgactggatacgcaaggtaaaaggcgtcttgatagcgttgaagtgacggagcaaacggacaatcaattgtcgtacgccttcatatacttctgccatggtcgctagagggccttgatacccttgagcgattacaatttgtccttcttcacgagcctcgattgtagctgtcatggccaaatccggtaggggtaaggcaatggcaggttggccgtaaacgaccgcgtgttcaccaagtaaaatcaccttggcgtggctagtaccagttgctagcttttccactgtaaaatcaccaatccattctctaattgttttttcaaactgctattatcataccaaaacccattatattagggaaataaatgtgaaaattcatgatacaattagggtactactaaaagaaggtcgtggtacgctctgatgctaaatcgagacatctatgcggttgtcgatctagagacaacccgtacaacgagcgaatcgggccgaatcattcagattgcggtcgcattcgtacaaaataaaaaagtcattaaccaattttcaacgttggttaaccctggcgagcaaattccacgtaacattacccaattaacgggtatcacacaaagtatggtgaagggggcgcctttttttgaggacgtcgccatgacgctacatgctatgctacaaggcacaatttttgtggcccacaacgttaactttgatttgccatttttgaacgctgaatttgagcgtgtgggattaacgggattgaagagtactgctttggatacggtgccgctaagtcaaattttgtggccaactgcaccaggatatcgtttggttgatatgaccaactacctagcgctggaacacagtcacccgcaccaagcggacagtgatgcgttggcaacagctgatttgcttattgcgattttgaatcgggctgaagggttgccaatgttgacactacaaacgttggctgatttgccactggttttgccacgtgacacgaagacggtatttgaaaaggccttggccaagaatcaagcccagccacaatcgttaccagcgcacttgcaagtgattgatggattagcattgcgtcgcttctctgatccggcaccgttggtcacaggacatgcaccggctttcccagctaaaaaagctgcaaaagaacagttgtatggcaaagaactggcgtaccgtgagcaacaagcaaagttgatgaatgcgatttacacgcattacacagaagctgagttatcaaatgaacctggtaagacggcatttgttgctgaggcaccaacaggaatgggaaagacgttggcttacttgttgccatatgcttatctagcggatgaacaacagaagcaagtagttgttgctgtgccaacaattacgttgcaacaacaagtgaccgatacgattaatacgacgttgaaggacattttgccatttgaagtacgtggggcgagcctgaagggacgtacgcactacttgaatttgcaaagtttcaagcgtgctttacgcgtcgacgaaggatcaacgtcattgcaatttatcaaggcacaaatcttggtttggttaactgaaaccttgagcggtgactttgacgaattgaatttgattaatccgcagccagactttatggctaagttgtcacagccagctaataatccagctgggtcaccttactacggacacgaatttagcgagcgtcagcatgtcttggctgagaatgcacaattcttggttgttaatcatgcgtacttggctgaatatgcacaagagctgggaacgactgaagattcaccatacttggtgattgatgaagcccagaacttgccaaacgctgttctagaacaaagccgtcaccaattgccattccaagtttggttgacgcgtgttcaaaacgcgacgaatttgattttgcgtgataacgatccctcaattggggtgattttgaaccgcttagtcggtgggcaacaattgaagtctcgtttcttgcagcaattggaagtgctctcaagtgagttgccaaagctacaagttgcgttctatcgtcgtttcttgctcaatgggcatacaccagcgacggaaggtcactacgaagtggaactaccgatttctgagttggcacagttctgggtcgaccaaggacaccacctaacgagtatgcgtcgtgcagtccgtgatttgggcgaatcgatggattatttgttggagcaattcagtaataccaaggacgcattttcattgaatgagcgtcaacatttggcggatttccgtcgtttgctagagagtattgcgaagtatgagcaacacttgacgacgttccaacaagatttggttgatttcccagatgcgagtgtcttctggctaacggaaaatcaaaaccatgacagcagcaacttgcgtttgagtggtgggttgttacacaccttggatttcttcaaagacaaggtttatccgcactttatgccaccaaccattgtcggggcaacgttgtttacatcaacgaagtcaggttacctatatgatcgtttgaatattgatcgtgatacggtatttgctcgtcgttaccctgaagtgtttgatttcaagaatcaagctgaattggtaatggttgagaatgcgccgtctccaactgattcagggtacgtcagctatttggccaagcaattggtgcaattgacgacgacggttcaagaaaacacgctggtgctgtttaattcgttagacaccattcagcaagtctataatcacatgcagtcaaatcaaacttggcagcaaggaaatatgacgttgttggcacaaggtgtgacggggacgcgcagcaaaattatgaagcgcctgcaaaacgaatcacatatggttgttttgggtgccaatagtttctgggaaggtgtcgacttgcctggtgatcaactccggatggtcgtgattgcgcgactaccatttgatcaaccaaatagcgtgctagctcgcgccgaagaagcggttttgatggcacacggtaagcaaccgttctatcaaagtacgttgccaaaggcggtgctacgtttgcgccaaggtgtcggtcgtttgattcgcaagccggatgattttggtgctgtggttatttatgacccacgtatcttaacgaagtcttacggaaagacgttgcgcaatatgttgccggaggaaatgccacaatatacgttggctgacaatgaagttgtcccaaaggtgaagcgattttttgatgcgcattaacgcaaggtctttaatattgctgtaaaatttgatacagtaataattgattttgttctgttcacgcagaactaaccagaaggagccacgacacatggaaatgcgatcaaccgctcgttcaagacgtcgccggcacggatggcgctggctaattggcttaatctttgtgttagtactgctaattggtggtgctacgattgtgtcggttgcaatgcacccggttactgcggcgcgtgaacgagtgactgaattggcggttaagcgaaataagatcacctcagcaacccaattttacgcggtttctcgtaacgacacgtactacagtgtggttggtgagaacaagaagcaccaaaaaattggtgttatcgtaaaaggaaagtcaaagaaactcgtcaccgttaaaatggctgatggtgtttcggctgctgaggtgcgacaacttgtgaagtcaaagtacaacccaaagcgaattacaagcctcgggttggcaatctataagcaagttcctgtgtgggaagtcacgtttatagatcgacaaggcaatttgaactttatcacctatcaatttgcggatggtaaggcagttcggaccatccaacatttataagagattacacatctaagggagtttagaagatggatacaattcgcattgaagacgcgaagaactacgtcggccaagaggttcgattgggcgcttggttgcgtaacaagcgtggttcaggaaagatgcaattcttgcaattgcgtgacggtacggcctttttccaaggggttgtttcaaaggaagccgttggtgaagaaatctttgccaaggccaaggctttgacgcaagaaacgagcatgtacttgattggtacgattcgtgaagacgagcgttcaccattcggatacgaaatgcaagttaaggatttgacggttgttggggagtcagaaggttacccaattacgccaaaggagcacggtacggatttcttgatggatcaccgtcacttgtacttgcgccacatccaaccattcgctgttttgcgtattcgtaacacgattattgctgcaacgtacgagttctttaacaaggaaggcttcgttaagattgattcaccaattttgacgggttcagctcctgaaggaacgactgaattgttccacacggaatacttcgatacggatgcttacatgtcacaaactggacaattgtatgctgaagctggggcaatggcctttggacgtgtcttcacgttcggaccaactttccgtgctgaaaagtcaaagacacgtcgtcacttgactgagttctggatgattgagccagaaatggcttggatgcaccaagaacaatcacttgaagtgcaagagcgttacatcgcttacttgattcaagctgttttggatcgtaacgagtacgaattggacttgttgggacgtgacaaggaattgttgaagtcatacacgcaattgccatacccacgtttctcatacgatgatgctatcaagttgttgcaagaaaacgactttgatgttgaatggggtgctgatttcggttcacctgaagagacgttcttggcaaaccactttgctaagcctgtcttcatcacgaactttcctaaggaaatcaaggccttctacatgaagcgccacccagaccgcgatgatgtcgttatctcagctgacttgttggcacctgagggatacggtgaaatcatcggtggttcagaacgtgatacagactacgattaccttgagcaacgtatcaaggaacaaggtttggacttgaaggaatactcatggtacttggacttgcgtaagtatggatcagtacctcactcaggattcggtcttgggttggagcgtgccgttacttggattacaggtgaggagcacatccgtgaggcaatcccattcccacgtacgatgaaccgtttgtggccataagctaaatacaaacgttgatataccgctggaaaccgttgatattactggtttctggcggtttttcatatctatttttaaatgtctgaaagtgtgcaaaagtatcaaaaaatttgcgccaatttgcgccaaaatgggggtttttaaaaaaatttgcgccatatttgcgccaaaaatcagtcgattttatcaagaatattaagcgtctttgcttcttcactttgttgcttgtcacgtagtaggtgggcatatacttgttgtgtaattgtaacgtttgaatggcctaaacgcttagatgcataattaatgtcgacgcctttcgatagtaagtaagaaacgtgtgagtgacgcaagccgtgaacggaaactatattttcaaaaccaagttcacgttcaactcgttcaagccagtggttattgatagtagcccaacggcggccatcgaataattcattggcatcgttccattcagactttgcactaataaacgtttcgtagttatcaaagaaacgatctggcatagcaatagtgcgaatagatgattttgtttttggcgtggttgtttttccagaacgttgcttggtctttgttacgctgatattgtgcgcatcaatatcaacatcatcacgagtaagtgctaatgcttcacctgcacgcagacctgacaatgcaatcaaataaatcatgaatgacgtgttccacttaactagcttgtcgttagtttcgatgtatttaagtagctggttaaactcatcaacttgaaggaatttttcctccgcagacttagaatcagcgcctggtataataacgccataggtggggtcagctagtattaaaccatcgtgaaatgcttgttcgattacttgtttcataatctggtgacgcttaagtacagatttacgtttcttgtcgattgaataatcgttcaagaatgcttgatacatttggcgagtaatttgatctagtgttacattcttaaaatacatatcaataatgtatttgcgaaccgcatgccatgattcttttgttgtttccttgagcccagcatcgaaccgtaattgttgatactcgtcgaaataatcgctgaaaagggtaagggtgcctttttgaagtgttggcttgctattggcaactgagtattcagccgcccaagcctcagcttcctttttggtcttgaaaccacgtttgccttttttgcgatattttccggttgtgtctttgaatgatatttcaacacgccaaccggtatcggttttgtatactgccattagtttaaacctaacctttacataaaaaatttaggcagtttaaagacatgcccaggtctggtacaattaaatacggaaacagggcagtaatgttttgttttgttcgatacgcacacttactgctagccggcgggggtgtgcgtattttttgtttaattcaaaccaagttgctttgaaattagatttgttgcaacttgtgaaagtatttctattgttacgccttcgaacttactggtaaggctttttgtttgtcgccaaatttcaggagaacgtacagtgtctaagaattgatgtccgctaaacgaaatacttttaatcatatagatgtaaccgcccattgttctttgacgttttccaataatataaccaccgtctagcaagctatcgattgtatagacataatcatcactgcttattttagtgcgtcgacttgcatccataatgtcttcaattgtccagtcatcgtgaagcttcatgtgttcttccatgtctaaaagaacatttcttacattatcttctagtaatttcatgaccctatcacccaataatcttcgctttttggtcgtcgaattcttcttgagttagaacaccggcgtctagaagtgactttaactttgctagttcgtccgctactgaagagccattatcttgtggtgctggtgctgtttcttgaattgactttgattcttcaagctcaataatagccttttgaaggaactcaacgatttggtcaagagaggtgttggctaccttagcaatccatccatctgccttggccttttggctgatcaagggaatatcgtgcattgctggttcaccggttgtgtagatacgtacacgtaagtctctgatttcgtttttcttctttttaagcaagaacccacctagaagaccaataggtccaaggataagaccaccaactgctgcgccacctagtccaaatcgttcagacttttcaccatctttaatgacttcaaaagaacgaatatcggcacgcttgaacatttgtgttgtacccatattcatgatgccacgattgataacaacttcgtcagttgactcactccaaagaagatagtcactaacgcgtgtagttgcaatctttgtaaaatctttgatgtatgctttatcttctttgcgcttttgagtggcttcagcgcgttgggctaccagctcttgcttttcagcttctgttttctttgaaaatagtcccataagttcatatcccccaagctttttacgtgattcctatctgcacgtatatatgccaccttaacgggggcttttttgatataaaagataaatattaagctgattactatcattatgtgatattctaaccctatagtatttatcgaaggaggttagtctaatgtcagagggaagcccatttttatttggaaaaattcataaaatgcaagaaaaaactttgcagaacatggcatatacaaaagaaaaacatgaacaattaaaatggcaaaacactgaattttctaatcgagttcggaagcagatggaacgtcgaaatagagggcgataggttgtgcagtagccgcgccattgttaacgatttcaagcgagttaaaaaacaagttttgtaggaaattcggtatttgtaaaaatttcgaaacgtctgagaaatagtcatttgactctatttctgaaaattcaacatttgaacgtttaattccgataattgtcaatttcaagttagatccgtttatcatggccatttgggcatttgataaacggcttttttcttttctgccaattgccagtactgacttatcatctgaaacaaatattggtgactggctgaaattcaaactgccgatttcaattacgtttttaatatcgttaaattcgctcatttgtttctcggcagcttttttaattgccttttgagcggcttgtttagacatatttgaaacgtttatgtttgaataggctgcatagtttgcctgcaatattgaattcaaagcatttgagttcaataaggattctaattccgaaaagtcaactcgtttgaacttagcagtatatttgaagacgctaccgtcaggcaaattagcaacgtttggagcatcgtccaagtctaatttttcaataagttgagtgacagcataatcgttgaaaattatttcttgctcttcctctgttgcagaagtttctgattctgaatttccggttttcatttccgtaccgccgtttgttgatgaaacaccaatcgacaactttccggtaaacccattatttgtttcagtcttttcggaattagaagccttctgatggattgctgaaacaagcccctgatcaatttgagcaagtagggagtttaagacaatatcgtccatataaataaattgtttcataataatttcctttcaagccaccttaacgggtggcttttttaggtatcccggtgggcgggtaggaacgcatactcacaattagataatcgcagtgataaaagctgcgaatccaaataaaataccgggcacatttgcaattacgatgggcatgtcacgggtatgaccgtccgtcccaaacaatccgtgaatagtccacaagatacaatttaacatagctacaaagggctgtattggatcacctgcgtgaccagatagattatccacgatttgtgggatatatgaaacgtacatcagtacagacatcacactagcgatgcgagcaataagaagtagtgattttttatcttccatgtttgtacttctcctgagcttttaacgtgaatcctatctgcacgtgtgttaatcaatcacaatcgactgttaaaaaagaacttcctgtttaggaagatagctcctttttagtcttctgcttccgcgctatcaaattttttaatagatgatagaaataaagaaccaccgatgatggcaagaattccgccaatccactccaacaagggaataatagcaattgatccaccaaccatcattaaaacgctaggtgaataggaaactactggagattttttaaactttactactcccacaatcccaagaacaaaaatagctactttaatcatgaaaaatgctgagacagcgagatttgctgccatcatactttggttcaaagtagctgatacagtgatgggcgtagcgaacaatagaaaaattccaccgcctaaaccgacaatcccgtttactttagctaaatttttcaacttttttgagtccataaacaaacatactccttagcttttaacgtgactcctatgtgcacgtatgtatgccaccttaagggtggcttttttaatctatctcaatgcctttttcttttaagttttcaatacactcttttaaataggcgttgtcatgctcggggtaaatcggcgaagtcagaacttcacttggtagtgaaatataagaatcttccctggatccacggtacaaggggtctaaccataattcgttaggtttatacccgcgacttaacatctcattcattactaattggtgatattgaaataatttgtatggtgagtggtcaaagacgtaattcacagttgcatgcttcttgccccaaccaccgccacgaagtgcacaacactctctatgttgccccagcaattgctgacgagggagttttgggattaaagattcgtgccacaatctcatattaataattcctttctaaataacgtggttagtacgtccaatttttaaagaagcaaagatagataaaattagctattgcgaaaccaactatccatgcagcagctacgtatttaaaataagattctttcgtcttaaagtaagcatatagagatatagagattagcaataataatgtgttgacaatgattaaaattgtacgtagcaaacgaatgcctcgctttcatacttgcataaccgcttcgcggaccatatcttcaaagtaggcaggtagtcccaatacgtccataaaattaacgtagtttcgatattcgacgggggcatcttggaagaataaagcagctaaaaaattcaacgcgaattcgtgagcatgacgttcttccagtttcttactataaggcgagaatgcataaacaccctgactacctgtgtctccattgatgaggtgagctaattcgtgcgccaatcgaaaggcgtatgaaaatttagtgttaaatgaaacgttcatgaagatgactttatcttcaacgattgctacatctggatcgtgcattccagcattaactttgataatcacgattccacactgacgagcaatagagtttaactttgagatgaccgtttgtatcactcatcatcacctcgtaacttacgtaagctgcggacttggtcgatgatgaattgcttgtaatcgtcagataattccataccgtccaacgcaagaatagtagtatctttttcaaggtctactgttttatcgaccttcttattactgtgcatctcatcagtgttacctaataggtagtctactgatacgcctaaagcacctgctatagccttaactgctgtatcagtaggagtgacaccttgtttgtaccttgatatagcgcttggacttttgaagcctgattttatagacaattgacgcaaactaagattttgtttgtcagcttgttctttaattcgttcgtatattatattcgctgtcataatagggttcatctcctaatcgacaaataaagtgaacacaaagtgtttgtttttgttgcaattgaacactaagtgctttatactttagtcatcaagtaatttaagcactaaaaaacgagctaaattattaacaatctttggcgagaaacgttaatgtaacggggttttattagctgtgttaactatgctcttattgtacacttggtgttcaattaaagcaacttttacttgataaataaacaaaaaggagaaaagaaatggataaagaagcaagaaaagaaattgctaatgaaattttcgaagagctaaaagaaaaacatctcttagaaatcgatgcgattgcaattctaagagatgtaacttcaaaaatctatgaagttcaaagtaatcacatacttaattaatagcggtcactttgttctaaaaataatttaaaagattccgaataggtgtaattgaacaagtcaatttcgtctacaggattagtgattttgtgatgagggtcttggtttgatttgtcaagttctcgcagaaaagtggcttgagtataagcaatcgccttatcatgagcaatttgttctttatcagtcatgtcatgtacttcctttcattcaatgtagggcgagttcatgacactcgcatgtctaattataaagcttttaaagcataaaaaggagatgaaatatatatgtccacagcagaagcatcatcaaccattctacaagcggttgatgatttcgaacaattcttaaagaataacggctacggccgcggaacagggtcacgtcaactgtttgcagaacgaacgggaaagtctcaacaatatatttcccacgtattgggtgggcgtgagcatggtaaagctgcatttgaaacgctaaaccaaatatttttaattgttggctataaaggtagtaactgggttattcacagataaggagaaataaacatgacaaacgaagtacaagtatttaattttgaacaaatgaatgttcggacggtagaaattaatgatgaagtttggttcgttgctgccgatgtggctaatgcactgggactttctaatgtctctatgtcaatcaaggcactagacgatgatgaacggtctaagttcaacttagggcgtcaaggtgaggtgaatgttatcaatgaaccaggcttatataatttcatcggttcaagccgtaaaacagaagccaagcaatttatgcgttgggtacgccatgaagtgttgccaagcattcgcaagacgggcggttatcaatcaaagccaatgaccccaatggagttgctagaaacgcaattcgaagcattgaaggaagtcagtgctgatcagcaagagttgcgtggcgagtttgccgaactaaaggaacagtttggactgcctaatgatttgcgtaagcgatttacaaaggcacgtaataagcgagttgttgaagtgatgggcgggtactacggaacagcctacaacactaagaagttgcgtaacgcagtataccgtcaacttggaaacttcattaaagaccgtttcgttattaatgagttcgccagcttgccaatgtcaaagttcgatgaagcaatgcgtttaactcaaaactggcagccggacgaggtattgacgtttgccatcaacggagccaatgaacaagcacttttggaggtgtaggaaatgaagaatttaaagaaggacacggatgtagctatgtacaaaggtcaaaaagcagctcaaagacaatctgaggtagcgatcagtaaggaattgagtgaagacgaagaattacgagaaatgacattacagatagttggctttttaaagcaagaaccggccagttatgcaaaaaaagaaagagcactcaagttggctaatgagttgctctttacaaaattagtgactactcgtcgtgactagagttttctgaaagaaaggtttctatttctgcattccagtctatgttttttaatgcggctttctcttgtaaataattatcatactgttcttggttggcaccaacaacatagatggtgtacaagaatgggttcccattttcatctacatcagctgtattaattgttccgacatgtagcaatttccatccttcggctaacttttcattggcttgagcattagcatttaggtcggaaaattctaaagtaaacacaatatcgttcattagttttcccctttttgaaaaatttttggaaagcaaatgaacctttggaaaatcggattcaaaaacatttcctacgttaattataactaagcgcagacattaacacaacgcaacgggaggttttatgaaagtttatgaacttgttgatagtcatttaaaagctatcgaacgacgtataccttggctttcaaagcaaattgggataagcgattcagcattacgggctgttaggtatgattaccgtcgtcaatacaccttggagacaatggtcaagatcgcaattgcacttgatatggatttaaacgaactgaagaagattgattgggacaatcaagaacaaggaggaaaacatggcaactgaagttcaaaaagacgtacttggtcaaaaggatgttgctgaactgtttggtcactcggtgaattggttcaagaacaacctgcgtttcactaagaagttcatgcaaaacgtgccaaacaagacacctaatgcgattcgaccaacatatttacgtcacgatgtcgaacgctttaaagaattgaatgattggtggtgatgagatgcaatcggtagggtatgcaatcgcaattgttgttggcagcgtggtgttcatagcgtggttctttgacttcctagacacccatgaaattcacttacgaccatattgggaagaaaagattaaggaggcaactgatgatcaagagaattgttaaggcattggataacgcattcgatgcgattgcactaattggacttgatagtcaatttgagaagcgttccaaaaaggcagccgccgatgttggctgggatccagatgaatattggaatggcttcgttgagtacaacaactcacatcaataacaattgaatgtgggtcgcgcatcgccagatgcacatcaaccacttacacgtaatattttttctcttactgtttgtctcctaacaacatgttggtgtgtgtcttggggtgtgcgacccagaaaggaatggaaatggatgagtttactccggtgatgatttcaccgaaacaattggtttcaatcttcatcgttcaaggtgtcgaaaacttgtacgacgaagagttggctgaccaattaggaactagcgtggcttcgttgaacatgatgcgtgaagcaaagtttgctggcatcttaatgccgccatggttggcattgaatgtacatcgtattttgtcagagaagcactctcttattgaagtcacaaaacaagtattggaggacgatcatggcggattttgatattggatcaactggtgttgcgaagttacattacagctttgcaccagctaaggaatttgacatcgaagcagagcgtaagcgtattctgcaacttaatggtcgtctatcacaccgtactaagtgggtaacgcctggtgaaaatcaggtgaagagagatgagtacgaaagtcggtaccaagtgttcaagaagatgcgagacgcaggtaaaccagcaagttaaattgcatcagctattggagtgtctaaggtgacgctgtcatcacttcgttatcgtggacgttaccaaaaagaaaacgcctaacggctgcaaccgttaagcgcgaaaaggggtaaatctgtttaggacgatttactccttcagaataccacaaggaggtatgaaatgaaacacgaattgcgattagaagcgcaaaaacgtatgaatcgagccttccaggcggaacagcggtgtaacaatgacgggactgtttcggagtttgaaatgggtgttgcaaatgttctgaattgggtggctgaccatgtttgatgaagtacttgatccacctgatgatgaaatgccttggggagaagatttcgaaggcgaagaagtagcccaaggtacagaaggttggtacacagatgaaggatttgttccagatgaaaaagaaaagctaaaggcctatatggaattagttgggcatcgggcaatagcggaggattgaaatgttgcgacgaaatgaatataacccagcacctgaactgatggaatcattggcgaaagtgcaattgaatatggtgcaaccaaccaagacgaagtcaggtcactttggtaagtatgctgacttggctgatattgatagcgctgtaagactagcgattaagtcatctagtgaaccgctagcttacacgcaatcaatcaatactgacattgattcaaatggtaagcgtatggcgcaaatagttacaacgattacccactcatctggtgagtatatcgatgtggaaggcttgcctgttgagtttggtacaacgccacaacagatgttggccaatacaacttatgcacgacgtggaagtctagcagctgcattcggaattgttgctgatgatgacgacgacggtgaaaacatcacggcattaaagcaagagcaaattaaacacgataatgttcgcaaggcgatcattgctaagttgaaggaagtcttgaaatcagtaccaaaagagaagctggagcaagtgttcgctactggaggtatgacttctaaagacaataacgatacgcaacttaacaagctgtcagccgacaaagcttcactgttagcaggtgctgccatattcgctaagaacgacgctggtatcgagtaatggatatttgggggcgtatcactaacatcagcggcaataaagtaacaatgtcggtggaagatgcgcaagagctggctatgttgtcactctacacctcagaagaacgaccacaggcagttattagcattgctgatgaacgcagtattagtcgtgtacaacgaaaaaaagcatatgcaattatcggtgagatagcgaagtggtcaggatatacaccagaagaaactaagtggtggatgaaattctattatgaagcagaaacaggtgatcaacatttttcgtttgctgatacagatatgacgacagcacggaaatttatttcatacctgcttgattacgcagttaagaaccacataccgatgtctaagagtggtttggcgtatatggacgatgtagaagcctatatgtattcatcgttgagccaccgaagctgtgtggtgtgtggacgccctgctgatgtccaccacattgacaccgttggaatgggtaacgaccgaaatctggtagaccaccgacaaaagcatctaattgcattatgccgaattcaccacaatgaagcacacaacattgggtggccagcatttgaacagaaatatcacgttaagggtatcaagttagatcctgaaacattacaacgtctcggaatcatgacatttaagcgtatggaggaaatagacaatgaatcacgtctcgctaatcggacggctcactaaggagccagatgttaagtacactacatcaggtgcagcagttgcatcaggaacaatcgcagttaaccgagattttacgaacgctaatggggagcgcgagagtgactttatcaactttgttatttggcgcaaggctgccgaaaactttgtcaatatgaccgctaaggggtcacaggttggtttggaaggctcgtggcaaacacgaagctatgagaaccaacaaggacagcgtgtatacgtttctgaactagtagtaagtaactttactttagttgaaacaaaagagcagacagagcaacgcaaggggcaatcagcacaacaaagcaacggtgggttcaatagtacgccaacacaaaacaacttcaatgctcagcaagcacctcaacaagcgggattctcgcctaatgatatgtatggtaacgacttaccaccattgaatgatgatgatcttccgttttaagaggtgaaataaatggcacaacgaagaatgtttagtaagaaagttacggacaccgacgtgttcttagacatgccactgtcaacgcaagcattgtacttccacttaaatatgcatgctgacgatgacgggtttgtcgggaacatcaacacaattaagcgaatgattggcgcatcaactgacgatgagaagttgttaattgcaaaacaatttcttattccatttgaagcgagtggagtagttgttatcaaagattggcgactacataactacattcgtaaggacacctacaacccaacaatatatggggaagataagaaaaaattgtctgtatcagagaatggatcatacatcgttgacggcccgtcgacggatagtccacgcctcgtcaactaaccggcgacacaggttaggtaaggataggttaggtaaggatagattaggctagtatggcccgccgagcgtccgcactcatagtatacagagagccaaaaagcgggcgctctcacaggaagacaaaaaatgataaataaaaacatagttattcaatggcaacaagcaaacatgcctgagaactcacttgcctatcaggatttggaagaaatgcaagaactggcgttacacaatgctgagtccgagcaagaggctgtaaagctagtaatgcttgcgattaggtctgcggcaaaaaacggtgctacttcaacgctatcggttcaacgccgtttagaaaaatggataaacgctggtgccacaacggcagcaaaagttggtgattacgagaagcagtcacaacagttacagcaaccacgtcagcgatttggacagccattgcagaatgagtcaccaattgaaaagttcacaccagaacagattgatcaacaaaatcaacgcatggctaaagagcttggctatgcatcagttgcggatatggctaaggggacagcagataagctgtcagagcttagaagtacacgagccgaacgattagctgaccagtccgcaaatgggcgtacagctaacggcagacgtgttttacagcgtttctaaattaagagtgtgtcagcgatgacgggatagggcgggtaacaaaggagtaaacatgggaattaagcgtattgagctgtatgagttcagtgagcatgcagcggagcaattgaagagccgcttcaaaacggagcgaaataattggaagaactggctgatacatcgatactgcttcaatttgaatttctttcgagaacataagaaaaccccatgagttagatttactccaactcatggggttcagttcacgagagcgtttactgctttcggaagctttttttctacggcgtcgaattaccaatcactaaagtaggcgtaatgagttcagatgcaacggtttcgccgtttaactgtgccatcaataatttcaccatggtgttcgcaatcacgcctaatggttgctgaatcgtggttagggtaggcgaggataacttgtggatgtaaatcccgtcgaacccaataattccaatttcgtttgggaatgacaagcctagtgcctgactggccctgattgcaccgagcgccaaacgatcggttgccgttacaatcccagttcctggcgccggactgattaatgtgaccaattcagtggcagcgcactcgttatttggcaaatcgtaagcttcaataggcaacccgtacttcatcatcgtttgtcgataaccggtttcgcgattcagcgcgaacggctcgtcgattgataagccaagatacacaacatgttcaaaaccgtggttgatgagatactcagttgccatcgcagtcccgacggtgttgtcgctgtctactgaaatcagaccaggttccataccataaataacgacgggaacagggaggtgcagtgactcgatatctgttcgtcgtgcaccgctcactaagaaggcatccacattcgtcaaatcaaattcacggtcgtggcggacttccaatgtatagccatggtgtcgtagggcatcagttaaatggatcaataaatgcgcataatacggctcaatttctgcaatatcatcaagtagaacgaaggcgatgttgtaatgccgcttgttcgccaaggcacggcctgctcggttctgtacatacccaagctcaagaatcgcctgttgcacatcctcctgaatttctagtgagactagttcgggatggtttaagacacgagaaacagtcattttagagacatgagctgtcttcgcaacgtcgttaagtgagaccatgaataaacctcctaataaatgaaagcgctaacacgcccaacttatattaagtgtagcatactttcaaatgcaggcagaatgtaattttatgttaccggtaacattctgaaaacgctttcattttgtaatcaagagaactatagtggaatttgtaaataaagcgatttcatttgcagttcacagataggttattttgaaattacgaggttgaatcatgacagaatcgcaaaacaaggttggtaagaagcatctaccaacgctaacaatcgcgacattgatgttgatgacgtttggaaatttgggtacttccatggcgttctcactgcaaagtgccaacatgggacgtatcttccaaacgcttggtgctgatcctacgaagctaggattcttctttattttgccaccattggctggaatggttgtccaaccattggtcggttacttctcagaccgtacttggttgcctaagattggtcgtcgtttgccatatttgattttgggagctttggttgccatcgtcgtcatggccttgttgccaaacgccggttcatttggttttaagacatcaactgctttgtggttcggtgccattgccatcttgttcatggacttgtcatcaaacatgtcaatgcaaccatttaagatgatgatttcagacatggttaacgatagccaaaaggatatggcttggtcatggcaaaccatctggggaaacattggtggtgttattgccaacttgttcccatacttctttactgccattggtgttgccaacgttgccgctcaaggacaattgccagcatcagttaagtggtcattctatgttggagcaattattttggctatttcagccgctttcacagtatggaaggttgatgaatacgatcctgagacgtacgcaaactaccacggtcttgatgagcaaaagggtgagaagcaaaacgtcttcgaaatcctaaagcacgcaccaaaggttttctggacacttggattggttgagttctttagctgggccggcttccaatacctatggacgtacggaacgggtacggttgcaagtaacatctggcacacgacgaacgctgcttcaggtgccttccaagccgctggtaactggttcggtgtcttgtcagccatcgaaacggttacggccattgtttggggattgattatttcacgtttgaacaacaagacgcgtaagccagcttacacatttggtttgattgttggtgctgctggatttgctttgttggctacgactggatcaaagaccatgtcagcagttgcgtttgtgatgttgggtatggcttgggttacgatgaacgctatcccattcacgattttgacgaacgcattggacggacaacacgacggaacttacatgggcttgtttaactcatggatttgcttaccacaaattgttgcctctgttgcatcatttgccctttacccaatgttgggtaaccacatgccacacatgattttggtatcagcattcttgtttgttttgggtggtattagtgtttgggccgtgaaggaaacgtctgtcgaacacggtgacagcgtgcgctaatcagtaagagaggggagcattatgaacctagcaggtattatgcaccgtcccgacagtgagatggcgtatgtcgtgaatgagcaaaccgttaatattcgcctgcgtactgccaaagacgacattgttaacgttgaattattagcaggtgatccgtacagtttgcggagcttgccaactgatgaaaagttctaccaagtgccaaagcagatgaccaagattatgtcagatgggatttctgatttttggcaggtgacggtgaccgagccgaagcgacggttagcatatgccttcctagtgactgatatgctcggtatccagaaaatttatagtgacaaaggcttctttaaagtggctgatgccgatttgatggatatgaacttttactttcgtatgccgttttttcaaacgattgatcagtacaacgccccggaatgggtgaccgatacggtttggtatcaaatcttcccagagcgatttgccaatggggatgcatcaaatgatccgaccggcacgaaaccttggcgttcaacggatcatccgggtcgtgaagatttttatggtggtgacttacaggggattttggaccatttggaccacttgcaagaccttggggtttcaggcatctatttgaatccaatcttccaagcgccatcgaatcacaaatatgacacgcaagattatatgaccgtggacccacacttcggggatgccaagttgtttaagcaactggttcaagcagcgcatgaacgtggtattcgcgtcatgttggacgccgttttcaatcacattggtgacaagtcgatgcagtggcaggatgtattaaagaacgggcaagcatcaccatatgcgaactggttccacattcgtgaattcccagcaacgtacacaccaacggataactttgaatttgcagctgatgcaacgtacgacacgtttgattacacgccacacatgccaaagctgaatacgagtaatccagaagtggttgattacttgttgaatattgcgacgtattgggtcaaagaatttgatatcgatgcctggcgccttgatgtcgctaacgaaatcgatcatcatttctggcgtaaattccacgatgcgatgatggcattgaaacctgatttttacattctaggtgagatttggcacacatcgcagagctggttggtcggcgacgaatttacggcggtgatgaactacagttacactggcgccattctgcaatacttcttggagaatgagtcagccgacacattggttcaaaagatgagccatcaattgatgttgtatcgtgatgccacgaatcgcatgatgtttaacaccttggattcacacgatacgccacgtttgatgaccttggcgcatgaagataagcaactagcgaaaagcatccttgcatttacctttatgcagccgggggtcccatcaatttactatggaacagaatacggtatgaccggggagaacgatccggatgatcgcaagccgatggtttggcagccagagttacaagaccatgatttgtacgactttatgcaaaaattagtacaagtcaggcgccaagacattgctaagctatctgacgacaaaattatctttgacgtgattggggaacgtcaaattcgattgacgcgtgaagataatcaaaagcgcatcgttggggtgttcaacaatggcacgaccgacttaacggttgagcagccagtcactattttgctaaaaacaaatcaatctgagacgcaactggcaccaaacgactttatcatttggaccgagccagtgcgctgattatgagggaataataacatgaaacgaatttttgaagttagtccttggacaattacaacgcacgaattgaatcctgctgacaagcgtttgcaagaatcaattacatcattaggaaatgagtacatgggtatgcgcggtatgtttgaagaaacgtatactggtgactcattgcaaggtgtctacattggtggtgtctggttcccagacaagacccgtgttggttggtggaagaatgggtacccagagtacttcggtaaggctatcaacgctttgaattttgtgaaggctgaaatccgcattgacggtgacttgattgatttggctaagacgccatttgatgattttaagttgtcattggacatgaaggctggtattttgcaccgttcattcattgtgaagggtgtgaagattagcgtcgatcgctttatctcagttgccaagaaggaattggctgacttgcgctggacgtttgtatcagtcgacaaggccacgcaccaattggaattgacgtctttgattgatgccgatgtcatgaacgaagattcaaattacgatgagaagttctgggacgtgttggataaggaagctgatgaagaatcagcctttatcatgacccgtacaatcgctaacccatttggggtgccacaatttacggttgccgctcgtcaacgcttcgtctctgatttgccagcggttggttcagtcaatgatgacaagcaagttggaaacgtctttgctggtatcgtgacggaaacgcctgttcaaatcgaaaagcgtgtcattgtcacaacatcacgtgactatgacacaaacgatgctgtgaaggctgccacggatgatttgtttgctgacattgcatcaaatacctacaacgatttggtcatcgaccacacaactggttgggctaagcgttgggagaaggcggatgtgcaaatcgaaggggatgaagaagcccaacaaggtattcgctttaacttgttccacttgtttgccacttactacggtaacgatgcgcgtttgaacatcggaccaaagggcttcactggtgagaagtatggtggtgccacgtattgggatacggaagcgtttgccattccagtttacctaggggttactgatccagctgtcgtgaagtcattgttgaagtaccgttaccaacaaatcgaaggggcttaccacaacgctaagcaacaaggcttggctggggcattgtatccaatggtgaccttcgatggtatcgaatcacacaacgaatgggaaattacgtttgaagaaattcaccgtaactcaacgatcgcctatgccatctacaactacacgcacttgacgggtgaccgttcatggcttgaaaacgagggtagtgaagtgttgattggtatcgcgcgcttctgggctgaccgtgtgcactattcagcacgcaacgatgcgtacatgattcacggtgttaccggaccaaacgagtacgagaacaacatcaacaacaactactacactaactggatggctaagtgggtcttgtcatacgctttggaaaacatcgacacggttgcgccagagttccaaacgaagttgaacgtcacagccgaggaacgcaagcactggcgagaaattgtcgacaagatgtacttgcctgaagcggacgtgacggacgtcaacggtgtgccacgtcacgtctttgttgcgcacgacacattcttggacaaggaattggtgccagttcgtgatttggatccaaagaacttgccaattaaccaacactggtcatgggaccgtatcttgcgttcaccatacattaagcaatcagatacattgcacgcgatgtactacttcccagatgcctttacggaacaacaaaagcgtgacaactatgaattctatgagccattcacggtgcacgaatcatcattgtcaccatctgttcactcaattatcgccgctgacttgaagatggccgataagagtgtcgagttctacgagcgtacggcgcgtcttgatttggacaactacaacaacgacacgtcagatgggttgcacatcacgtcaatgacgggtgcttggctatcaatcgtgcaaggatttgctggcatgcgtgtccgcgatgaccaattgcacttcgagccattcttgcctgacaagtggcaaggctacagcttccgcttcctattccgcggtcgcttgttgtcagtcgctgttgaccaaaacggttcacacgtcgaattgttgtctggtgagccattgacgattgatttggctggtgaaaagctaactttggaggcctaagatgacaaaaatttcagacattaagggatttgcctttgacttggatggcgtcatcactgacaccgctaagtttcacacgcaagcttggcacgcccttgctgatcaagtaaacgtgacttggacgccagaattgcaagagtcattgaaggggattgaccgcatgggcagtcttgagatgattttgaaggctggcaacaagcaagatgactacacacacgatgaaaaggtggcgttggcatcttggaagaataaccactacgttgaattgatttctggtttgacgccggacgatattttgccggggatggcagatttcatcaaggaattgaacgacaagggttacaaggctagtgttgcgtcagcctcaaagaacgcgccatttattcttgaccgttggcaattgacggattcatttgtgggcattgttgacccaagtacgttaactgccaacaagccggatcctgaaatttatgtgcgtgccgccgagttattgaacttgccatcagagcaagtcattggtttggaagatgctgcgtcaggtattcaagcaattaacggggctggcgaagtgtcgttgggaatcggtaacgccgaaattttgcacgacgctgacattcgctttgatgcaactgccgacgttacgttagcaaacatcgcggcaaaactcgattaacaatttgtacctctcacgaatctcaaaaaatatctcaaaccaaagttttgccgcgaaggcgccagtttcgttatgctggcgcctttttagttgatgacattaacaagcttgccaactataattaagtaaacacaagtttgtttggattttaattagaggaggcctagaatggcagcacgtcctaattcaagtcgtcatctcgttttgacggcattatttattgcaattattctgctacagtcagttgttccttggctgggcacattaccacttggggcgttcgcaattggggcagcggtaacgattattacgtttactgtcgcaattggggcgatggtcttggggcctcgcgccggtgcgttactaggtttcgtttggggtgcctattcactttggcacgcttggacatcagcaccaagtattggcgcattgattttccgtaacccaatcacagcgattgtgccacgaatgttggtcggtttgattattgggtacctgtactggcgctttgttaagaatcgcccgatgggacaacagaccatttggttagcaggacttggcgctttgtctgcctttgtgaacacattttttgtgttgagcatcacgtggattggctttacggtcatgcacacaacggcgtttggtattcctgattcaggactcgcaaattacttgattgtttcaattgccggtttcaacggtgtttttgaaatcattgttggggcgatcttagtgccactgattggcattccggttttgacattcttcaatcgtcaaaacgcacgataatttttagactcggtagcaactgctatcgggtctttttttgcgcgtttttcaaaaaaaaaccatagtttcgtaatttgatacgtcaaaagagctttaatgtccgcagttcgttaaaatttagatacagaagtagattttgaccatgtaataggggtgtttttgtcgatattagttcccgctttttagtacttttgtgagctaaactatcgacaatggtcgaagtctatactttgacagtcttgaattttaggggagttaaaatcatgaaatctacagacacaagtgtaaaggagcgagaagttaatctcgaagatgccggtggtggtaataagaagaataagcagtggcttcgttttggtgcgacgtcattgctgattgccattggtatgggggctaacacaggcggtgaggtttcagcggcggaagatccaacgattgacgatgctgatgcttctttggtgagctcatctgacaaggatgacgaccaagatattgaagaacgtgataaggatggcgatgggttggatgatgaaactggcgaaccagtgcctactaatccaagtgatccagattcagtcgtagctagcgcagaagctacgacgtcagaagaatcagtcgtggaatcggtggccgaaacgccagttgatccagttgtagtggagagtacgagttctgaaacaagcagtctacctgaagagagcgttgtctcaagcactgcagaagttagcgatagtgaatcagttgtccaatcaccggtcacaagccaaagttcattggctagttcggtggttttgttgaccacatctgcagcttcagaaagttcggctacgtcaacggattcatctgatgcgtctagcgaagcaagtagtgcgacaagcgatgaggagtcaagcgcatctgacagtttggtgagcgtggcacctgaaagtgaagctgagtcatcttcagctgaatcagcaatgagtagcgcagactcattgcaatcggttgtaccagctagttcacaatcagcaactgttttgggagcagacgatagtgcgactgaggaagaaacagtcccagaaactgtcgcagatggcgtgaccgtttccgttgacacaacaatcgaaattccaaataaggacagttttacgggttcagactatggcctaagtagcactgttacagtgacgtatgttgataagtatctctggattaacttgccagcatcttacaacttcaacagcattgatatggatgcgttgaaagcatacgcggcccgtaaccgcatggtcatttccttcttgcaagaaggtgaacaagagaaggacacaacaactggtctgacagaagcacaacaagcatcgtttgatttgtttaatcgcgattcgtttaacttgatgccggcaaccgaagtcatgaatgataacggcacgattattgtgtactggcctgattcaaccgaagcaagtacaacatttgattcggttgaccacgatgacattcgtatttgggctgagacaaatggcttggattgggttgttgcatcagaggcttggcgccgtatggatacgggacaaacagtgccgactggtgaccaagttttggatacaagcaacacagacttgccggcaattattcgtaatgatgctaacttgttgcgaacgtattatccaatccaatacttcttgagtgctagtgacaagaagcaatatgttatctttatcgcacgtgaaggccgtacgtctgatccgtggagtcagacgattaaaccgggtgagaccttgatgattgctgaaattaattcatcaggaattattgggcgaacatatttgaccaatggtcaaaccgtaacgttgaatggaacgacaatcaccgaccgtttctcggcaggtagcggtgattactacattggtagctattacacaagtacaggaactagcttgcaatcgtggacgattcagggaatcacgaccaaggcaaccgcagccgatgccaactactactatgctatcgataacggtgatggaacgtacactaagacggacattcgtattccggtgaatacaagcgccggttcaaccggtgatgccaaagttaatacgttgaccggtggatctggtgggtctttcccagacgaatacatcgtcacgtccgacgtgctggccgggtaccagcttgtgccgtcattgacgtacgtttcaggtcaaatgtcttctacgacaagtggcaccggcacagggacgacgcaaacggtgcgtggaaagtttatgaccaacaattatgatcagatggttaaatctggtgcgaacatgtatcgtacagtgcttgatccaaacaatccatttaatttagcgttagttcgtgcttatggatttgatttgagcaaggtgccggcggtgcggtggttgataagtatgtcaacagtagtggtggttataccgtaacgattgcttggccggtggtcgatgccaatggtaatcaacttggccaaacatcaattatttgggatactggctcgaatacgattcgttttgatacaagtaccagtggtggggccgcaactaatccagttaagcactatacgattccgacttctccgctaacgttctatctacaaacaaatacgtcgaccggtgcgacttcaattgttgctgcaacgtcacaaccaaccacatcaggttatacatttgccaagattactggtgatatctataaaacaaccaccggaacgctaacgttttcagcgactgatgcgttcggtaacgctaacgcagtggtttcaacgccggattggttagacgaagatcgtaacggatcaatcgacggtggtagtttcaccggctttaagaatggcgggtatggcgacaagcaaaacagtttcacgattattgataaatatagtgtttctggcgttaacttctactatgttgccgcgccacaaatggcaacagttgggttgaagacagctgaaaagcaatccgatggcacgtataagttggttgatactgcccgaactaatacggatggtgtttcaaactataacaacaagacgtctggtcaaatagactcagccttgcaaggtgtgacgggtgccgtcattggtgttgctcgaacaggaagcacggctaatgattgggcgaaaattaataccaaggtgccaggttatacctacattggttatacgtacaatggtggctctttacaatctgtgcagaaatcagatggtacttatgccatgccgtatgaaaattcaaatgcgaaatacaacgcgaccgcaagtacaagtgtttcgaatggtgcgattacggactcatcagcggatgcgattgttttgtactatgccatcgatagccaacaagctcaaattaagtttgtgatggccgatggaacgacagcaccagcaaacatcaatttgactggtaagactggtgaagccttgtcacaagacatcgcaagtagtattcctgctggataccacatcgatacaagtaagacgacaacgactggttcaccagccatgacgttatctggtacgacagtttctggtacgtatgacgccacgaataacaatttgagtacaactgatagtagtttgcaaacaatgacgattaccttggtcgctgacacacaaacggttaaggtgcgttatattgacgtcaacgcgtcagataaaactaccggttggaccgctgcagatggaaccgaaattacgaattgggtgcaaacggtaactggtgatactggtaagacgtataccaatgtgccgtggggaatgtcgacgactggatacgttgttgtggcgcaagatgccggaacgcgttctggaacctttgataacgataccaatacagaccaaacttactacgtttacttgaagcacaacactgtgagtgtggaaggtggtaaggaaggaaatgcaacgtggacgacgaagtcgacggttcgttatcgctatgaagatggcacaacggccgcggcggctaatgttcgaacgataacatttacagctaccgtaacgtacgatgcggtcacaggtgaagcgctatacgatacgtgggatgctgaaagctatacatttgatgatgtggaatctccagtcattcaaggatacattgctgacaagctacaggctggagcagggactgtcactaatacctctgctggcatcgtggcaattgtcgaatataaggcgctgggtgcttggacgccaagcttcccagatacgacgccagataatccgccaactgatgtcacttatccaaacgacccaacggatccaacacaacctgatcgcacgaatccatcagtgccagttgtaccgtatgtgcctggatatacgccagaattacctgatggtacgccgttgacgccggttaatccagatgacccaactggtggatacttgccaccagatgtgccggcagatccaacgactgacacgacaattgtttatcatgcgaatgatcaaacagtcactgttaactacatttacgttgcggatgatggcacccgtacggttgtgcacactgaatcatttgatggtaaatcgaatgcaacttatacacacgaactgtgggattatgaaaataatccagaccaatcttatgttttggtatctaaggatgcgggtgctgagagcggcacgttcgatgctgacgatgatgagacacaagtttataacgttattttggcgattggaacggaatcggtaccaggtggtaaggatgatgatccaaaccaaagtgattacacaaagacgattacacgcacaattcattatgtcgaccaaaacggtgatccgatgttggatgcggatggtaatccggtaccggatagtgtgatgacccacacctttaccgcaacggttacctataaagtagattcaaatgtgccagtctcgattgaatggcctaatgattcggccacgtttgcagcggttaagagcccagttattacggattatgttgccgatgtgacgcaagttgatgcggaacaaattgaccacaatgatacggatacaacgtacaaagtcacgtacaagccgatgggaagttggacgccaagtttcccaccaaatactgaaaatgtaccgagtgacccaattcaatatccaaacgatcccaacaatccaacggataatgaaacgccacatgaccctgctgagccaggcgacccagtcatcccttatgtaccgggttacacgccggaagggcctgatggcacaccattgaagccggtcgacccagaaaatccatcagctggttatattccaccagctccaacggatccaacgggcgatacgacaattaattacacgcgtaatacgcaacaagccattgttcgttatatcgacgacacgaccggtttggaagtaactgaacttcgtcaaacgttctcgggtgagactgatcaagcttatacgaatacgctgtctgattacgcaacccttggttatacgttcgttagtgctgaagcgggtgcaactgctggaacttacgaccgcgatgacacggtgaaccaagtttatttggttcacttggaccacggtacggtggttgtcgacggtggtcgtgaagacgatccaaaccacgacagttacacgtctacggttacatcgacggtgcattatgtctatgaagctgataatgcaacggctaagcctgatagtgtacaggaaaagacgtttacagcatcagtgacttatgacgcggtaactggcgaagtagtttcgattgtttggccaactgaagaacaaagttttgacgatgtacaaacgccggtaatcgacggttactttgcaagtgaaggcgttgttgctggtggcgcggttgattacaacgatgcaagtcgtgaagaaactgtcacttacacaaagctaggttcttggattccacacgtccctgatttgccagaagatgagcaattgaagacgcgtgtctatccaaatgatccaaacgatgcctcaaaggtttggacacgtgatgatccaaactacgttgaagtaccagtgccatatatcccaggatatacgccaacgactgacggtagcagcacacctttggaacaaattgatccaaacgatgtgacgaagggctactacccacctgacgtaccggataatccggcagcggatacgccaatttactacgtggcacatccacaaacattggtggtggtttacgttgatatttcatcaggaactgaagtcgaagttacggagctacaacaaactttgacgggaacaacgaacgcagcttacacgaacacgttgtcagattatgcagcacgtggttatgtcctagttaatcaagatgcaaccgcaaccgaaggaacatacgacgacgcagacaacgtaactcaatttgctaaggtctacttggaccacggtacagttgtcgtgacgccagataatcctggtgacccaggcaatccaatgtatccggacgtacctggtacgccaacgtggccacagggaacggatgaaagtggtgttaagcgaacgattaatggtgtcattaattaccagtacgctgatggttcagaagcagcgacggatgttacgcgtaccgttacatttgaacgttcaattacgttggacgccgtaactggtgagcaaatctcaacgacggactgggaagtaacggccggtgatgatgactggcccgagacacctagtccagtgattgatggttactacgccgatatttcagatattttggcagtgacggtttcgcctgatgactatgatcgtagttacatggtgacgtactacccaatgggacagtacgtaccggtgttcccagaaggtactgagaacgtacctagtgatccgattacgtatccaaatgacccagataatcctggggatcctttggagccaggtcagggaacaccggatacgccaggtgacacggataatccaaccttgccatacgtaccgggctttacgccggaaggaccagatggtacaccgttggagccggttgatccaaataacccaagtgcgggttactggccaccggcaacaccaaccgataatccgggtggtgacacgacgattacctacacggctaatgaacaaaaggcgaccgtaacatttatcgacgatacgacaggcgacacactgaaggttgtcgatttgacgggtaagtctgatgaaactgatgcttaccgcacggcgaccgacattgcgacgtacgaacgtgccggatatgtccttgtcagcgacgattacccaacagatggtgtggtttatgaccgtattgatgatacggaccaaccattcacagtgcacttgaagcaagccactgtcacggttgacccaagcagtccaaaggaaccaggaacggatatctttacgccaggcgacccggttgatccgagtgacccaagtggcccaacctatccggaaagcccatacacgccgggtgacccagtttatccagaccaagcagatgggccaacggtacctgatacaccaggtgacccaggtacaccagttgatccagataatccaagtggaccaacttggccagcaacgccaacgtacccaagtggtgtcactaaggatgatttgaaccagacagtcacgcgtacgattacctatacgtatgcaagtaatggtgaaaaggcatctgaaacggttactgaaacgttgacgtacagtcgtacggcgaccgttaatgcggtgaccggggcggtgacttatggcgattggcagacgactgattcaacgcttgataaggttgattcgccgttgatttctggctatgtggctagtcaattaacagtcgctgaagaggcggatgttgatgcgatggccgatgatacaacggttgcaatcacgtataccaagcttggtcaatgggtgccatcattcccaccatcagctgctgatgaggatgtgccagatgatccaattgattatccaaataacccaagtaatccaaccgaaccgttggagcctggtgtgaataatccaaatgatccaggtacgccggctaacccaacgttgccatatgtgccaggttatacaccagaaggcccagatggtacgccgttgacaccggttgatccagataatccaagtgcgggttactggccaccggagacgccgacggataagccgggggatgacacggttattcactacgttgcgaatgatcaagccgctcgaatcacgtttattgatgatgatactaagcttgagctagcagtcgacacaatttcaggtgagtcgagtgacacatcgacgtatacaactgctgatcgtatcaaggcttatgaagcgcaaggatacacgttggtatcagatgacttcccagcggacttccagttcgaccgtgacgatgcgacggaacaaaaatttgaggtgcatttgaagcgcacggttttggtgattacaccagatgacccgcgcacaccaagtgatccaatctttacgccgggtgagccggtggacccaagtgatccatcaagcccaacgtatccagctgaaccaggtacaccaggtgagccaattgatccggcaaacccaagtggcccaacttggccggagacgccaacatacccagcaggattgacggccgaagatttgaaccaaacggtcaacttgacggttaactatgtttacgaagatggtaagacagttgctcacgatccacacacggatgcggtgcactttacgcgtacagcaacgttggacacggtgacgggcgaggtgacgtactcagattgggtagcggttaaggatgatgcgacattggacgcttacaagtcgccggtcattgacggctactatgctgataaggcatacagtacagcggtgacggttgcagccgaagacggtgatgtgactgagactgtgacgtacaagaagttgggacaatgggtgccatcattcccagccacgacgccgagtgcaccaacggatccaattgattatccaaataatccaagtgatccaacggtaccaacggatccagctgagaatccaagcgaaccaggtacgccagagaacccaacgttaccttacgtgccaggttacacgccggaaggaccagatggtgagccgttaacaccggctgatccaagcaacccatcgtcaggctacttgccaccaaacccaactaatccgggcgaggatacggtaattacctacgtaccagctgatcaagttggttcggtcacgtatgttgatcagacaactggtgaaacgctagtagttgattcgttggctggtaagtcagatgaatcgggcacatatgcaaccgctgaccgtattaagcaatatgaggcgatgggatatgtactggtagatgatggctatccaactgactttacgttcgatagtgatacaaccaagtcacaagatttcacggtaacgttgaaacaagtcacggtggttgtgacgccggatgatccaaagaatccaagtgacccaatctttacgccgggcgatccggtggacccaagtgatccatcaagcccaacgtatcctgaggaacttggtacgccaggtgacccaattgatccaaacaacccaagcggaccaacgtggccagcaacgccaacgtatccaactggggtaacggcgcaagatttgaacaagacggtcacacgtacaattacgtatgtttacgaagatagttctgaagctgcgacaacggtgacggacaatgtcgtcttcgaacgtaccgctacggttaacgccgtgacgggtgaggtcacgtatagtgagtggacggccgtcggcgatgatgtcgattggcaacaagtcgattcgccaatgattgtcggctacatggcagacaaggcatcagttgaatttgtagatgtcactggtgcaactgagtcaacatcagtggttgtaacgtatacagcggttggtcagtgggtaccacatttcccaccgggaactgaagatgtcccaagtgacccaattaactacccaaacaacccagatgatccaacgaatccagcggatcctggtccggataatccggccgaccctggaacgacggataatccaaccttgccatacgtgcctggcttcacgccacaagggccggatggtgagccgttggagccggttaacccaagcaatccaagcgagggatactggccgcctgttattccagatgatcctaagcagagccaagatattacctatacggctaatgaacaaactgcgcgaatcgtcttcattgatgatacaaccggcacgacattggcaacggatgatatcgatggtgtctcggatgagaagtcgacgtatacgacggcggaccgtttggctgcttactacgcccaaggctacacgttagtcagtgacggttatccagccgacttgcgtttgaccgtgtcgacggcaatgttgaaacgttcgaggttcacttgaagcacgctgcgattaccgtgacgccagatgatccaaagaacccatcaacgccaatttacacaccgggcgacccagtcgacccaagtgacccatcgagtccaacatatccagcggaaccaggtacgcctggtgatccaatcgatccggataatccaagcggcccaacttggccagcggtaccaacgtacccagctggggtgacgacgaccgacttgaatgagacagttaaccgcgcgattacgtatgttgatgaggcaggtaatacggtcttcgatgatgcaacggacaaggttaacttcacgcgcacggcgacagttgatgcggtgacaggtgaagtcacttacggtgcgtgggttgcaactggtggtgacacaacgtttgacgcggtgagctcaccagttaagactggctactacgctgataaggaagtggtagctgaaaccactggtttgacggcaacgacggcggatgaaaacgttcaagttgtctacaagccaatgggacaatgggtaccatcattcccagccggtacggaaaacgtgccatctgatccaacgacgtatccaaatgacccagctcatgccgatacgccgcttgaaccaggtgattcaaatacgaatgtgccaggaacgccagataatccaaccatgccatatgtaccaggatttacgccacaaggtccagatggcacgccacttgaaccagtaacgccaggttcgccagaaggtggttattggccaccggcaacaccaaccgataacccaggtggtgatacggttgtgacttatgttgcggatgaacaaaaggcgacgattacgtaccacgatgtgacgacgaatactgatttgtcggttgatacgattgatggtcattctgatgaaacaagttcatacaccacagcacaacgcattgcgatgtatgagcaacaaggttaccgtttgattgatgatggttatccgggtacggacttcacgttcgatcgtgatacggcaactgatcaagcgtatatcgtacaacttgagcgtattacgcaaacgattacgccagatgatccaaagacgccaagttcaccaatctttacgccgggtgatccggtggacccaagtgatccatcaagcccaacgtatcctgaacaacctggtacgccaggtgaaccaattgatccagataatccaagtggcccaacttggccagccacgccgacatatccagccggtttggagcatgatgatttgaatcaaacggtcacgcgtgaagtaacttatgtttacgatcgtgatggttcagaagctgcgacgacggcgacggaaacgttgacgtttacccgtacggcgacccttgatacggtcagtggcgacatcacatatggtgaatggattgcggccgatagtgatacgacctttgatgaggtgacatcaccaacaatcgctggttacacggctaaccgtgcgtcagttgcggaagcgaccggcgttgcggcgacagatgcagatacgtcgattgaagtgcgttacgttgcaaatgagcaacatgcaacgattacgtatattgatgacaacacgcaacaaacgattgtcatggatgacattaccggacaatctgatggcacgacgacctacacgacggctgatcgaattgcggctttgcaagcgcaaggttacagccttgtgaaggatggttggccagctgacttcgtgttcgacacggatgatgatacgacgcaagcctttgaggttcacttgaagcgcgcgacgattacgattgactcagatgatccgaagacgccaagttcaccggtttacacgccaggtgacccggttgatccggatgacccagatggaccaacgtatccagctgaacctggtacgccaggcgagccaatcgatccaaacaatccaagtggcccaacttggccagcgacaccaacttatccggacggtttgaagacgactgatttgaatgagtcagttgaccgcacgattacgtacatttacgaagataatagtgaggctgcgaagtcggtgacggataacgtccagttcacacgcaccgccgagtatgacgtggtgacgggaactgtcacatatggtgagtgggtagcgacgaatggtgatacaacctttgatgcggttgcctcaccagtgattaccggctactatgcggatttgacgcaagttgatgaaactgctaatttgacggctgatagtggggatgaaaacgttacggtcacgtataagcaaatgggacaatgggtaccatcgttcccagctaatacaccaagtgtgccaacagatccaatcacgtatccaaacgatccggatgatccaacgcaaccgcttgaaccgggtgcgccagattatccagtggtgccatacgtgccaggcttcacgccagaaggaccagatggcccattgcaaccagttgatccaactgatccaagcaagggctatgtgccaccggcaacgccgacggacaaccctggtgaagacacgacgattaattacgttgccaatgagcaaacggccacgattacgtttatcgatgatacgacgaagacggacttggcagttgacacaatcacaggtgtttctgatgcaacgtcaacgtataccacggctgagcgcattcaagcatacttggcgcaaggttacacgcttgtttctgatggttatccaactgacttcacgtttgaccgtgatgacagtaagacgcaagcgtatgaagtgcacttgaagcacgctccgattacgattacgccaagtgatccaaagacgccaagtcagccaatttacaacccaggtgatccggtcgatccaagtgacccagatagcccaacgtacccagaagaaccaggtaatccaggtgacccaattgatccggataacccaagtggtccaacttggccagcaacgccaacgtacccagctggtttgactgaaactgatttgaatgaatcagtgacgcaaactatcacgtacgtgtatgccgacggccaagaagcaagtgatccaaaggctgacaaggtaacgtttagccgtacggcgacgctcgatccggtcacaggtgcggtgacgtatggtgagtggattgcagcaaatagtgataccacatttgatgcggttgcctcaccagtgattactggctatgttgcggacaagcaaacggttgctgaggtgacgggaattcaggcaactgacggggataccaatccagttgtcacttatacagcaatgggacaatgggtaccatcatatccagctggtacgcctgatgtaccaacggatccgattacgtatccaaatgacccagaagacccaacgcaacccgctgatccaacggcgccaaattatccggttattccggatgtacctggcttcacgccacaaggaccagatggcccattgcaaccagttgatccaagtgacccaagtaagggttacgtgccaccagcaacgccgactgatccgacacaagatacgacgattacgtatgttgccaacgagcagcaagcgacgattacgtattttgataagacgactggcaagcaattggcaatggatacgattacgggacactctgatgagacgtcaacgtatacaacggctgacaagattgcggcctacgaggcagcgggttatgttttggttacagatggttatccaggtgccaactttaccttcgatcgtgaagatgattatgaccaaacgtacgaagtgattttgattcacgctgtgattacagttgatccaaatgatccaaagacgccaagttcaccaatcttcacgccaggtggtccagttgatccggacgacccaacgagcccaacttatccagttaaccctggtgacacaccaacgccaacgtacccaggtggtttgactgaaactgatttgaacgaatcggtaacacaaaccatcacgtacaagtacgcggacgggtcaacggcagctgatgatgcgaccgataccgttacgtttagtcgtacggcaactgtcgatgcggtaacgggtgcagttacttacggtgattgggttgctgccaatgaggacacaacctttgatgcagtggactcaccagtgattacgggttacgtggcggataagcagacggttgctgccgtaacgggaattggtgctaaggatggcgatacgacggtcaatgttgtgtacaacaagatgggacaatgggtaccatcgttcccagctgacacgacaaatgttccgagtgacccaatgacgtatccaaataacccagatgatccaacggagccactcacaccaggaccagaaaatgaaactgatccaggtgacccagacaatccaacgttgccatatgtaccaggcttcacgccgcaaggaccagatggcgagccattggacccagttgatccaagtaacccaagttcaggttactggccaccaactttgccaagtgacccaaccactgatacgacaattgagtacaaggcggatgaacaaaaagccacgattacgtatattgatgaggtgacgggcgacacattggttgtcgatacgattaccggtggttcggatgaatcaagcacgtacacaacggctgatcgcttagctgattacttggctaacggatacgtgctggaagaagatggttatccaactgacttcacgtttgaccgtgatacgacggtcacgcaagcctacacggtaaccttgacgcacggctcacaaacgattgatccaaatgatccaaagacgccaggaacgccaattaatccggataatcctgatggaccaaagtatccagatggtttgaagtcaactgatttgaatgagtcagtgacgcgtacgattacgtacgtggatcaagctggcaagacgatggcgacggcggttgaggaaactattcactttacgcgtacggcaacccttgatacggtaaccggagcatacacgtacagtacttgggtgccaacgacggtaacgtcaatgaatgcagtcgattcgccagtcattgctggttatgtggctgatcgtcaaacggtcgctgctttgagcgatttgacggcaacgtcagcggatgtatcagagaaggtcgtttactcaccaattggtcagtacgtaccatcattcccaagtggcgtaacggatgtgccaagcacgccaattgattatccaaataaccctgatgatccaaccacaacggatacgccaggtgaggataatccagccacaccgggaacacctgataatccaacgatgccatatgtaccaggcttcacaccacaaggtccagatggcgagccgttggatccagttgacccagataacccaagttcaggttactggccaccagcgccaagtgagacgccgactgaagacacaacgattacgtacacggccaataagcaaacggccacgattacgtacatcaatgatgagacaggtagcgttttggcagttgatacgattactggtggttcagctgaaactagcacgtacaccgcttataaccgcatcatggtttacaagttggctggtatgatgttggtaagcaatggttacccaagtcactttacgtttgatcgtgacgaaacggttgatcaggcctttgaagttcacttcaagggtgcgacaatcacggttacgccagatgatccaaaggtgccgggtgatccgatttaccaaccaggtgatttgattgatcctaacgatcccgattcaccaaccttcccaaacccacttggtgacccaggtacgccggttgatccggatgccccagattcaccaacttggccacaaccaccggtttggccagatggggtaacggcggaagatttgcgtgaagaggtcaaccagaccatcacatatatctatgagaaggatggatcaacagctgctaagacagttaccgatcaggttgtctttacgcgtacgattacaattaacgtcatcgctgcccaagagagtgcgcaaccacgagcacgtttggcacgtgccgcaacttcaagtgcgattgtttactctgattggcaggcagtgaacggtgacgatacctttgatgctaagacatcgccagttattccgggctacatcgctgaccgtttggtggttgatgaagtggcaggcatggatgaaacgagtgaagatgacatccaacaagttgtttaccgtcaacttggttcttgggtacctagtgtgccacaagtgccaggggttaagacaccgggcgaagtgacgtatccaaatgatccagatgacccaacgaagacggctgatccaaattcaccaggttatccggtcatcccatatgtacctggctttacgccacaaggtccagatggtacgccattacaaccagttgatccgaagaacccaagcaagggttacttgccaccagctgtgccaagtgatccaacggcggatacaaccattgtttacacggttgatcgtcaacacgccaaggttaacttcattgatcaaaacacgaagcaagtgctccatgttgagcagttgtctggcgatagttacagcaagtcgtcatacacgaccgctgagcaaatcgcttactacgtggcccaaggttacgttcttgttagtgatggttatcctgctggtggtatgacattcgatgcggattcaacgttgaaccaaacatttgctgtcacgttggcgcacggtacaaagacggttgatccaaataacccaggggtaccaggtacgccaattgatccaaacaacccagatggtccaaagtggccagctggtgttgacgaagatcacttgaagacgtcaacgacgcgtacgattatcttccgcacaagtgacggtacgattgtcgatacgaagacgcaaattgtgacgtacacgcgtacggcaactgttgatacagttactggggaggtcacgtacggtccttggacggcggaagatggctcacatgtgccagatgttgctgtaccaggcatgccaggttacgtggctgatcgcgaccttgtaccaggggtggatattccagttggtacacctaacttcactgagtatgtgacgtacacggctgtgcctgagcaaacgacggcggaagtgggaccaaatgaaccggtgattgtacctgaggtattgacgccacattcattggcctacacggcagttcaatcagcaacggtgacaactgaaagtgcagcttcgttggcttacacagctgaacaaaacgctgctgagtcggcaacggcccagcattcaggcgtcttgccatacactggttcggacgagcaagagggtgctaaggcaactggtttggctatgttgttcggtttgttcctcggtttgttcaagcgtcgtaagcgcaaggatgaagctgaagaaacaagcaagaagcacgatgataagtaacggaaacgccttcacgggaaatgacctgtgaaggcgtttttgtatgattagttcatatatttcccatgatttgttgatatactgcaagcgggaacaagttagcagggggagtctaatgaaacatttatttttaatggagttctttggacgcggtcaaagtggccgatcatatgcggttacggagcgtgtgcgtctatttaagaatctaaacaaagatgtcaagctagtcacatttgactacaatccgcagtatgaagatatttggcgtgaagctgcgccggatgttatggcacaccacattaatatgatggattattttcaaggggaggccgttgcaggcggcgtccgtgttgaacgattgcatgatgcccgtcaggtgacaattgttgataaggtgtttaatcaacatgatgaactagtgggtgaaatctattatggtctcgataacaagagtgtttcacgacgtggcgctattttgtataaccgggatggttcggaacgcatgcggttgctatacgttcaaaacaaggtgacgcaagtcttattgtgggacggtggcatgctgcatgtgctgtcatttgaagcgatggtgaaatatttcttggaaaagttgaccgctgaagagccaagtatcatgtatgccgatgtgctagaggaaacgatgacgcaggcgtatggcagtgtcgaaaatgccgaaatgaaggtggcgtatattcacgctgatcatcacgtggcccatcatcaaattttggttggcttccgtaatttattgcgggccaagaagttcgattggattgtgacgggaacgcagacccaagcgattgatttgcgaacggaatggggcgcccaaacgattgatattgcaccggcttcagtaacggtaccggatacggtgacggatttggctgaccgacgcgcaatgtcggtcgtggtagtaacgcgatttgatcgcattaagcgtatagaagatatgattgcagccgtagttaaggcgcacaagcaaaatcgtgatatcaatttgcaactctacggtacggtttctgaccaagcctattacacgcagttgcaacaacaaatctcagacgctcatgcgacaggctatatcacgtttaatggcgctacgaccgatgcgattgacacatttcaaacggggcaggtcacgattttcacatcacgaacggaaggctttggtcgtacgattttggaagctgaagcagctggtacgccggtgatttcgtatgacattgattatggtccgcgtgcaattatcggcaaggccggtaagttggtcgcggatggggatgtgaacgcccttgctaatgcgattgtgatggcattggcggataaacgttggcgtgaaaaagcgagtgcagccggtcgtgaacaggcacgtgaatatgctgctgaacatgtccaggcgaagtggttagatttgattacaaaattggaggcgactcatgaaaatcatgttgattgatgacaagactactgatgtcgtcacaaagttaaaagacctcaaacgacgttaccatcacgtgcaagtggtgaatatgacggagaatgagtcatatcgcaatgggtttccaggcgaatatttgatgtatcgcatcgccggtattcgtttacgaccagcgacgtatttgaatgatttgccgtttaaaccagagtatgcgatgtcatacaacaagtatggtgaaatcagcgtgactgatatgggcaatgaggttgcgacgttgcagttggtggattggcaaaagcaaacggtccgtgcggtgaagtacattgcgcgtggctttaactggcagtttgatttggtcggtgaaaaggcggatgtggtgaagcggtggattcgcgatgataagcaacgcacgattatgattcgcatgcaattgtcgaacggcaagttgttgaagaagctttacaattacgaaggtgacagccaacagccgattagcatgacgtttatgtatgatggtaatctgtttgatgatgagaacagctgcttgacggcgttcttcatagatgtgtttgatgatcaaaacatcgagattattcgttatacaggtcaatagaatacgatagcgtgggagatttttcctacgcttttttatttgtggttagtgtcgacgcggtgcgtcgagacatgagggtgcgggactatctccggcaaagttcaaactgaggcaaccgaatggcgcggacgccattcagcggggcaaataatttcccctaatccttctaatcctgaatgggcttatctgaatagcgccggccatgcggcatgttgccccagtttgaacgctccgatagtcccgcaccctcatgccagcagccgagatattctagtctgtttatgattgtcatcttgctttcaaattgaaagtataacaagatagatgcagagggatggaatctataaagcgagggatttatgggaaatacagttaagctgatgtttgggaagatacctgaaactgttgggggtgagttatcggcgattcatcgattggtaacgtcgggattaactactgaacaggtacggtttctgcaagctatgacagatgtggtatctgatggacaggttgcaaacgtgatggatattcaggaggcattggactggaaagttaatgaaatcgttgaggtgcaacaatacctgattaagatgcgtgtcattcagcctgttaatacaggtgaagtcagatttgccttgccaaatacaaaagattattttgctctcgtcgaacatccagttgattatgtagatgtgtggagtcgctaaaaaatcctatcaatccaaacgaccactggacagcttaacagcatatctggtggtcgtttgctgtttatacgtcccttacttaaagtcacgaataaaaatcttttgtttcggtgtaaactaattaaaggtaaaggtagacaggagttggggaaatgagcaaggaacatgataagcaaacgctggcgcaacgtaataatttgattcgtgccgccgtgatgggggccaacgatggcatcctgtccgtgtcaggaatcgttattggtgtggccggtgcgacaacgaattcgttcgcgattttcattgccggtttcgctggggcattggcgggaacggtctcaatggcgatgggagaatatacatcggttcactcacaaaatgacgcgcaagtgaaggcagaaaaggtgcaagaggcggccttgcaaacgcaatacgacacagaatttgaatttgtgaagaacaagtatgctgcgcaagggatttctgatgaattggcaacgcaagcaactaaggaaatgatggccaacgatgccttggggacgacggtgcgtgagcgttatggtttcagtttgcaccacgaagtctcagcgattggcgctgcgatggcatcaatgattgcctttccgttggggtcattgttgccgatgctggccatcacgttgttcccggtgaaggaacgtgtcattgcgacgggtattgccgtattgattgcgttggcgattacgggttattcagctgcccacttgtctggtgccaacgaaaagcgggcgacgattcgaaatatcgtggccggcattttcacgatggtggtgacgtactatatcggaacgttaattggacactaagggggattgcgttatgaataataaagttaagacccatcaaacgatggaagaacgtttgaatgcgattcgtgccggtgtgcttggttcgaatgatggtattttgacggttgttggcgtgctgttctcggttggagcagccacaagtaatcaatttacaatctttatcgctggtttggctgacttgttggcatgtgcattgtcgatggcttctggtgaatatgcatcagtgtcatcacaagcggatgctgaaaaggtggttgtcgatcgtgaaacgcaacgtttgcgcgtgaacccagcgggagtgtctgaggatattcgtgccttttacgtgtcacgtggagtgacaactgaaactgccggcaagattgcagatgagttgatggccaaggcacctttggaaacgatcttggcaacgaagtatgatgtccagttgggccactacgttagtccgtggtcagctgccgtttcatctttgatttgtgcggccatcggtggagcgttcccgttattggcaatgattttggccacaccacgctgggagttcttggccacgattggtgcaacggtggttgccgttgcgttgaccggatatctgagtgccgtgattggtaagggattcccagtcaaagccattaagcgtaacgtggttatcggacttttgacgattgccatccattatggcattggcatgttcttctaattttaggtaaaataaacattaagtaagactgagtttatgctcggtcttttttgttaattggctttaatttggtaagctggaaggtaacaacaggagtgaggagcgcactgacatggcaacgacacgatatggacttttgggctacccggcccgtcattcaaaatcaccagcaatgcataatgccgcgtttaagcaagcgggcattgatgcgcaatacgatgcctatgaagttgcgccaaatgcgttagccgcaacgttcaaaagtttggttgcgtcaggcgtggctggtttcaatgtgacgatgccgtttaaggaagcaattatgttgtacttggatgatttgacaccattggcccgccgtctttcagcagtcaacactgtcgtgattcgcgatggcaaaacgattggtgattcaaccgacggagctggtttttggcgcacgctacgtgagccagctgatcaagtgattttgattgggactggtggcgctgcccgcgccattatggcgacggcacctaaatcagtgacgctacatgtgtttaaccgacaaagtgaccgtttcccggaaaaagctgcgatggtcaaggatttggcgggcgttgaattgcatgatttggatgaaatcgggatgtatttgccatatgccgatttgattgtgaacgcaacgaatgtggggatgcaatcagacatgtcgattctttcaactgaacaattctacgacacccaaccagatgtccaagtggttgatatcatttataaaaaagagccaacgccattcgtgacggcagctcgtgcagccggacgtcacgcagatgacggccttgcgatgttgattggccaaggtgcattgagttttgaacaatggacaggtcaactacctgatatcaacgtcatgaagcaggcaattatgccagctgaagaaggagagaagtaaatatgattttagtcatgaagaatgagcaagtagcgcaacaggttctcgcggcagcgacaacagccggcttgcaaaatgtgtacgtacatgaggaacgcgtgggttttgcgacgattaaaacgttggcgcaagtcccatttgtgaatgaagctgatgttgctgaagtgattgaaaagcacccagcagcgttgaagagttcacgtctttttcacccagctgatacggtgattacgacagcacattcaacaattggtggggacaattttgtcttgatggcggggccggattcgattgagtcagctgaccacgttttggcgatgggcgcagctgtgcaagaagcgggcgcaacgttgcttcgtggtgggtcatacaagccacgtacaagtccttatagtttccaaggattaggtgaggctggcttgcaaatgcaccgccaagcagccgatgccttgggtatggacatgattactgaaattatggatacgcgtgatgttgaaattgtcggacaatacaccgatattttccaggttggcacgcgtaatatgcagaatttcagcttgttgaaggcacttggacaacaaaataagcccgttgccttgaagcgtggcatgagcgcctcgattgatgaactattaagtgcggctgaatacatcgcgtcagaaggtaatgatcaaattatcttgattgagcgtggtatccgtacctttgataacaagtacaggcgcaatacgatggatgtgagtgccattccggttttgcaagaattaacgcattatccagttttggctgatccatcacacgcagctggtgtggcacatcacgtgacgtcagttggcttggcagcggtggcagctggcgcacaaggtctgatggtcgaaattcacgaccatccagaagcagcgtttgttgatggtgcccaagctttgacgccagcccaatttactgaattagccgacaaagcgcgggcgattcatgaaattgtgaggggataagatgattcaagtaacattacctgacaaacaatatcgcattgagattcaagcgggtttacgtcatgcgattggtgaacaagtggccaaggtttggtcaaaacgcaaggtgctgttgatttcagacgagcatgtcgcatcttattattttgatgtgacggcccaaaatttggcattgaatggctttgaagtagtaccagcagtgttacccgctggtgaacaaacgaagtcgctcgaagcagttaattatctggttggcgtgattgctgaaaatggctttacgcgccaagatggtgtgattgcccttggtggcggggtgattggtgatacggctggatttgtcgcgtcagtttacatgcgcgggattgcctttattcaagtggcgacgtcgttgacggcccaagtggattcaagcgttggtggtaagaatgccatcaatatggatgatgtaaaaaatattatggggactttttaccagcctgatttggtgattattgacccagaatatttagataccttagacgaccgcaatctaattgaaggctatgccgaagtggtgaaaacgtcagctttggctggtggcgagttttggcagtggaccggtcggatgaagacggtcgctgatgtgcgtgccaatgcgcaatggctgattgaacaatcagtccaatataaggctgacattgtgatggctgatgaaaaagaaggcggtattcgcaaggtgttgaacttcgggcacacctttggtcatgctatcgaattgatggcacacggcgaactacgccacggtgaagctgtcgcagttggcatggtgactatatcagaccgttttgagcgtgatggcaatacagaatcgggattgacggatgcgttggttgaacgtttggcgccagttggtctgccagtcttttcaccattgatcggtcaagacgatttttatgaccatttgaagaatgataagaaaaatcaatctggcacattgcagttggtagcccttgcggcgccaggtgagcctgtgattgttaaaaaagagttagcagcaatgaaagaattcgtggaaggaaacccagaataatgcgttatatgacggcgggtgagagtcacggcccagaagaagtggcaattatcgagggcattccagctggtttgcacttgacccaagaagatattaatacggaattagcacgtcgccagcatgccgctggtcgcgggcaacgccaagtgattgagacagatacggttaccatcatgggtggggtgcgccatcaagtaacgttgggttcaccaattgcgttgaatgtacacaatgatgaccacaatcactggacgaaaatcatggacccaaatacgccagctgacgaagaaaacagcaagcgtaaggtgatgcgtccacgtcccggtcacgctgatttggttggggggatgaagtatcgtcactcggccgatttgcgaaatgtattggagcgttcatcagcccgtgaaacggtgatgcgtgttgcggttggcgccgttgcaaagcgtttgttggctgaattaggcattgatgtgcacggattcgtcttgaacatcgggccagtgcgcgctgatgcggggcaaatcgctcagtataagacattggccgagctacgcgcagttacagagagtttcccaacgcgtacgttggatgctgaaacggatgagaagatgcgcacgttgttggatgacacaaagcgtgattacaacacggttggtgggacggtgcaagtgattgcgactggtgtgccagttggattgggctcatacgtttcagctgacacaaagttggatgccaagattgcacgcgctattattggcattaatgcgttcaagggtgttgaatttggtggcggttttgagaacgctgaaaagttcggctcagaagtgatggatgaaatctactggagtgaggaacgcggtttctaccgtggttctaacaatcttggtgggttcgaaggtggcatgaccaacggtgaaccagtggtggtgaagggtgttgtgaagccaattccaacgctttaccgtccaatgcaaagtgttgatattgatacccacgaagaccaccgtgcgtcagttgaacgctctgatacgacagcggttaccgccgctgccgtgattgccgagcacatggttgcgattgagttggccactgccattttggataaatttgatacagataatatggatcgtttgaaggagcaattggcggcgtaccgtgccgaaattaaaaacttctaagtcgccccgaaaggagttcgttatgacaaaccgacaattaaaaactgcagcaaccggcattaatggccagttaacggtaccgggggacaagagtatttcacaccgtgcggttatgttggggagtattgcaactggggagacggcgatttacgggctactcgattcagatgatgtccgaaacacattaggcgccatgcaacagttgggggtaaccgtcgactggtatgatgaccgtgtcgttgtgcacggccggccactcacaacgttaacggagccagatggaccgcttgatatgggaaattctgggacaagcacccgcttattgatgggcttattagcgaaccaatcatttccaatgacgtttgtgggggatgccagtttgagcacccgtccactggcgcgcgtgattgatccattgacgaaaatgggggcccgatttgtgtccactaatcatcgcttgccagtgacgacgatgcctggttttggcttgcacgggattcactaccgtttgccagtggcatctgcgcaagtgaagagtgctttgattttagctggcttgcaagctgaaggcgaaacggtgattaccgagccgcttgcaacgcgtgatcacactgaacgcatgctacaacagtttggcgtggcagttgcccgtgacggccaagatattattgtgacgccgaatacggcattgactggcacaacgattaacgtacccggtgatatttcatcagctgcgttttggattgtggcagcgttgttggtgccacatagtgaattgcgcttgactggtgttgggattaatccaacccgtgatggcattttgcgtttgttgcgtcgaatgggtgccgtgatcgaactggataatgtgattgcagaaggtgaaccaacggcggatttgattgtccgcacgcaagcccttcaaggaacggctatcacgtctgaagatattccgacggcggtcgatgaaattccgatgttggtgttagctgcgacgcaagcacttggcgacactttgattaccggggcgcaagaactacacgtgaaggaaacggaccgcatcgcgaccgtgaccacgcaactcaataagctgggggcgaatattgaagcgcgcgaagatggtttcttggtacatggtggcacgccgttacatgttgaggagccaacggtggtcgattcatcaggtgatcaccgcattggtatgatgctggcgattgctgccttgttgacggacggtgaagttgccttggcgaacgccgattcagtcagtgtgtcatatccaagcttctttgcggacctagaaagattggtggaagactaatgaaaacagcaattttgattggtttcatgggggctggtaagacgacggttggtcgcttgctagctgagatgctggccgtgccattaaccgataccgataaaatgattattcgcaagacgggacaaaccccaggtgagatctttgcaacagagggtgagccagcctttcgcgcactggagcatgatgtgttgcaagaagttattaataatgatggcattattgcaactggtgggggcattatcgaaacacctggtaatatccagctgttgtctgaagcaaacgtgccggtgttttatctatcaggctcatttggacaaacgatggaacgtttggcggatgatgatacgcgacctattttgcgttcaaagaccttgatggaagtggcggcgctttggcgtaaccgtttgccgaaatatgatgccgctgccagtcacgtgattgcgacagataataaaacagcagctgaagtcgcaaatgaaattcgcgatttactaggtgaataagatgacgaatttgaaaattggatcagcagttgcaacgcctgagcgtcccttaatagcagtaccagtcatgggtgaaaccgtgaatgatgtgctggtgatgctggaccaggccaatgagagccaaactgatgtcatcgaatggcgcgtggattatttaactgatccaggtgaattgcaggcaagtcaaatgcaaactatcgcttttaatgcggataagccgttaattatcacgtggcgaacaacagctgaaggcgggcaagaagactttgatagcatcgcttatcactgggtatatcagttagcgattgcaagtcgcgttgcggcggtggatgtcgaagtttcattgctcgaagaagttggggaggtggttgaagatgcgcagtcacaaggtgttactgtgattggctctcgtcattattttgacgcgacgccagctgatttagatgctgagttacaaagcatggttgcaacaccggttgatgttgtgaaactagctgtgatgccaaatgattctggtgatgtacaacgattgttggatgaaaccaaagtggccaatcaaaccaaaccattaatcacaatggcgatgggtgaacttggtcagcggtcacgttttgaaggctaccaatatggttcccaattaacattcgccagtcttggtgagtcatcagcaccaggtcaaccaagcgtgacacaattaaaagcacattttgaataaaccttatagtgctgaacggcaaaacgttcagcactatttttttgtgtacaagttttcagactagaactatttaactatcagttatttgtggcgtttcaaaataaccagtcttttgaacaatgaaagggcttgcatttgaaaattaggctcctataatgggtgttgtaagttggttggccggacaaatcaacccgactaagctgacgaagttttagctgccaacacagattttgttctaattttggaggatagcatcatgtcagaattgtttgacttccctaaggttgagtaccttggcggaaagaaggggattaactttttggacgccaagggatataacttctataaccctgaggagcctgtaactatcaacggagaaacaaagccaatgaaggattggttgaagttctcagttgcttactggcacacaatggaccaacgattggttgacccatttggtgaaggaactgccgtacgtccttgggatgttgacggtgttgatgatgtcacaagcatggaacaagccttgaagaaggttgattacatgtttgagttcatggacaagttgggcgttgaatactttgccttccacgaccgtgacttggcaccagaaggaaacacgttggctgagacgaacgccaacttggataaggttgtcgacaagattgagcaaaagatgcacgaaactggcaagaagttgctatggaacacatcatcattgttcacaaacaagcgtttcttggccggtggtgccacgacaccatttgctgatgtctttgcttatgctgctgcccaaatcaagcactcattggagattgctaagcgtttgggttcagagtcatacgtcttctggggtggccgcgaaggttacgagtcattgttgaacacggatacgaagcgtgagttggatcacatcgccaagttcttcaagttggccaaggattacgctaacgaaattggctacactggtcaattcttgttggagccaaagccaaaggagccaacggcacaccaatacgatactgatgtgcaaacgacgattgccttcttgaagacgtacggtttggaaaacgacttcaagttgaacttggaaggtaaccacgcatacttggccggtcacacttacgaacacgaagctcgcttcgcccgtgaagctggcttgttgggatcattggatgccaacatgggtgacaagcaaactggttgggatatcgatgaattccctaatgacatttatgaagcaacgttggtcatgtatgagttcgtcaagaacggtggtttgccaactggtggtttgaacttcgactcaaaggttcgccgtgcatcattcaagcctgatgacttgttctatgcccacatggccggtatggatgtttacgccgctggtttgcgtgttgcgttgaagatggtcgaggataacttcttggagaacatttacaaggagtgctactcatcatttgattcagggatcggtgccgactttgaagctgataaggtaaccttcaaggactttgaagactacatcttgaacaagacaaacgatgaaatcttcgcaacgattcaatctggtcgtttggaagctatcaaggcaactttgaacaactacatctactcagttttgggtacgactttcaacaagtaattttaataaccttacattctcaaaaataatcatctgtaaaaaataaaaaacgtgcccagcaggctactatgaacctgctgggcacgttttgtgttaataaggttttataatccatgccacaatggcatagccgacaatcaagatgatggcaacagcccaatgccagattggcaaaggatcagtcgcagtttgtgttcgtggaaagctttccgtgaagccatgtgatgtcatcgccatggccaagtcatcagaccagtgcagggcgctcacaattgctttgaaatacaattgtggactccaaaagtgataggtgatgccacgcaatgaggcggcgtaacgaatcgtttggacttggcgtcggacacgaggcaacaagttgaaagctgccaacaaaccataggtaaacgttgatgacaacttggcatgcaagtgcaaactgatgagcaaatctttcacgtgcgtggttaaggtcaacgctgcgccaagcagtagataggcgtagagacgtgaggcataaaccaacgcaatgcgatgcgtatcaccagttccaaacgcaataaatgaccaccacgttccgaaggcaagtggggcagccaccaacaacataatcacaataactttaccggaaacacgttgcgataatagatatagcaaaccaaccacggcaacgatgatgttcaacgtaattgattgactaaaggcggtttgaaaaccgatcccaatcagaataacgagcaaaacggtcggattcaacttaaacatgttgggtacctccgattagcgttagctgttggtcggcgaaatgcaattcataatcgacaaagcccgtcaaaccttggcgttgatgcgaaatcatcaaaacggtttgattagtttgctgaatcgtttcttgcaacaaagtcatcaacacattgaccgacgcactatccaaaccagcgagcggttcatcaagcaacaaaaccggttgtcccatgattaacatcgtcagtagttgcaacttcttttgttgcccaccggatagttggtagacaacatggtattgtaagtcgcttaattgtaacttctcaagcgcagctgcaacacggtcatccgtccagtaagtggctcgcaaactaaactttttcgacagcgcaatttcactggcaacggtcattgtcacgaattgatcaatagctgattggaagaccagcgcaagccgttgtgaccagtgcttttgtttaactttacgaccatcgacgttttcccaaagaatttggccatcatacgcgcgttgatgggtgagtcccttgaaaaatgttgacttaccaataccattagcccctgaaatcagcccaatctgaccagcgggtgcagtaaaggttgcgtcatgtagcaattggcgttcaccaactgccacaccaaagtcttgccagcgcaatggtccatcaccaactggtgtgccaacaaaggttggggcaggtgcaatgtcagttagcatatgacggcttgcttcgcacaatgtaccagtttgcgtgtcgagttggtaaagggtatcaaccaggtcggcgtacccagataagtcgtggtcggaaatcagaatcgtcgtgccgtttgtttgttgtaaatctttgagatcttgcaacaacaatcggcgggcatctggatcgacgttggcgaatggttcatcaagcaagatgatgtcactttgcatcgcgaaaattgtcgccaaggccacgcgttgcttttcaccaccagacagcgttagtagttctcggtccgctaatgcgtccaagtccaatcgcgcaatcgcatctgtgacacgatgctcgatgtcggcgacaggtaattgcaagttttccaatgcaaatgtgatttgctcacgggcagtgcgcatcgcaaactggcggtctgggttttgaaacagcatcgcaacccgcttagctttctcaaatggtgcgatcggcccgattgattgaccttctaacaagacgtcgccattcgtgacgacaccaccaaattttggaagtaagccagccattgctttgagcaacgtagacttacctgagccggaagggccgaccatcaggttgaaactaccgggtgtcaaatccaaatttatcttattcaaaatgtttggctgatcagcttcgtaagcaaagctgaaatctacaacacgtaatgatgtcataattaacgcttcatcaaacctgacttcgcaaccaaggcgttaatcaagtaaaccaacacaccggcaaacaacccaactgagatcaaacgaatcacgaacaacgtgatcaacatgccgggcttgtaggccatgtaacctgagttaaccaagtcccaagcaaatgtcacaatcgtgctcgtcaaaactgataggctcaaaccaagcttgctccaggtcttgtaaccagtgagggcaaaaccaagttctgaaccgattccttgtacgaaaccgtaaatcaacgttgcggcaccccagcttgagaagagcaacatttcaacgacagcggccaaaacttcaccgattgtcgtagcgccaaacttttgcaacaagacacccgccaatggaccggccatcaaccaaacaccaatcgtcatatcgttggcgtatggcttaagtggcgtcgctgacaagaagtagtatgaggcaccccataattggtagataaccccaaagaaaattgcaataatggctaggaaaataacatctcgaagcgcccaaccgcgcttgttttcaacaactgtttgcatgacgcaaacctccaaataatattccgaatcgcccaaagccatggaaataaaaaggaccccagcatcactgcaaaacgcagtccgatactggggtccgtttacttcaatcgtaaacaaaccaagctccccggcaggcattaccctgcttaggttccatgggtattatctcagccataacggcaccccagcttgtttgattcgttaacacaagtatagggggttaggcgagggtttgcaactgtccgcggaattcgtcgaggtggttgtaacctttttcagccataatggcgatcaattcgttgttcaaacgttcaaagatagcgggaccctcgaagtaaagtgacgtcccaactgagaccaagtcagcaccgcaaaggatgtggtcgtaaacatcacgaccgtttgtcacaccaccagtgccgataatcttgatttcagggcgcaaacgttgacgcaaggcacgtacgttcgcaagtgccgttggcttaacgatttcaccaccaagaccaccgaaaccacccttaggtgcgatgacaactgtgtccgtttcaggatcaacaaccaaaccgttaccgattgagttaatcgtgttcacaaaggccaatgggaaatcgttcaagatttcagcaatcatgtcgaagtgggcgatgtcgaagtaaggtggcaacttcacacccaaaggctttgtgtagaagctgaagacctcagtcaaaatctcgcgcgttgtgtcgaagtcgtaggccgtttgtggtttacctggcacgtttgggcaagacaagttcaattcgaccaagccgttaaagtcagaagcttgcacgtcacgcaacatcgccaagttatcagcctttgtcagaccagcgattgaaaggaacaatggcttttcgtcttggtgtgtaattgtgtagtccaagtagtaatccaagccaagatttggcaagcccattgagttgattgaacccaatggcatttcagcaaaacggatcccagcgttaccgtctcgttcagcaggtgtggcactcttcgtaaccaatgaaccagcgccactggcctctataatttggtccaattcagaagctgtttggcaatatacgccggcagcgttcaataatacgttgtcaaaatcaaaaccagcaatgctcgcagtcaaagttgtcatggctttttgtcccccaaaagtcctcttgtgaaattaaatttttttaagtctaccaggtttcaaggcctatgactacactgtattttgggtataacgttttactcgtgaattaattctcaaatgcagttaccaggcgaatttatcactgatatttggtagaatagaagtaacagtaaagtagctttttaagctaccgcaaaaaaatggaggaattcgttcgtggagtgtgaaattaagttattcggtctgtcagctaacaataagttggcgcgtgcagtggccgaagagttgcaccaaccgttgagtcaaattgatattcaacgttttgctgatggtgaaatttatgagcgagttttggaaagcgttcgtggcgatgatgtttacatcgtggcaccaatcgctgaagaagtgaacgacgctttcatggaaattatgattgtgattgatgcattgcgtcgtgcttcggctgggcaaatcaatgtggtgattccatatttgggttatgcccgccaagaccgtaaggcaaagtcgcgtgaaccaatcacagctaagatggttgcctcaatgcttgaaatgaatggtgttgaccgcgtggttgccatcgatttgcacgctgaccaattgcaaggattctttgatatcccagttgaccacttgcaagctgcaccattgttgtcagattacttctacagtcgcaacatgacggatgatttggtggttgtgtcacctgatcacactggtgctggccgtgcccgtaagtttgccgacttgttgcactcaccatggggtgtggtaaatgaccacgtggcaatgacaacacctgagtcacctgatgccattgttggtgaagtggctggtcgtcgcgcaattatcgttgacgacatcgtcgatactggtcgccgtgttcaaatgacagcgcgtgctttgcgtgcaaatggggccaccgatgtctttgttgtcgcaacacacgccgttttgtctggtgatgctgcccaacgtttggcggctgatgataacatctctcgtctggtctttacggacacattgacgctaccagctgaaaagcaaagtgctaagttcacgatgttatcagtggcaccgttgttagctgaagctattcaacgcattcacgataatcgcgctttggatgttttgctgaagtcacgcaataatccagaagctaagttataatgttaactaaggtatatgaattttaattaacttgaggggtaatcacatggtttatgcagctgcagataatcgttatgatatgatgccataccgtcgcgtggccgattctggtttgattttgccagcattgtcattcggactatggcgtaacttgggcgaccaaaagccacttgcaaactcacgcgaagtgatgttgaaggcgtttgataatggtattttctcattcgacaacgcatcaaactacggcccatcagatggctctgccgaagagacattcggtgctgtatttgagaaggacttgaagccataccgtaatgaattggttattacgacaaaggctggttaccacatgtggccaggtccactaggggagttttctggtaagaagacgttgacggccgcattggatatgtcattgcaacgtatgcacttggattacgttgacattttctatgcacaccgttgggatccaaacacaaacttgcgtgaaacggctgaagcattggacttaatggttcgccaaggtaaggctttgtacgttggtgtttcaaactacacgacggaacaagttgctgaaattggggcaatcttcgatgaattgcacacgccatttattggtaaccaaatgtcatacaacatgtttaaccgtgaagcggaaacgacggatatgttggccgaattggacaagcaccacgctggtttgattgcctacggtcctttggctgaaggtttgttgacggaccgttacctagatggcttcccagccgacatgcctttgcaccgtacgaatgctttcattaaggaagatcctgaaggtacggttgctaagttgaacgcgttgaacaaggtggctgcagaccgaggtcaaacgttggcgcaattggctatggcttggttgcttcgtgaccgccgtgtcccatcaatcgtgattggtgcttcatcagttgaccacttgttggacaacgtgaaggtccgcgataacatggatttgtcagctgaagagttggcaaccatcgatcaaattttgaagaacaactaattgaaagtgcctcattatccaagcgggtagtggggcactttttctgttatactaagttgataagtagtaagggagcgaacaacatgaagaagattacagttttgggttcattgaacgctgacacaattctgcacattccacatttgccacaacaaggcgagacgatggcgatggacgacgcctcaactgcccctggtggtaagggtgctaaccaagccgtcgctgcaaagcgtatgggtggggatgtcaactttatcggtgccgttggccaagatgcaaatgggcaattgcttttggatgcacttaaggcggatggtgttgatacaacccacgttgctgaacttgaaggtgtcgcaactggtgcggcttacatcatgttggaagctgactcacacaacacaattttgattttgggtggtgccaaccgccaagttaacgaatcaaacgttgaagctgctgaggataccatcaaggcatcagatgtgttgattgcacaatttgaaacgccaatggttgctacgttgaacgcctttaagagcgctaaggaagctgacgtgatgacggttcttaatccagcgccagcaacgaaggacattccagccgaattgtttgcggtgactgatttggtggtaccaaacgaaactgaagctgaaatcattaccggcattccagtgacggatgatttgtcgatggaaagtgctgccaagcgtttgcaagaaatgggtgctaagaacgttatcatcacagttggtgagcgtggttcttacttctacatggctgatggcgaaaatggtttcgtaccagctttgaaggtgaaggcagttgatacgacggccgctggtgatacgtttattggtgcgttgacgactaagttggacgctgatctgcgtaacgttgaggaagccgtgcgctttgccaatgcagctgccgcaattacggtgcaaggggctggtgcacaaccatcaatcccaacgttggaccaagttaacgcttcacgtgcataataaagaatgaacgcaaacgtcggacgcttgtccggcgttttttaacaggagaacaacaatgaataataatgacgtcgtgcgtcgcattcgttttatctacaacattaagaatgctgacatgattaagatttttgaacttggtggtttgacgattaccaaggagcaataccaagatattatgacgaagcaagaaccagatacacctcgtgatgaaaagttgtcacgtcgcgatttggagaagttcatgaacggtttgattatttcacaacgtggtgtgaagaaggatgaagatggccaaccagttgaacctgactacagcatgcaacgtgataatgacattaacaatgtcgtgattaagaagttgaagattgcgatgacttacagcaatgaagacttgattgagttctgggaagcagctggatttaaggtgtcaaagggcgaagttggggcgatgttgcgtcgtaagggccaccccaagtacttggttgccggtgatcaatttatgcgtaagttgctgggtggtttggcaatcacgttccgtgacggtgagacgactgaaattgtcgattagaaaattctaatatttttcgcaggctaagcactgaaaaaatactgctagtttgatatacttgcctcatcatatagatatgggggatattaacatggtagctgaattgaatttggaaattgaaccaatgcattttcaacgtattttggtaggtgtggatgaatcacaacaaggtcacgtggctttggcgaatgcgattcaccaagctgttgaggacgacgcaaagttgatcatcgcatcaattttggagttgggggagttgtcagcggttgatgtattgagcttgccaactgttcaagcggtagaagaccaattggaagccaacttggcacgttacaaggaatatgcagaagcgcacggcgtaaaggatgttgaagttgtctttgatagcggtcaacgtgccggtgaagtgttggttgaagaaatcgcaccacgcgttaacgctgacatgattatcgttggggcgcactcaaagaagggttggtgggaatcattgggttctcaagccgtttacgttgcgcgtcatgccaaggtatcatcaatgatcgctcgttgcgatttggaagagcctaagaagtaatagatatgaagccctgtgccacgttggtatggggttttaatttaggggtaagtcagaatggaaattagagaagcacagacattggcagattatgctggtattttgacaatcgatgaggttgtttggaacgatacaaatgcacccgttgccatgcaaaaatggccggatgccggtgaatttaaagccgcgatggttgctgaaggacgccgtcatggcgttgcagtggacgagaatgatgctgtattgggatacgttgaattttcgtcacgttttccaagtcatcattataagtgggacatcggccttggtgttgcgccggccgcccagggtcaaggtgttggtggccaattgttagcgtggctacaagaattggctcgccaagagaaaatgcacaaaataaccttacgcgtattggggacaaaccctaaagcaatgcgtttgtatgaacgagctggctttaagaaagttggtgaattgaaagacgaattttatttagatggtcattttgttgacgactatctgatggactggttcgtcgactaatgaaaagcacatggttgacatgtgcttttcttatttttcggaagtgaaaacctaaaaaacatcatacgtatgaataatttttgacttgtgtgaaaaaatactattgcttaaaaaacattcaccctgtatactaactcttgcgggtgagggagccccggttaagtgaaagtcataagccttcaatcggaagcgattggacgaaatcctttatgaattttatttagcactatgaactaatatcaaaagttaatagtacactggggaaaacctcgctatgagtttctaaaaacatagtaggagggtttgtcatgtctgaagaaatgacaaagaagccaggcttcgtcggcgatgcaactgctgatgcaagtttgggtgatgtgaatggttctgtggaggtaccaaagaacggttcattctggcgtaaattgtgggccttttcaggtcctggggccttggttgccgtgggttatatggatccaggtaattgggtaacgtctgttgcgggtggtgcgaattatcactacacgcttttgtcagtcgtattggtgtcatcattgattgcgatgatgttgcaatacatggctggtaagttgggaatggttaagcgcgaagacttggcccaagccacacgtgctcgtacgagtaagtcgggtggtttcgttctttggattatcactgagttggctttgattgccactgatattgccgaagttatcggaggagcgattgcgttgcacttgctgttcggctggtcaatgattgcgtctgttttgacgacagcgtttgacgtgttcttgctattgttgttgatgcgtttcggtttccgtaagattgaagcaattgttattacattgattttgactattttggttatcttcggttacttggttatctcatcaaacccagacatcgttgcgatgttgggtggttacgtgccgcaattgcaagctgtaagcacgcacgcgccaaagggtgttgattcaccattgttgatgacgttgggtatcgttggtgcgacggttatgccgcacaatttgtacttgcactcatcagtttcacaaacacgtaagattaaccgtgagaacaaggctgaattgaaggaagctgttcgcttcatgacttgggattcaaacattcaattgacgttggccttcgttgttaactcaatgttgttgattttgggagcatcattgttcttcggtcatgctgattcagttggaacgtttggtcaaatgtactcagctttgtcagatagcaaggttgctggtgcaattgcgtcaccaatcttgtcaacgttgttcgccgttgcgttgttggcttcaggtcaaaactcaacgattacgggaacgttgactggtgaagttgtcatggctggattcttgcgtttgaagattccaatgtgggcgcgtcgtgtgattacacgtggattggctttggccccagttatcgcctttacgttgatttatggtggtgacgagtcaaagttggacgtcctattgattaactcacaagtcttcctatcaattgccttgccatttgcgatggcaccattgattctgttcacatcatcaaagaaggtgatgggtgaagacttcgttaaccctaagtggatgacaatgattgcttggctagtgtttatcgttttgactggattgaacatccaattgatcgttgaaacggttcgcaacatgttctaatagattatttttcaagactttgcagcgcttgctgtgaagtctttttttgtctcaagtgtttatgtttgacatatcattatatctcgtataatatatactatatcgtaaatagtgttatatcacacgaaggagacgggtatgaatattcaagtaccgacgaccgtattggacggttcggttctcgcgattctagccaaggaagatacctacggctacatcatcacgaaaaccatgcaagacttgctgaacgtcagtgagtcgacgatgtatccggtgctacgccgcctgaagaaagatggttatgttgaaacgtacgaccaaccattcgaaggtcgcattcgacgttattacaaaatgaccgctgacgggcaagcgcatttgacagaaataaaagatagctggggcgcttttcgtggcgcagttgactcactattggaggaacaataatggttaatgagtatttagcagacgtgagaagttatatggctggggtgccagaaaacgaacgcgaagaactgctacagttttatgaggaacaaatgatggacgctgggttaacgtccgagcaaatcgttgaaaagtatggcacgccaaaggaatttgcccgcaagttgaagttggagtacttcattcaagtggacgatgcaccaggggcaactgatatgccagctggtaagcgaacaaagaaccgtgcaacgttgatttggttgatcattctggggttgtttgcatcaccggtcttgattcctgttgcattgatactaatcgctgctttgtttggtgtgtttatggcctttattggggtcatctttgcgatttatgcaacaattattgcagcattggcagtgggtgtcttttcatttgtttcaggtattatcttgctattccaatcagttgcaaccggcatcttcttcatgggagctgggattgtcgcaacggcagccacgattttcttcgcaccactagtttggcgcgtgacgaagtggttgtttgaacaagtgattgtctttgcaaagtggattggccgcaagttggttcgcaagaatcatgttgaacctgcacaggaggtgtaagcgcatggatttgaagaaaactttgattattggcgctgctggtatggtgcttggtggcgtgatgattgtgggtggcttgagtgccggtgctgaaacgaacatcgcttggaacaaggggcctaagattgttgacgtttctacgacgcacaagacgttcaaggatgcccaagtgcaaaaccttgaagttgatgctggtaacaacctcgttgaaatcgtccgcggtacagactggggcgttacggcgactggtacgtcaaacaaggtgttgactgatttacaagataagacgcttcgtattgatgcaccagatgacaatcacaaactgattttctctttcggcaactatgatccgaaggttacagttacggtgccattctcggctaatctggacaacctaaagattacgacaacgaatggtggcatgattgttcaaggtcaaaacgttaagaacacgacggtaagcaactcaaacggcggtgtccgctttgaaaacttgcaaggtgagcaactaaacatcacgacgacgaatggtgcgattgcacttgaagatacgaacttgcatgccgtgcattcaaagagtcaaaacagtgcattcaaggctgaaaatttgacattgacggatgcgagtgacatcacatcaacgaacggtatgattaagcttgaggatagccatttcccaggtttggatgcatcaacccacaatggttatgtgcacgttgaagatgtgcaaaacggtgacgatgacaagagttaccaaactggggatgcaacgaaggctttgaagattcaaacgaccaacggtgtcatctcaattgaaaattaatcacaacgaagtcggatttaacatccggcttttttgctatctcataaaaatctcatttttggtataatgaacctaacaaactgggggtccaaattaatgaagataaatcaatatgcggtggttgagactccgttcgaacaacaagtacacgaactgacggaaattggcttttatgatgagtcagtgaccgacgcgatgggtgctggggcggcagccgtttggcaggctttgttggtccaagcctttccggaatatcgtgacgcaacaccaaaattgcgtgaattagctgttgataacaatcgtgatgttgcgacatttttgcaaagtggggcgccactaacaactgagatttttgacgcagttgcattgcagttgcttggcttcacggaaactgttgattaccaaattgatcaaccactgcaagcagttcatgaaattggactaccgctatacgaaaagcgtggcaagtgggacgtggatgatgttcttacggcttggtatgctttgttgacgacgcacacatccggcgggttgcaatttatcgatgatttggccagccgtggttactttgctaagacgaatttgccactgtttttcaacgggaaagcaatggcaacttttgatacaagtgcgctgattaaagaagtcgtgtatgtcgaaacagatgtggatacggatgaagacggtgttcgtgatttggttcgggttgaaattttgcgacctgatacgtcagttgatgtaccagtcttatttacggcgtcaccttactatcaaggattgaacaacgaggcgaatgatgccaaattgcatacggttgatgtgccactaagtcacaagacaccaaacaaggtgcgctatgaagatattgcattcccaggtgtgacgctaccggatgctgagcaacatgaggttgttgctgaagctgatgaagcaacggaaagtttcaaggcaacgagtcatgttgatatcaataattacttcttggcacgtggttttgcggttgcgtattcttcaggtgtcggcacgcgtcattcagatgggatgcaagataccggttcgccagaacaagtgctttcaatgaaggcggttgttgaatggttggccggtaatcgcgtggccttcacagaccggacttcgggttatgccgttaaggctaactggtcaaacggcaaggttgcgatgacgggaaagtcatatttgggaacattggcaacggcggtcgcaactactggtgtggcaggtttagagaccgtgatttctgaagcagccatttcagattggtaccaatactaccgtgataacggtttggttattgcacctggtggtttcccaggcgaagacatggatgtgttggcggaattagtttattcacggatgcacgatgcagctgactggcaccgcacgaaggatcaatggacggctttccaagcccaaactgaccagatgatggatcgtgagtcgggtaactacaatgcatactgggatgcgcgcaattatttgccacatgtttcagacattaaagctgacgtagtgatggtgcatggcttgaatgattggaacgttaagccacgccaagtattccgtttgtggcaagcattgcaaacaagtggcgttgccaagaagctgtacttgcatcaaggacaacacatctacatcaacaacaatcgttcgcttgatttctcagatcaaatgaatttgtggttgtcacacaagctttatggtgttgcgaatcaagccgaaacgcaattgccggatgtgacttggcaagcgaatgaccaagctgaaacgtgggaaacacgccaaagctgggggcaaactgaaacggttgctttgccactggctggggatgatgagatgagctacgaagattggcaaattgaatctgatttcgagagttacaagcgcgactttaataactggcgtactgaaatgttgaagcaagaaaacgaccgctttgaagtaaatcgtttagtattcaccgaagcaccattcgaaaacgatgttgtgattgatggtgaagtgacagtaaagttgcgtatcaagtcatctgaaaactttggcttggtgagcgcgatgttggttgactatggcgaagcccaacgtttaggtgcaacgccaacgccacttggtcaacaaattgaccgcggtacggaatggcaaccaacgccattggtagagttcaagttgcaaaagccaacgactgaaaagatgattagtattggtcacatgaacttgcaaaaccgcactgcgccatggcaagttgatgatttggtagctgatgagtttgtgacgcttaacttgacgttgcagccaacgctttatcgtttgaaggcgggtcacaaattgggtgttattttgtacggtacggattttgaaatgacggtgcgtggtaaccaagatattcgctatacagttgatactgtcaatagcgagttattagtgcctttccaacaataaatttatgtgaaaaaagactttttggtatacttgtgccggaaagtcttttttgaggtgagagaatgtcggatatcatcattatatttgctgtattgctgggtgttatcctagcgagtattgttgcgaatcgactgaagaaagtgccaaaagcatttataacaattgcgattggttttgcactgtcattcgttccctatattagagaacacgtggcattagagtcagagtttttcatgatgtttatcatcgcaccaattttgtattatgacgcacagcgttttaatccgtatcgcgttagcaaacatcttcgatcaattatttacttggcaggatcactcgtgattttgacagcgttggtgacaacgttaattggtgtgccggtgggattggcacattcaattccgttgtctttgctgattgcgtcaatcgtgacgccgacagacgccgtagctgccaattcaattaccgaaaattttgcggtacctgaaggaacaaaaacggccttggagtacgagtcattgttcaacgatgcaacgggccttgtgctgatgagtattgcgttgaccggtgttgaagcaaatcgattgtcactaacagcgggcgtatgggaattaatcaaagttgcgggtggtggtgtcttggtcggtatgatgctaggctacctgatttacttgctaattgattttattgcttctcagactagtgattcaatgagttccgttgtgccgatgatgataatgacaccatttattgcatactttattgccgagtcaattggtgtttcaggtgtgctggcggttgttgtagcagcaattttccaggtgcaacggacaatgcgaacgcgtctgtcgttggtgcatgatggcctaacgagtcgtagtctttggcaagtgctatcaagtgtgttgaataatgcggtttttgtcctgctagggatgaatatattcaatgtcattgatttaataaagaacatgacaaaatcagaacttctccattcctctgcattggctgttttgtcatatttcgccatgcttatcgcgcgtggcttgttggcttattaccggcatgaagaaacgtggtctgagttgattggtccggatggttctagcgagcgacgtcataatgcggtgacgtttgcgctgtcgggtgttcacggggcagtgacgctagcattggcgttttcaattccaaccaacgtaccgtttcggcctggtttgatactggcagctgctattgtgattggtttgagtttgattgtgccaaccctggttctaccgttttggttgccggctaagcaagcgcctgtaacggttgacgacttgcaagaggcacgtctggaaatgtttgcggccactaaaacagaactcaaacagaagcagctgcccgaggaattatatttgggaatcgtggaatatttgagttcacaggtgcgaccaaaccgtttttcaaaaaatcagcgcttatttaatcgtttattgcaagataccgcaaaggcgtcacgtacgtatgtgcagacgataacggctgtggacccggcaatcagacatgcctatttgcatctgattgacctgatgctagctgaagaattgtcatttgcaccatggcgatcacttaaagcgactctttctcgacgcgaattaaattgggtctttcaacgttatcaacaacggggcattcacgctggcatgacgaatcaagaacgtgaagagaaacggtcagcgaacattgctgagttacagcaacaatggcgcagtatctcgaatgaaaattcaacgtacatgatggcttgggtaacagaacgtcgaaatgaagtgggggatgttggagctcacgatgcgtgggaacgcattttagatatttatcgatttagacatgcatccttgttacgagggctgaatcgcgtggaactgaagaaagaacacattatgaaggcacttaactccgaaatgcagtatgtcttacgtcgtctgtatgatggcggtttttcacaagaaattggcgatcggcttatccaggaaattgctgaagcacaagcgtggcagtcacaacaaaccatgcttgatccaaaacgtgcgggaagacgggtattttagttacgcccattcagatatgtgctaacatagtaccaattgagtcaaaagaggggtctaacgcatggaacgcaaactaatcggaattgatttggataagacaacattgaatgacgcaggtgaggtttcagaccgtacccgtcgtacgttgcaagctgcacaagcagatgggcacattgtgtcgatcgttacggggcgtcccgtacgtttgtcgatggatatttacgacacgttgggcttgaagtcaccaatgattaacttcaacgggtcattgggtcataagccacgccaacattgggaacacgagtattcatttaatattgatcgtgaaattgcgtttgacctgcttgaaaatgcacaaatgatgggtattgatactgtcgttgcggaaagcaaaaatgatgtgtgggcaaatggtaatggcccacaacgtaatacggaagatgcgattttcttcccacaagacgaagcgaaccgtaagatgttggatcgtttgaacttgcaaacggatgtgaatgccatcttgattcacgccgaaaatgccttgcaccaatcacaaattcaacactttgtaacggagcgctacggtgctgatcgcgtgaacgtgaagacttggggtggtgaatcaccagttcttgaagtggcaccagctggtgtttcaaaggatactggtttggacatcttgcgtaaggcttacgacattaagaaggatgatatctatgcctttggggatgagatgaacgacttcgagatgattggttacgcaactcacggtgttgtgatgaagaacgggaaccctgaactaaaggcgattgccgacgatatgacagaatacactaacgaagaagacggcttggctcgttatcttgagaagctgttgaagttgtcattgtaattattgaagtaaagttccacgatgcaagggactatgttataatttagacatagaaaaagcctaacgaagtggcagcttcgctaggccgacaggttcctaggtttggataatggggcgtctactgcttacgcggtggacgcttttttcgtgtctcgaagttcacataataattaccaccccaaaccgcaacaggtcaggtttttaaaataggtgaaaaacgtgtaaaataaataagaatacttagatttaaggagataccgaatggcggagttaccagaaggatttgaagaaaaataccgtcaattacttggcgatgaggcagatgcttttattgaatcgttcgataagcctgtcgtgaaggcgttccgtcaaaaccctttgaaggccaacatggatctatacgataccaaggccgatggcaaggtgccatgggggaagtggggaaactttggtgccgtaaagggccactctgtcgatcacacaacgggtgtcatttactcacaagagccatcagcccaattggttggtgaacttgcacaccctaagccaggcgagcgcgtgctagatttggccgctgcacctggtggaaagaccacgcacttggcctcatttatggaacaaaagggactattggtctcaaatgaaattttccgtaagcgtgcggctatcttgagtgaaaacgtggagcgctttggtatccaaaacgccattgtgacgaaccactcaccacaagagttgtcgccaaagttcccacaatacttcgacaagattgtgttggacgcaccatgttctggtgaaggcatgttccgtaaggacccagctgcaattaagtactggcacgaacactacccagaagaaaacgctgcgcgccaacgtgaaattttggaagaagccgttaagatgttgaagccgggtggccaattggtttactcaacttgcacgttcgcaccagaagaagatgaacgtatcatcgcttggttgattaacgagcgccctgacttggaaattgttgatgccgacaagtacgaaggtatggatgatggaaagccagaatgggccgatggtaaccctgatttgaagaagacggcgcgtttgttcccacaccactcagatggtgaagggcactttatggccaagttgatttcaaatcaaacggatgaagattacgtttctaaggaacctaagttggctaagtctaacttgaccaaggatcaacgcgaattatggcaagcattccgtgcagatttcatgccggattacgacccagaattgttgattgcctttggtgaccaaatctacgcagcgccagaaggaacgcctgatttgacgggacttcaagtgatgcgtgttggggttcacttgggaactttgaagaagaagcgcttcgagccaagtttggccttagcgttggcacttcacccagaccaatttacgcgtcgttacgaattgacagacgaagagtgggcgcaatacgttcacggcgatacgttcatgattcgtgaccgcgaccaatatcagaacggttggtacttgcttgaaatcggtggtaatggaactggttttggtaagttggttgatggccaaatgaagaatttctatccaaagggattgcgcttcttggttcgtgaagataaagcagaagaattatctgacgatatgtactaatagtgcggttttttggtaaaataaacctattacagcttgaaaggaatacacatggcaaacgagcaaattacacgtgaagaagttgaacacgttgccaacttggcaaagttgactttgacggacgctgaagccgacatgtttacagaccacttggagaagattttcgaagtggtgacgactttggctgaagttgatacggagggcgtaaagccaacgtattcagtgacagaaatgcacacagttttgcgcgatgacgttgcggttaacgcacaccaatcagcagaattgttggcaaatgcaccagaacacacggataccttgattaaggtgccagctattcttgatgaaggagcagagggctaatggatttcttgcacacagatttggaaaccttgcacgagcaactcgttaacaaggaaattacggccgttgaattggcacaagcaacgttggataacattgctgccacagacgacacgtatgaagctttcatcacggtgatgaaggacgaagctttggcagaagctgctgcaattgatgaagctggtatcgacccagacaacatcttgtcaggtatcccatacggtatcaaggataacttggtaacgaagggtgtgacgacgacggcagcctcaaagattttgcaaaacttcaagccaatttacgacgcaacggttgttgaaaagttgcgtgacaacggcgcagttggcgttggtaagttgaacatggacgaatttgccatgggttcaacaagtgaaacgtcatactaccgaaagacgaagaacgcttgggaccaaacgaaggttcctggtggttcatcaggtggttctgccgttgctgttgcagctggtcaagtgccatttgcattgggaactgatacgggtggttcaatccgtcaaccagcagccttcaacggtattgttggtatgaagccaacgtacggtcgtgtatcacgttggggtgttatcgcctttgcgtcatcattggaccaagttggtgtcttcacacgtacggttaaggacaacgcccgcgttttgtcagctatggatggtcaagatgagaaggaccaaacgtcttcagaccaagtagtacctgattttgctgctaacttgaacggcgacatcaagggcatgaagattgcggtgccagctgaatactttggtgccggaatcaacgaagatgttaaggcaacaatcaaggctggtattgccaagcttgaagagttgggtgctgaagtcgaagaagtatcattgccacacacgaagtacggtgttgcagcatactacatcttgggttctgccgaagcttcatcaaacttgcaacgtttcgatggtattcgttacggcttccgtcctgaaggtgtgaagaacttggacgacttgtacgttcaaacacgttcacaaggcttcggtgacgaagttaagcgtcgtatcatgttgggaacgtactcattgtcagctggaacttacgatgcattctttaagaaggctgctcaagttcgtacattgatgaacgaggacttccaaaatgtcttcgctaagtacgatttgatcatcgccccaacaacaccaaacgttgcttacaacttcggtgctaacgaagatgatccagaagtcacttacatgaacgacgtattgacgattccagttaacatggctggtttgccaggtatgtcagtacctgccggcttcgttgatggtttgccagttggtatgcaatttatcgcaaaccgtttccaagaagagacgatttaccgtgctgcatacgcatacgagcaagcaacgcgtttgtttgaacaagtaccaggaggtaacaagtaatggctgtgcctaactttgaaacgacaatcggacttgaagtccacgttgagttgaagaccaactcaaaggcaatgtcaccttcaccagttcaatacggtgctgagcctaacgccaacacgaacgttattgactggggttaccctggtgttttgccacaagcaaacaagggtgcgttggaatacggtatgatggccgctttggctttgaatgctgatgtaacgcgtgacttgcactgggatcgtaagaactacttctacccagataatccaaaggcttaccaaatcacgcaacaacaagagccaattggccgtaacggttggttggaaatcgagtttgagggtgagaagaagcgtgtcggtattactgaacttcacgtcgaagaagacgctggtaagaacacccacgggacggatggttactcatacgttgacttgaaccgtcaaggaacgccattgatcgaaatcgttggtgtacctgacatttcatcaccagatgaggcctacgcataccttgaagctttgcgccaagctatccaatttacgggtatttcagacgttaagatgcaagaaggttcaatgcgtgttgacgccaacatctcaattcgcccagttggttctaaggaatacggaactaaggtcgagttgaagaacttgaactcattcaactatgttcgtaaggctttggcgttcgaagaagagcgtcacgctaagatttacatggctggtggcacaatcaagcaacaaacacgtcgtttcgatgaagcaacgggtgaaactgttttgatgcgtgagaaggaaacggctgatgattaccgttacttcccagaaccagatttgacaccagttcacatcacggacgaatgggttgaagaagtgcgtgctaagttgccagaatcagcaactgaacgtaaggcccgttacgttgatgaacttggtttggaagtgtacgactcagaagtgttgacgcaaacgttggccatggctaacttctttgacgcaacggttgctgagggtgctgatccaaagcgttcagctaactacttgatgggtgacgttaacgccttcttgaacgagaagcaagttgatttggaagagactgctttgacaccagctcacttggccggcatgattaagttgatcgatgacggtacaatctcaacgaagatggctaagaaggtctttgcagcaattacgcaaggtgaagacccagttgaatacgttgaagctaacggtttgaagcaattgtcagatccagctattttgacgccaattattgacggcattttggatgaaaatgagcaatcaatcatcgacttccataacggtaaggaccgtgctgttggtttcttggtcggaaagatcatgaaggaaaccaagggtaacgccaaccctaacgtggttaacgagttgttgatggctggtttgaacgcccgtaagcctcaataagcttaagagcctatttacaaaacataagattaatttatgcagacatcgatatacttggtgtctgcaatacatatattgaaaacttgaggagagaacaccatgaagcgtgcgcgtatcatttacaatccaacgtctggtcgcgaagccattcgtcgcgacttggttgatattttaaatgtctatgaaaaggctggttatgaaacaagtgcttttgcgacgactgctgaaccaaattctgcattgaatgaggcgcgtcgtgctgccgaagctggttttgagttgttggttgcagccggtggtgacggtacaattaacgaagttgtgaacggtattgccccattggagaagcgtccaatgttggcgattattccggctggtacaacgaatgactatgcgcgtgcattgcgtattccacgtgaagatcctttggaagccgctaaggtgattttgaagggtaaggcagcgcaaatggacgttggacaagctaacgacacttactttatcaacattgcagctggtggttctttgtcagaattgacttattcagtgccatcaaagttgaagtcaatgtacggttacttggcctatgtcgttaagggtgccgaaatgttgacgcgtgtcgcaccaatgaacttgcgtgttgaatacgataacggggtctttgaaggtcgttcatcaatgttcttcttggcattgacgaactcagttggtggtttcgagcaaatcgtgccggatgcgcaattggatgatggtaagtttacgttgttggttgttaagacgacaaagtttgctgaaatcttgcaattgatttctgaagtattgactggaaagcacgtcgataatccaaacttgctttacgtgaagtcagaaaacgtcacaatcaagccattggatgagaatgctaaggttatgattaatttggacggtgaatacggtggggatgcacctgttgtattcaaggatcacaaggcgcacattgcaatggttgcaaacgtggatgaaatgccagatgatagtctaattgatttacctttgtatttacacgaaaattaattaattttgtagacaagagcttgccgaacaaaggtgggctcttttttggagaaagaatgatgtttggtaaaactaaaaaagtcgaacaaccagcgaattcaaagcaaacgtactataagcaattggcccaccatataaagcgtgcctgggatatgcaagtagccattagccaaattgctgcccaatcaaatgatgcgttaacaccacaaagtttgtacgtctcagtgcaacagccaaatgccaagcaacagaatggggtaacgccgtttacaatgtatgttgaggctgaagatatggtgccactgcttgagaagaagttgaacgaccagctgtcagtcgcggatgaatatcttgaatcattggaattaagtgattcattaaccaatcatgatcaagcgttggtagcagagctccgcgagatgcaacaagcgggcaaattagcggatatgttaaagacgttgttgaaccataatgtggtcacacgtcatgatttgcattaaattcatgaaattaacatacaaccatcgagcgtaaatagttgtttttccacagaattggactattataaatatacagcgtaatcttaaacggcatcctgcaccagggatgccgttttttaattgaaaggaaagcgccatgaacaaaacagacaaactacaaccgctccaagagatggccattgcgtatgcaaattcattgcctggggccaaggcgtattggcgtgaagattgggaaacatactatttcgatatcatgggaaagatgtttggcattgtgcatgacaatgtcatcacgctgaagaatgatccttatatcaataccgaattgcgcgaacagtttccattcatcattccgggttaccacatgaacaagcagcactggaatagtattgttgtcgataaaaacgaatttcctgatgaaggggtcaagaaactaattcatgattcctataatttggttcttaagaagatgactaagaaacaacaagccgaattacaattacgcattgatttggggcagctataacgacacataaaaacgccttggacgtcgaaaatgacatccaaggcgtttaattgtttacttatcgttaccagtcaatccgttgtagatcgtctcagcattgtggttcaacaaatcgtagtacgttggcacaacgccagacttctttgaaactgagtccgtccacaattcaccagcgatgtgtgaatcaatttgtgaaataacagtttgcattggcttgtctgactcaccttgctcaacgaaggttgcaggaaccttttcgccttgcaatgattcaactagcgtacggatttgtgaaggcgtaccgtttgattccgtatcaatttcccaaatgaagtatggcttcaaaccaaagtcacgggcgaagtatgccatggcaccttcttgcgtcaccaacttcttgtcatcagcaggtagggtagagaacttagcgttccacttctcgtaaaggttttgcaacttagcttcgtatgctgcagcgcgctttgcgtagtatgccttgtgctttggatccttcttctcaagaaccttagcgatgttagcagcgtaagtcttaccttccaagataccgttccaagcgtgagggttatcttgaccagcaacaccagccgtcgtcaacttgatggtgtcgataccgtcagttacgttgaaaatttgcttaccgtagtgcttgtcagtcgtcttcatcaacttatcaaaccaacctgagccacccttttcaaggttcaaaccgtttgcaaagacaacggctgcgtcctgtgtacgcttaacgtcagtaggcgtaggatcgtaatcgtgttgatcagcaccaattgctgtgatggtgtgggcattaacgtacttaccaccaacttcttggctgatttcgttaataattgaaaatgaagaaaccacattcaaacgaccgtcgcttgaacgaccatcagaagctgaattgcggtgcgtcaacccaaatacaacaccagcaataacagcgatagcaacaataatcccaataactcgcttcataataaaactcctatttagtagcttggtcatgcatgcgacgacgcgtaaccaagtgaatcaaaaacgaaataataaaaataaccgcaccagtgacaacaattgctggaccagaaggccagtcaaaggtgtaactgaggaacaacccgacaaaggcgctaatcaaaccgaagaatgatgatagccaaatcattggttggaatcgcttgaccaccaatcgggcgctggcagcgggggtgataagcaaggcagttaccaagataaccccgactgcacgcaaggcaacaatgataaccaacgtaatcaagaccactaagatgttgcggaatagattagcgtgaatcccttgtgcctgtgcgtatgaacgatcgaatgttgttaagtacaattcacgatagaaagtcgtcacaaccgcaatgacaatcaagccaatcaccaaactagaaatcaaatcaccgcttgaaacggccaaaatatttccaaatagaatatcggttagcttggttgttgaatgcccggctgtcatgatgatggttcctaaggcgaagaacgtactaaacgttaaaccaatggcggcatctgtttttaatggtgtgtgttcagaaatgaaattaatcactaaagcggctaataagccgaacacaccggcaccccagtaataggggatgcccatcaaagccgcaatggcaattccgggcaggactgcgtgggacatggcgtcaccaatcaaagcagtaccttgcaagatgctaaatgcaccaataataccggcgattaaaccaatcatcgcaccagcaatcagtgcattttgtagaaaggtatattcaccaagtgcgtgaaagaaattcagtaacgcagacatattaacctccctgtacgatgtgattatgacgatccatgataattaagtgatcaccatatgcttcggacaaagtggcggcatccatcacatcttcgggttttccttgacggagcagaccgtggttaagcaggatgactgagtcaaagtagtttgcaaccttactcaagtcatgatgcacaatgatgattgtcttgccggcatcacgtaaatctcgcaatgcatccatgatttgtgcttcagaggccacgtcgattccaacgaacggctcgtctaataggtagacatctgcatcttgtacaagagcacgagctaccaaagcacgttgacgttgcccaccagaaagctcgtttaatgagcgattagccaagtgggcgatgtccattttctcgagggcgttttggacgattgcttcttcagctttaccgaccgaatgccaacgagagatttgcgatagcacgcccatcatcactaaatcgaaaacattaactggaaaatctaaatccaagtcgcttcgttgggggacataggcgaatttatcgcgacgtacacgcccagtaactggcgtatcgtcataggtaattgtgccggcagtgggctgaataattcctagaatcgctttgatgagcgtcgacttaccagcaccattaggtccgataataccgataagctcatttggattaaaagaaagggacaaatctgtgaaaacaggtccgtattcatagccaaccgtcaagtgatcaacgcttaacatatgccattcctttcatgcatacttacttattcaaagtaaaaatagaataacgagtaacaatgtaacagtttttgtccggaatgacaaatgaaaatgtcatcatattatatatgaaataaataacatgttttatatatccgaacattgcttgtttagaaggacaatcgcagaaaagattcgtccaattgttccgcgggtcgctttatatggtagaattaaccattagaaaagcgagtttgttggcattattatagcgaatgccaacacgtaatgtgtgtttgtacacttcaaaatcttctatatatagtaaggacaggaaaaaatgggtacagctgagacttatcaacagattacaaagaagatggacggcccttggcgagttcgaccagaagctggtaatcgtgttggcatgttacaagaaattttgcgctggatggggcatcctgaaagcaagttgcgtgtgattcacatcgttggaactaacggtaaagggtcaaccggtgttatgttggccaagattttggtgacagcaggctataaggttggtcacttttcaacgccggccattttgaacgaccgtgaagtgattacaacgaatggtgacatgatcagtgaggctgatttcgttagcagctacaagcgtgtcctagaagaagtcacagcacacggcggggacgaagatacgctatcgaagtttgagtggtggacactcgtagctttggactacttcgcccgcaaagaaatggattttgtcattcttgaagccggcgtcggtggtttgcgtgatgcaactaacgtgattgaaaagccattagttgtggcctttaccaagatttcatatgaccacgttggcttgttgggtaacgacttgcttgaaatcgctcaagataaggccggcgccatcaagccaggagcaagtatcgtcaattacccaggccaggatattgaagtgtaccacttgttgcacgataaggcagaagaagtaggcgcaatttggaatccaaacccaaagccggtgattacaattgtgcaatcatctccaagtggattggtcttgaacgctgaccaattcgaagggttgaagttgtcattgacgggtgcttaccaagccaataatttgagtacggttttgcaaattgttacggtccttaagagtcgtggctttgaaatcaaggatgtagacgtcgctgaagcgttggcccacgttaagattcaaggccgtatggaatttgatgcggaacgcaacattttgtatgatggtgcgcacaacccagacggtatcattagtttggtcgcgtcaattcgttcatggcacttgccatttaagccagttgttgttttggggttgctgaagggtaagaattaccacgacatgttggaagaattgttgccccatgttgatacggtaatcgctgttacgccagattctgatcgtgcgatgtcagccgatgagttggccgctaagattgtgatgatgagtaatgtcgacgttgaaatcgccgacgacccaagtgctgccattacgttggcgcgccgtgttcgtgaatcatcagaagccttgattctggttaccggttcattctacacactacgcgcgattgaatctgaagggatgtaagacatgttaaagcgattggtaattgcctcgaataattcacataagacggcagaaatggttgattatctggcagttttgggtgttgaagcgattaattatcgtgacctacatgagcaaatcgcctttccagatgagacaactgatgacatggctcaaaacgcacgcgtaaaggcgcaaacaatccatgaaattttgccagatgaatacattttggcggatgattcagcgttgtttgtaccggcgattccggatcattttggtgtgaccacgatgcgcgagtttcaggcacaccaattacgtggggatgcggaaattaacgcgtatgtgttagcccagttgccagatgatgctgaccgaacagcttatttgcaagctgactttgtcgtgatttcaccaacgggtaagacgtatttcagtcaagcgcgcggtggtatcacgttggcaactgaaccacgtggtgggcgaaacggcttggatgagttgatggtcacagaaaacggtatgacattatctgaaatcgacatgccggagcgtgtacattatgctcaccgtggtcgcgctgccattatgattttgcaacagcttaaagcagctggtgaatggcaataataatatagatagataatgaagaggagagataggataaatggaactcacagcacaacaaattactgagttgttggccgatcaagatttgttgatttcagcgccaaactttgatggtgaggtcaagcatttagcctataattcaaacgatgtagaacctgaaacgttgctctttattaagggacgttttaaggctgaatatttgactgatgctatccaaaagggcgttaaagcattggtcgccccagaaacttttgtccatgacacaacactaccaacttgggtggtggacgacgtggcagcggccatgagtattttgagtatggcgttttatggttacccacaaaacgaccttgctttgattggtatcacgggtaccaagggtaagacatcggcaacttatatggcttacgaaatgctacgtgtggcaacgaacgacaaggttgcgttgtcatcaacgttgcaagtcattacgggagctgatccaaagttccactatcgcgcccacttgacgacaccggagtcattggacttgttccgttggatgcgcgaagccgttgataacggcatgacgcacatggtgatggaagtgtcatcacaagcgtacaagatggaacgtgtttatggtttgcgttacaacgtgggtattttcttgaacatcagtccagaccacgttggtgaaaatgaacacccaacctttgaggattacttggaacacaagatgatgttgttcgatcactcagaacaaatcattttgaatgccgattcagaccactttagtgaattgattgaacatgcggaaatggctgtaccacgtgatggtatttggctatacggtcgcgaagatgaggattcaccaaaggctgacgtttactacgaaaccgttgaagccgacttgcaaggtagcacgtttgcggttcgtcaagctggtcaacaagcggaacgtcttggtatcgctggtgaataccacttggatatgccaggcgacttcaaccaaggaaacgccgtagctgcgatgattgcagcacgtttgactggtgctgatccagatgccatgcgtgaaggactagaagttgttaagattcctggtcgcatgcaagtgttgacgtcagctaatcacggtacaatttacgtggactacgcgcacaactatgcgtcaattgcagcgttgttgaactttgtccgtcaaaacgaaacggtcgaaaagttgacgattgtcgttggtgcgcctggtaacaagggtgtgtcacgtcgacctggtattggccaagcggtcagtgaaggtgccgatgtcgtttacctaaccagtgatgatccacaatacgaagatccaaatgcaattgcagatgaaatccaagcagccatcaccaacaaggatgttgtgattaaccgcgaaatggatcgcacaattgccattactgaagcaattaaggcagccggttcaaatgatgtggttgtgttggcggctaagggattggatgaataccaaaaggttggtggcgttgatacaccatatgaaaatgactgggcagttgcacaacgtgttgttaacgaattggaagcctagtttttaatcacaaaatttggtataatatacagaattgccgatagtatcggtgattttttatgtttaaaacagtgaataaatgcattaaatgtgcagagattaaaaggggatagtgccatggctaaggaacctgcagaaaatacgtcagagttcgacttgggtgacttcgttgaaggtaagaagtttgccaacttcgaacacgactttaagggtatcgttgaaaagatttacgaacactcattgttggtcttgattactgaaaacgacccagaagatacagcgacggttaacgaatacaaccaccgcgctgttgtccgcatgtcagaaactaagattttggtgaagacggacaacccagcaccacgtaaggctgatgaaactgaagaggaagacgaagaagaaatccctgaagacatcaagcttgaagatgatgatgctgaagaagaggaagaagaagaggagtaaccgatggactataagaatcaagtggctcaagccgtcgctgcggttgtgcctgaactagatgaagcaacgattttgtcaaaggttgaagtgcctaaggattcatcaatgggtgattttgcctttccaacattcttgttggcaaaggaacgccacatggcacctaaccaaatttcagctgaagtagctgaggcaatcgatgcgtcaaactttaagcaagttgaagctgccggaccttacgttaacttcttcttgaaccaagaaaactttggtgccgatgtgttgcacgctatcttggaaaaccaagaatacggtcacaacacggatggtgaagcaggacacgtaacgatcgacatgtcatcacctaacattgctaagccaatgtcaatgggtcacttgcgttcaacggttatcggaaactcattggctgaaatttcaaaggccaacggttaccaaccaatcaagattaaccacttgggtgactggggtacgcaattcggtaagttgatggttgcctacaagatgtggggatcagaagctgaagttaaggctgacccaattaacacgttggttaagtactacgtgcgtttccacgaagaagctaaggaaaacccagcattggatgatgagggtcgcgcttggtttaagaagttggaagacggtgatgaggaagctcgtcaattgtggtcatggttccgtgaagagtcattgaaggaattcatggagctttacgagacattggatatcgagtttgactcattcaacggagaggctttctacaacgacaagatggacggcgttatcgacaagttgaaggaagaaggcttgttggttgaatctcaaggtgcacaagttgttaacttggataagtacaacttgaacgttgccatgattcaacgtactgacggtgctactttgtacatgacgcgtgatttggctgctgccatcttccgtaagaagaactacaacttcgtgaagtcattgtacgtcgttggtggtgagcaacgtgagcacttcatgcaattgaaggccgtgttgaaggaaatgggttacgagtggtcagatgatgttgagcacatcccattcggtttgattacggttgacggtaagaagctttcaacgcgttcaggacgcatcatcttgttgaaggatgttttgaaggattctgttgaattggctttggagcaaatcgaagagaagaacccaactttggcaaacaaggaattggttgctcacgaagttggaacgggagccgttgtgttccacgatttgatgaacgagcgtatcggaaacttcgactttaagttggaagaagtggttcgtttcgaaggtgatactggtccatacgtccaatacgcaaacgcccgtgcacaatcaatcttgcgcaaggctggtaaccctgaacttgatttgtcagatgttgtcattactgatgagaacgtttgggagactgaaaagttgttgggtgactttaatgatgttgttcgtcgcgcatggcgtgatcgcgaaccatcagttatcgcaaagtacgctttgaacttggctcgtacattcaacaagtactacgctaactcaaagattttggcagacgacggtcaattgaacgcacgtttggctttggttacggctgtttcacaagtcttgactgagtcattgcgtttgttgggtgttaaggcgccaaaggaaatgtaattatatgattaaggcagttgatttcatttatgaagtcaactgccttttttatttgcgactgttgatttaagagatttgcaatccggaaaattagttattaaaaataagtattgacgtttttctaattcaggtctaatatcattgcatattgaacaggcacaaagaatgtataggggacatgatgtttagcttaaaaatgtttgttttaaaacaaacaagcacctttattcgattaacgacctggcctgttgaaggagccggtcgttgtcgaagccacgcgtattaatttttattgacagttaatcaactaatacagggggcaaaaaaataatgagtatgaagaagcaaatgctagtagcaactacattgtcaatgttggcaatttcagccgggggcatgactaatcaagtcttagctgctagcaagtcagatacgtttacgtatgcaatcagcggtgatttggaatccacaaatccgattgcaacgtctgatcgatggggactgacgtttgataacattcaatactcaccactatttcacgttgctgaagatggttcgtacgaaccggttctagcaacgagccatgatgtttcatcagatggcaaaacaattaccgtcaatctccgtcatggggtgaaatggagtgacggacaaccgtttacggcggatgatgtcgtgttcacataccaaaagctagctgataaagctaatggtaattcagacaatctctacattaataatcaaccaattcaaatcgaaaaggtaaatgataatcaggttaagtttgtgttgccggaaaagtcggcttcagccgtaaacaatatcatgaccgatacctttatcattccaaagcatgtgtacgataagacgactgatttttcaggtagttcattaacaccaggaaatgtcggtaccggtccatacacgctggaaagctataagcaaggtcaggaagttcgctttgttcgcaacgcacattattttggtggccaaccaaagatgaagcatgtggtgctacgaattttgactgatccaaatacgacgaatatcgccctgaagaagggcgaagttgacgcatcatttgttttgccaacgcaattgaagtcattaaagtcagctcatttaaaggttaccgcgtattctgaaaaccgcgttggttacatgggattgaatacacacgtgcaaaagctttcaaatgttaaggtgcgccaggcgattttctacgctttggataagcatgaaatgaatcaggcggcttatctaaacaaggcttattacaacacaccggtttcattcttgccgccaaaggacaaatatgcaacgacggatgttcaaacgtataagaccaacgacaacaaggcaaagcagttattgcatgaagctggtgttaaaaatttgaccttgaatttggggtatgattcatcagatgccgcacaaaagattcaagccaatttgattgtggcacaattgcataaggttggcattaaggtcaacgctgaagcggctgattcaacggcgctatcagcggccatgcacacgaaggggcagaccaagtatgatgcttttctagatggttatattatgggacttgatccacatcaatacacgccgttgtatgcatcaaatggtcaggctaattattggcagtacaaccgtgatgagcttgataagctgtttgcaaagggagatgccgaaaccacggaagcaagtcgtaaggcgacttacaagcaactacaacaaaagattgctgatgcagcgattgtttatccaattgtcgacaataagaaaattctagttattaataaggatgtaaagggtgcaaatgaggcgaagaatttgccgatttacacgtttgctgattggtcaaagctttcaaagtagagggcaggaagatgttaaaactaatcaggcaacgattgttattagcgataccgttgttgctagtcctgtcatttctagtctttggtttaatccatttagcgccgtttaacgcggtcgatgcgattattaagcctacgatgtcgactgctgaagtccatgttttacaacaccgctatggcatcgacaagccctttatgacgcaatatgtcttatggttaatgaatttcgtaactgggcattttggccattcaattattaatcaacaagatatcgggcaagcacttgcggaaagaattccaaacacggtgatgttggtcttgccgccgtatttgacagcaacgattatcgcggttgttttgggcttaattggaggtaggtcgccgcaaaaattagtcgggcgatttattgatacattgactgccattggattggccacgccgtcattttggattgcactactattgttgtattttctaggatacgtacttaatttgtttccaatcttcgggatgggtagcacagcgcatccgctgggtgtgatctggcacatggtattgccatatttgacactggtgattgcctttttcccagaaacaacgcggtatgttcgtagtaaaacgatgacagaatatcgacaagattacgtgatggtacaacgagcattcggcgccagtgagcgttcgattttgttccgtcatgtcttgccgaacgtgttgttgccggttgtgacacaacttggtcagtcactaccactgctaatcaccggtgcaatgattaccgaaacggtgtttagctggccgggggtcggtgcttatatgatggatgcctcggtcaagttagattacccggtgattttagcagtgatgttattgtctgcgtttttggttgttgtgggtaatttgttggcagatatctcatatgcgttggtcgatccacgcgtcaggaggtaatcatgcaacgtgtaaaacacttattagcgcaacgaccaagttacttaatctggatcggcgttatggccttgctagtggtattgaccctgtttgcaccattattaccgctgcatccgaatgtggtagacgtggcgaacatgtcgcaagggccaacgctacaacattggtttggaactgatgatttagggcgtgactatttggcacgggtgatttacggcggccgcatttcattgatggtaggttttttgtcaatggctgtgtcggttgtattaggcacattggttggtacaatcgccggttattatggtggatggattgatgtggttttgatgcgattgttggatgttttttcagcaataccttggttggtattagtcgtcgtattgagtgctatgttacgacctggtcttacgacgattattgtcatcattagtatcttttcgtggatgtcaattgcacgattggttcgcgctgaggtggtcaccgttaaagaacgtgattttgtggtctatgcgcaatttgtcggtgaaaagtcgctggcgattatgtggcatcacctgattccgatggtggccccgataatcgttgctgcagctggtacaaatattgccaatgcgattatgacagagtcagccttaagttttctaggtatgggcgtgcaagatccgactgcttcatgggggtcattgttaaatgcggcgcagtcgcggttgcaagatgcgccatacatggcgattattccaggtgtgtttattatgctgacggttttggcattcaataaactgggtaatttgttgcgcgatgcactttcaccggaggaatatgatggctgatccaatgattataattgaaaatttggacgtgaccgtccggaacaaacaacgtgagaacaagtcgatactacagggtgtcaatttgacgcttacaaagaataccgttcttggtctggttggtgaatctggttctggtaaaacgatgacgatgcgtgcgctattgggccttctacctggcgaggcgattatatcggccgatacttggaaactaaatggcgtggcgtacccggttgggcgacggttgccgattaaaatggcgatggtttttcaagatccgttaacaggtttgaacccagttcgaacggttggttaccatcttgaggaagttatcaagcggacacacccagagtattcacgagttaaacgccaagcgttagcgattatggcgcttgaaaaagtcgaaataaccaagccacagaatcgattgggacaatacccacatgaattatcaggtggtcttagacaacgagtcttgattgcaatggctttgttggcagaaccggatttgctgattgccgatgaaccaacgacggcactggatgttaccgtacaagctcaaattttgggcttaattaaaaggttacaacaaacagagcatctgaccgtgatttttattagccacgatttgagcgttgtctcagcaatcgctgatgaagtggtcgttatgcgtgaagggcgagttgtggaatttggagatgttaacaagatatttaccaatccaacagatgcctatacacaacgacttgtttcgctagttagcggtgagaggggctaaataaaatgagtgatttattgaaactcaacaacgtgacagtacgatatccgggcaaacacggtcaatcagatttggtggcgttagatgacgtgtcattagcgattcgagctggtgaaacgttgggactggttggtgagtcgggttcagggaagacaaccttaagccaagtggcgttgcagttgcttcagccaacgagtggtacagtgacatttgaaaatgaactggtaacgagcgaaaaccgtcgacgggttatgtcgaacatgcaagtcatttttcaagatccgtatgaatcattaaatcctaaacagacagcactacaatcggtccgtgagccgttgcagcttcgctatgacaaacagacagccactcagttggcgttggctgctttggcatcagttggtttggatgaaaatgatgcgcaacgttatccggcaaccttctctggcgggcaacgacaacgaatcggcattgctcgtgccgtagcagtccacccgaaatttattgttgctgacgaaccgatttctgcactggacgtatcaatccaagcacaagtgcttaagttaatggctgagttgcaggccagctacaatctcacgtacttatttatttcacacgatttaagtaaagttcgtcagattgcggaccgaattgccgtgttgtactttggtcatttagtagagctggggccggttgaagaaatttttcagaacccgatgcatgcctatactcgtgagttgttggcggcgattcctgagattggtaagtcaatcatttcgttcgagcgcaagccaattgtaattggcaacgagtgggttcaggtaacgccggagcattatgttttaagataaaaagaggagaaaacgtgacaactattggtattccaagtaatcacttaaaccatgcaaatccaaagcatggtacgaattacgttgattacacacagcagaattacaccgcagctttgcgtgaggctggtgctttgccaattgtttttccgatgggcacaccagaggaagcggctgaatatgtaaatgccgttgatgcggtattgttgattggtggacaagatattggaccgttgttttatggtgaagatccaacgcctaagatgggtgaaacggatcgccaacgtgatttatttgaattggcgattattgctgaagctcgtaagcaacaaaagcctttgatggggatttgccgtgggtcacaaattttgaatgttgcgtttggtggtaccttgattcaagatattaacacgcaatatacaccagctaatgggcaaccagttgtgaagcacatgcaatatccggttaagtggtatgatccaacgcatcgtattgatgtgatggcaggcaccttcttggcgggggcgtttggcgatcaaccgattgttaattcattccaccaccagggcattaagcgtttgggggatggtttgatgccagctgcctatgcaagcgatggtacaattgaagctttccaaactgaagacgcgtcagttcgtggtgtgcaatatcacccagaaatgatgtttgatcatgatgccacgcacttgaaggtattccaagatttcgtggattacgttgctgaacataagaattaaatagcgctgaaattcgatcacccattgtacagttttgtacgatgggtgatttttctgtatgatgggtgttaacacaaaagctgggagggacttatggataacatacaacgatgtgcgtgggtagataactatccgccaaatgaagcgatgcgtgtgtaccatgatactgaatggggcaagccggaatatgatgacgataaattattcgagttgctctctttggaaacataccaaacaggactaagttggcaaacggttatcgataagcgtgaacgattcaatgaacgtttcgaaggttacgtgattgataaggtagcgcaatacgatgagtcttacgttgaagatctactgcaggatgcaggcattattcgaaaccgggcaaaattactcgcaacaattaataatgcgaaagcgatgcaacgcgtgcaacatgagtttggtagtttcgctaaatggctatgggaatttgttgataacacgccgattgatcatcagattgtgcatagtggggatgtaccagcccaagatgctttgtcacaacaagtatcgaaggccatgaaaaaactaggtttcaaatttgttgggccagttaccgtttattcatttttacaaggcgctggattaataaatgatcacgaggtcacatgtgcctttcataattagagaagcattcacaaaaaaacagcaggcgctacggatgtaattcgtggcgcctgctgttttagtcattattaataatcgattcaaaaccggctttaagggcttggttatcagtaggattaagatacaagcgaccttcaggattaccttgattttgttgtgttacgagaacttcaggttgcccattgtgaagagtgaatagatacatcgtcagtttcggatcttgcttattcgaactggcatcgccaccatatacagcaaccaagttatagtcatgattgccggtgccatcagccgaccattgcatatcaacgaattgattatcaatagtagggcgtaatgtttcgccgtcatctgtgagcgatgatgggaacatgagaccatataaatcaaaatcatggccaggataatattcttggtagctttgtcccatttcagtttgccaatttgacatgaattcagctaattgctgtgttttctcagctgaccatggtgtagcgacaacgctagaggctgcgctttctttttcggagatggcagtgctcgtgctagatttttctgatgatttgactgatgatgacgaactagctgacgtttcagaatgcgattgggcaggtacaaattttgaaccaataaagcctgctgctagtgctgcggtcacaatagcagtatagagtaatggtttagaagtcatggttacgtttcctttctgtgcttattaaatacatcgtaattcatatttatggttataatctcgaccgctttgtaacacattacggcacaaaacggcagtgtaaattttgttacaaaatccaagaaaccgcgtatttactgatataattatttctgttgttttttaacaaataagaaattaaaagtaatatgtatttcaggagagaaacatatggaagtctacgtattagcaacggtggttattatcgttgccctaatctttgatggggttaacggattccacgatgcggcgaatgcaatcgccacggctattacaactggtgccttgaaggcgaagacagcaatcattatggctgctgtgatgaacttgattggtgccttgatgggaacggccgttgctgcagttatcgcacgtgacatcgttgatatgacgcaggtgagtgccgagcaacagttgttcttggttattgctgctttgctaggtgcaattggttggaacttgattacttggtggttcggtctaccatcttcatcaacgcacgccatcattggtggattgatgggagctggtttggctgaacaaatcgccggtaacaacgttcacatcaagttggctaaggtagttgaaaaggttattgatccaatggtgttgtcaccagttgtcggatttggactagcgctactcatcatggtgattttgaataaaattatcaagaaggctaatttgaaggaaacggataagtacttccgtacagcgcaaattttcacatcagcatcattggcgttgggacacggtttgcaagacgcccaaaagtcaatgggactgatgttcatggcagccgcaccagttggtttctttggcattacgccagggcaaacggaaattccgttccaaattattttgatggcatctttggctatctcagttggaacaatggctggtggacaacgtattattcacacgttgggaagcaagattacggtcttgagcccacaaaagggattcgttgctgaagctgtttcatcagctgtgttgttcatttctgcttatttcgttcatgcaccaatttcaacgacgcacacagttacgtcagcaattgctggtacgggtgcttctgatgatattcgtgctgtgaagtggagcacattgaagaacattgtgatggcctggattattacggtgccttctgcgggattgattggtttcatgtttgaagaaatcttccgtatgttgtttatgtaattaaatatgacagacgctacttgccaattaaggcgggtagcgtctttttgattccgcccgaacttaaggcagaaaaccgaaaaacctgtataattaaacttatatatgcaaaaaaagaaggattgaaaaccatggcattaaagaagcaagaacgccaagcgttgattttggatattttgtcacgcgaggtgattgattcacaagaaggtttgatgaactcactacaagccgctggcattgaagtcacgcaagcaacggtttcacgcgatatcaaggagatgcgcattgttcgtcgtgccgacggatcaggacgtcctcgttatcaagtgatgtcagatgcgccagttgttgatagcgaacaagtccaaaagggatttgcagagactgctgtgtcggtgacgcgcgttgagtttatgacggttgttaagacgacacaaggtaacggaaatcgtttggcggctttgattgacgcagcaaacttgtcagaagtcattgcaacattggccggccacaacacgatttacgtgacgagtccatctgcagaggccgctgagcagttagcccaacgctttacaaattggatgcaataatatgatgatgcgaatgaaagcatttttcgcgtggatacgacgcaagtttggaccgttttggacacgattccaaattaatcgttggataggtgtttttattctgactgggatattggtgattagtgttctcggaactttcgaagccaaaacaacggatgtgtcagacttaaaaacgcgactccaatcatccaccgaaatatatgatgtaaaagataataaggctggctcaattgctggtcaaaagggaacgtatgtcgcctttgataagatttcaccaaatgctgtgaatgccgtattggcaaccgaggatcgtaatttctatcatgaacctggattctcggttaccggtatgattcgtggtgggttgacgacagtttggtatcgcattcgtggtatcaatgcgtcggctggtgggtcgaccattacgcaacagttggttaaaaatgcgtttttgacgcaaaaccaaaccatcacacgtaagatacgtgagttgttcctagcgattcaggttgaaaaggaatattcaaaacacgacattttggccatgtacttgaataatgcgtactttggtcaaggtgtctggggaattcaggacgcttctttgaagtatttcggggttaacgcttcggatttgtcagtgacccaaggggcgatgctggctggaatgttgcagtcgccaaacggttatgatccattgaattatcctaagaatgcgttgaatcgtcgtaatcaagttttgcaaaacttggtgaatgataagaagttgagccaaaaagaagcggatcaatatgcggctactgccattggtgcaaccgaccacaatgttgataattctaattacaattacccatatttctttgatgcggttattgatgaggcgattaacaaatatggcctaacggaatcagaaattttgaacgatgggtacaagatttatacgacattgaatcaaacggatcaacaaaacttgcaggatgattatgagaccagttggttgaacccaattggtggtgattcacaagctgcgtcagtggtcatggatgcgaaaactggtggggtgcgtgccgtagtcggtggacgtggggaacacgtcttccgtggcttcaaccgcgcaaccagcatgtatcgttcaccaggttcaacgattaagccgattgttgattatgcaccatcattatcacgtggtttctcatatgattccgagttgaagaatgagaagactagttttggtacgaatggttattcaccatcgaactatgcggattacaccagtgaagatgtgccaatgtacgtcgcacttgaaaattcatacaacattccagctgtttggttgctcgaccaaatgggtgtttccgttggatacaatgcgggaattaaggctgggttgccattgaagaagtccgacaagaacttggcgatgggaatcggtggtttgcaaaagggtgtgacaccgttgcaaatgacccaagcttacacaagttttgccaacgacggtgtcatgagtcaaagtcacttcatcacgaagattgttgattcttccggcaaggtggttgtcacagcaaaggaaaagcaaacgcgtctttggtcaaagaaggttgctgatgaaatgacgtcaatgatgatgggcgtttatacgaacggaactggaaagtctgctgatccatatggctacacggtggccggaaagacgggtacgaccgaggtaacaggtagcgattcaacggcaacgaacgcgacggattcatgggctattgcttacacaccagatgtggtggtcacaacttggacgggttacgattcatctgctaacggtgaaacaattccggtatcgcttggtcagacggccggaccgttgatgaaaacgacactggagcaagtaattccaaacactgatcaaaccgcattcggcgttaagagcgtgcgtcaaaagatgagcaccgtaactggcgaaaacggaaagactagtggcagttcatcatcagatggcttctcaaatgccattgacggtattcaatcagacattaaggatggcgcaagtcaggcgtggtcaaatgtgaaggatggtgctcaagcagcatggtcaggaattcaaagtctgtttggtaattaggccccaaagtatgcgataatggaaatactaatttaaagaaggatattaattaatatgattaacatttatgacaacgtaaacgcagttgctactgatttgcgtgagacggctcaatacaagacgttgcgtgatgcagttgaagcattgaacgccgacgcggctgctaaggatgtgttccaacgcttccaagctgcccaaatgcaaatcaaccaagcaatgcaagctggtcaagagccagaagctgcgcaagttgcagaatggcaagaaattgctggtgagatggacaagcacgattctttgaagaagatgatggaagctgagcaagctgttaaccaattgttgatggaaatcaacaacatcatcacgaagccaatcgctgagttgtacggtcaagactaatcaatatgataaaggcgtcgcaaattttgcgacgccttttcttgtgggcaaaggttaagaaacgatgttaggtatttcctaatattgactaatcagggataatagaacacaaagactttaagaggagtggtggaccgcatgaaatttattcacgcagccgatttgcacttgggtaatccgtttgtggggttggctaacgtgccggcatggctacaaaataatttgcaaacggccagtgaaacagcgttggcccgcttggtcgatgatgccatcgctgaatcggtggatttcgttttgttggcgggggatttatttgatacaacgacgcctgacacacgtgcgcaattgacgttggtgacggctttgcaacgtttggatgaagcaaatattccggttgtcatgggatttggtaatcacgattttgtgcaagactggcaagcattgccagtttggccagcgaatgtcacggtgttgccagctgacatcacaacaacgcagttaacgacaactggtggtgagaaagttgccatcaccgggttctcatacacaacgcgccatattactgaagacatggcaattaagttcccaaacaagctacctggtgtggcgttccacattgggatgtaccacggatcggtaggacaagatggggcgggggattatgcaccattcagcttgggtgatttgcaagcgcatcactatgactactgggcgttggggcacattcacgtgcgtcaaaccttgcaggcagaaccgttcgttggttattcaggaagtttgcaaggacttaatcgcaatgaaagtgggactaagggttactacttggttgaaaatcaagggtcgcgcttggtaccagaatttacaccagttgcaccgattgtgtgggcaacgcatgacatcacattgacgggtgatttaaatactgcagtgacacaaatccgtcgcgaattagggacgccagaagaatttgagttggtgtcactaacagtaaagactgatgagccacaattgttatcaatgattgaaaatggccaattggtggcagcgttgacgcgtgcgtcacagtcgaatgatgcgttctatgtgtttgatgtgcggttagatagcacgccactaaaagcgactttgccagcggtggatcaacattattgggatgaaacagctgatgcagtctttgactttgaaacattacaacgcctgggattgaagcaggtgactgacgcatcaattttaacgtcatttttgtcagctgacatgatggctgaactcaaagaagcagttgaaacaaaactacgcgttgcggaacaaggaggccaaacggatgtggattaaaaatgcaaccattgtcgggtttggtcaatggcaaaagcaacgttttgatttcgtggatggcttacaagttgttcaaggactgaatgaagcgggtaaaacaaccttgcaccaattcttgttggggatgctgttcggctttccgcaagctaaagggcgtaaggtcaatacttacgaaccgcttgagcagggaccttatggtggtcatctgcaatttgaagtgaatggcacgacatatgaagtgacgcggttaggacgtacgaaaaacacaacgcgcttggtagccgttgagacgcaacaagaatttgcagacccagagggggtgctaactgagttgttaggaccggttgaccgtgacttgtaccaagcggtatttagtttcgatcaggatgcgctaacgcaaatctttgcgctacgacctgacgaatttgcggaacacttgcgtttgttggcgaccccagggtcagaacaatggttggcgattgcaaatcaatgggagcaagaggcggtgagccaattcggggtcaccaaaacagcgcgtcgtccgatcaacgaagcgcttcaaaccttgcaaatcgctcaagataacttgcaaaccgcgattgcagcgcgtccttcgttgcgtgcattatctgaacaacaacagactgcccaagcccgtttagccacgctaacggagcgccaacgcaatctgtcaaccgatttatcgtcacaggctaagcaacagcagctggtgccgatttatcaacgttggcaacaactaacagcccaacttgcggatgcaccagagccaatcgatacgcgactagccgacgaagcagagcaggtgcaacaacaattattagcgctagaaacggtgtcggttgaagcaacggtatctgatgaacagttggataccgctacccaagcggtaaatgcgttggaacaattgaatcaacaacaacgtgaagccgctcgtcgccaagctgatattcaaaaccaaacgagtttgttgctggcgaagtaccgttggcaagtctttccaccagaactcacgccattccaagtgaaccagctacagggtgggccacaaatcgccgtttctggccaatatcaacgcgccggcattggggccatcgcgtttggaattgttgctgggctaggattaatgcttggtcaccaagtgttaccaggaatcttagcaattatcctattaggtgcaattggggcattcttgttcttcaagttacctaaacgcgtgacggcatcgactgatttgccagccgaatatggtgatatgacgccagaaatggtattgaatgcgcaacctgatgtgcgtttgggtcaccaaatggcacatcagctagctgatttgatggctgcgcaacaagccatgatgccacaacataaggcgttggaagagaagttggcttggttgggataccaattgtctgaaagtgattatcgtcaaaagttagctgagttgcgggcaaataaccgcacggctgaccagcaagtggtgcaaaaggcgaagttgcaacaacgattgaatgagttgttgcaagtgttgggtgtcacatccgttggtgaactgttgcaacaacgtgaactagcagcacgcacccaagcaatgatgcaagaagctgacttgttgcgtggacaacttggggatgctgatttgaacgcattagcaacggctagtgaaacagttgatgacactgatccatcagcggtagcgttgcgtttgcaagaagaagtgaatgacgtgcaacaaacgttggcacgattggaagcgcaacaacaacgtttgatgacggatacgtcaatcgaaacccaacaacagcaaatcgctgaccaaaccgcagctattacggctgatttgaaggcttatttcgtgaaccgcctggcgaatgaatgggtggcgaaaaccttggatgctgccatcggtgaccgattcccacaattgattcactatgccggcgatttgttgcaacgcttaacgcaaggaaactatacgcaaatttcacaaacaaagactttaattaaagtaacgcgtcatgatggggcaattttcaatgttagtcagttgtcgaagggtgcagcggagcaagtttatgttgcgttgcgtttggcattcgtgcaagaggtaaaagaaagtattcaattgccgctgttgattgatgatgcgtttgttgatttcgatcgtgagcgccgccaagctatgattgatatgctgcaagaaatggcgggcaaccaccaacaagtcttgtacttcacggcacaccaagtcgctgcggacaacgtgttggatttgaacgaattaaagggggcttcgaaatgacagaagcaaaacaattaaaagaatatcaagttgatgaacgcatggagatttacgttctgttgaaggaagttgatccgcgtgtgacccaacaaggtaagcgatacttggccgtttcagtggcggaccgttcaatggaaattcgtggtatgaagtgggatgcgacgcaagaagaagcgaacacattgaagagtggtatggttgtctttatgacggcagttcgtcaggtttatcaagacaagccacaattaaaggtgttgtcattgcgtccaacgcatgctggtgaaccacaagacccagccgactttatgagtgctgcgccaatgaaggcttctgaaatggaagaagaagtctcagcgattttattccaaattacgaatgccacgtggcaacgtattgtccgtcacttgattgcgaagtaccacgaccagttctacaagtacccagctgccaagagtaatcaccacgcgtttgcaggtggtttgggcttccatacactctcaatcgtgcatttggcgcaagcagtcgtgaagcagtatcctggtttggatgctagtctgctatatgccggtgctttgctccacgatttgggcaaggtgattgaattgaccggaccaattgccacgcaatatacgacggccggcaacctaattggccacatcgtcttgattgacgagcaaattgtcttagctgccaatgaaatgaacatggatttgtacagtgaagaaatgctgttgttgcgtcacacggttttggcgcaccacgggttgatggagtatggctcaccagttcgtccagtcgttaaggaagcaaacattttgcaccaacttgatgaattggatgctaatattcaaagctttgataacgctttggccgaaactgaacctggcgagttttcacaacgtcaatgggcgttggataaccgtgccatctacaaaccaaccaaataagaaagaccaagaggtgctgtaacggcgcctcttttttaatatcaaaaaatatccaagaacggacatgatgttgtgttgatatctggaatttcagaaggtctttgtcactttgatgtttaactattaggacaaccaacctattaatgaacggaggtgtacaggattatgtatgattggatattcaaccatgttgttgattttctggtattggtgctagtgtcttacccaattgttgggggcatcgcgtttatcatttcaagtatttatcaacgcgtatttaacgagcgccgacaattaccagcatactttgaaggtgaaccgccatttgtcagtatttttgttcctgcacataatgaggaagactcaattgcgtcaaccattgtgtatttagcgacggaactgaattatccggatcattgctatgaaattttagtgattaacgatggctcgactgatgcgacaggtgaaatcctaagccagttacaggtgcgttttcctagcaagctacgtgtcctaactgtcgttgataaccgtggtaaagcgcatggatacaatattgcccttggttatgcacgaggagaatttattctgtctaatgatgcggataccaagcctgaaacggacgccttatggaaatacatgtcttatttcaaacgtgaaggtgggcaaaatgttggggcagtgacgggaaatatgctggtttcaaaccgcacaacattaacggccttggtgcagatgaatgaattaaattcgattgtcggtatgattaagcgatcacaaatggcatatggtggtttatttgccttttccggtgccaatacgatgtaccgcaaagcagctgttttcgatgttggtggctttcaggccgagcaaccaacggaagatattgcgattgcttgggatatgcaaacaaatgggtggcaagccttatttgcaccacacattcgcttcttcttggatatgccagaaaccttacgcgcaatgttcaagcaacgccgtcgttgggcgtcaggcggtatttatgtcttgctgactaaaacagggtcattattgaagcatccaattaagaacctcgccactatgccaattatcattgattatgctttcagtattgtctggagtttcttctattggataccaatgtttttattcttagcattagaagcatatttcctattcacgggtaattgggagcgcttcgtgcatggctggtatatgacggcgatgtttgtcacgattgaagttgctgtcggcgtcgtgcaaggtattttggcatcttacatgaatgacggcggtaagacattaaagtacctattgtttttgccatggtacctattggtgtactggatggtgaacacggcagcgatggtgacggagtttatcccaacatttttgaaagtgctcacgggtgatgaaggtggcgtttggaagtcaccagagcgttcaaagagtctcgccacgattaatgaggagataagccatgctaactagacgaaatcagaagtgtgaaaagccggcatacattacacacgaatcaactgaaaatgacatcacgattgactggtttttcggtaaaggtcggttaatcactaaaatttggcaagcactcttagcgataattgggctgtttttcatgttattaccggtctacataacggttaagacaatgatcgccaaatacattcaaaaagggcatgccatctggtcatatacagaagggtttaagatgtgggaatttgcgacaaaattctttatggatatggcgttattcttcgtgattattttctttgtgctgtatttgattaatcaataccgcgagaagcgtgaccaagatacgttgacggttgatgccaatcgggttgcgtatcgcgtcagtttagccgaagaaatgtacgacacgaaatatggtccgcaagcgttcaggacaaatcgtcaaagtatccgtgtggtcggttatgacgacgtggaaacatatgaattacgagaccgctttaagtattttgaaatagctgatggggatgactatgacaccatatgatgaacaattagtggcacacatgaagttgcgtgagcatcacatgaagcgtcgccaagtaaccaccaacaagatttttaggctccaaaaacgggttaaacaagtcacaacgctggttggcacattggctagcacggtgattttgatggcaattctgatttattcaccactggatgtcgatcatcgtctacaaggtttgccacgtgtcgatgttttgatattcgtcggcttgcttatcattatgtcgtttatcatgcataaattggcagagtgtggcacgatgaaacgctttttcaaacgtcaatcggccaagattaggcgccgttactcaggtgaactacacgctgggcgtcgttggattcagttctattacaaggggcgagatattgggccattaattccgcaaattttgtattacatcgatagtgagcatgaatttgaatcggtcgacgcaacaatcgagcacattgatcaaaccgttggccgtttgcaaaaagcgggtgtcgaaaagtttgagcgatatgcccgcctaacaaatcaggtaattttgtcatcgattcgatcagacggaaagcctagcagtcggttgatgcgctttgtcaaagtgcctgaacggccaaacgtttggctgatggcatcagcgccagatacaccgaaaattgctgagttgacgaatagtgcggtggcgatttttacaccaccaacccgtgatggggcaacaatcagtagcaacaatgtttcgattgtgcaggcgccatatcgtttagaagcagtgacggatttattccgtgaccaagttcatggctaccttgatggcatgagcgaagaagacttagctaccgaaattgttttcgaattaacgattcacagtgcgaagttggatacctggacagatcattcattggctgtgctagatgaaaaaggctatttataatatataaaaagaatgtatggcgcgtacttgtgacgcgttgtacattctttttgttaatgaaatgtaccagtacagggataatgagaaaaaactttacgcggaaaacgtttgcattgtgaaaggtttttacataaaatagtaaagtactattcagaagtaattaagattagtgaagatttgagaggtcttacaatggaatacttgatcggagttgacttggggacaacgtcaactaaggctgttttgtttgacacggaagggcatgttattgccagtgcaaacaagggttacaagctttaccgtgacgaaccagacatggccgaagaggacctaaacgagatttgggaagccttcgttgatgctatgactgaggttgttcgcggcgcaaacggcggtaagattttgggtgtatcattcagttctgcaatgcactcattgattgcctttgacaaggattggcaaccattgacacgtgttatcacttgggctgatacgcgcgcggttaagtacacggaagagttgaagttaactggcttgggccaagagatttacagcaagacgggtacgccaattcacccaatggcacctttgtcaaagatgttgtggttgaagaacgaaaagcctgacatctacaacaacgctgcccactacttgggaattaaggaatacttgttcaaccgtttgttcggtgccaacaagatggatatttcaattgcttcaggaacgggtatgttcaacatcttcaacttggattgggatgagcaagccctagaagtaacgggtatcaagaaggagcaaatgccacaaccagttgagccatacgagattgagcgtggtatggttgcggaatacgctgctgttatgggcttggatatcgacacgccattcgtttatggtgctggtgatggccctttgtcaaacttgggtgttaacgctgtgcaacctggtgttgccgctgtaacgattggcacgtcaggtgccatccgtgtcgtaactgacgcacctaagattgatccaaagggacgtacgttcacgtatgccttggataaggatcactgggttgtcggtggaccagttaacaacggtggggatgtcttccgttgggcccgtgacaagatgtttgacgccgagaagtcaacggctgccttgatgggtgttgatacgtatgacttgttgacggaaatcgcatcaaagattcctgccggtgctgatggtttgctattccacccatacttgggtggtgagcgtgccccaatttgggatgcgaacgcccgtggttcattcttcggattgacgcacaaccacacgcgtgcccacatggtgcgtgccgtgctagaaggtatcatcttcaacatctacatggttgctttggcccttgaagaagttgttggtgacttgaagtcagtgcaagcaactggtggatttgctcgttcagctttgtggcgtcaaatgacggccgacatctttgagcaaccagttacggtgccaacggccttcgagtcaggtgctttggccgctacggttatggcacaaaaggctttgggaatggttgatagtttggatgttatcggcgacatggtcggtgactcaaacacgtacgatccaaacccagaaaactacgaagcttaccgcgagttgacgccaatctttattcgtttggcacgtcaattgcaaacggagtacgcaaacattgcgaacttccaacgtaagcacgtaaacaagggcgacaagtagtcctgagcgaaaagcagataaaaaatattgctcacagtgcatgacactttgccagtactgtgagcaatctattttaaaatagctattttacctacttaaggagtaaataaacgatggaattcgttatgttggcaatttcaattttgattttgcttgttttgattgttaagttcaagttgaacacgttcgtttcattggttgtgacggcgttcatcttggcattgctattgggtatgaacccaatggatgttccaaacgctgtattgggcgaccaaggtatgggtaatatcttgggatcaaactcagttatcttcatcttcggtggtatgatcggtcgattggttgccgacgccggtggttcataccgaatcgcgaagacgttgattaactggtttggtattaagcgtttgcaatgggccgttttgattgcttcattcatcatcggaatctcaatgatcttcggtgttggaatggtgcttttgattcctatcgtatttgcggttgccatcgaagccggtgtgccattgctttacttgggtatctcaatgacggctgccttgtcatcagcacaaggattcttgcctccacagccagctccaacggccgtggcaatgtcattgggtgctaacattggtttgacgttgattcttggtttgattgtgtcagttattacggctgtcgttgcgggtcctttgtttacgaagttggctcaaaagtacgcccctgatgcattccaatttaagacggaaatcaaggctgttggtgaagttaaggaatacgagttggacaagacgccatcattcttcttgtcagttatcacgtcagtattcccattgatcttcatgatcatcgcaacggtttacaagatgatctacacgggtggtgttacgccaaagaacccatcaaacttcgataaggttgttgagttcttggcaacgccagctgttgctatgacaattgctttgatctttgccatcttctcaatgggtgtatggcaaaagaagtcagcccaatcaatcggtgcatcattgaacaacggtatgagcgcagttgctggtatcttgttgatcgttggtggtggaggagcatggcgtggtgtcttggtaaacggtggtttgtcagacaaggttgcctcattgttctcagctaacggtcacatgtcagctatcacggtgattatcttcgcctgggcagttgcggctgtattgcgtatctcagttggttcagctacggttgccggtatgacggctgccggaatcgtattgtcaatcgtgcaatcacaaaacaacccaacgttgtcagtgttggttgctttggcaatcggtgccggatcattgatcgcatctcacgttaacgatgctggattctggattttccaagagttcttcgagttgtcaatcaagcaaacattccaaatctggactgttttggaaacgatcatctcattgacgggtatggttgttatcttggcaatggcagttatcttgctataacgaaataaacattcaattaaggctcacatagcatttgctgtgtgggtctttttttggttgtgagtgttgtgctagcgccccaaaatcaacattaatttcaaaatttaaaaatatttagaactaaacgtaaggggtaatatctcgtataaaaagcaaaccgaaatgtcggactttttttattctggtatcccgacaatgaaataacgctgattaaaattttaatgaacttattacccgcaagtgcttacaaaaggtgtacaatatttaagttgacttatgaaatcgttttcatgagcagaacacatttgagatatttttttaattgagaaggggtaagacgagatgcttacattactcgctggcctaactaccgatcctaagacaggattgttccaatggatgacaaacggctttaacgtttggccattcttgattttggtagttggtattgcattgttgctatttttgattttgaaggcaaagattaacacattcgttgcgttgatcattacttcaattttggtcgccttgggcttgggtatgaacccagccggaatcgctgatgccttgaagaatggtatcggtggtacgatgggtgagctggtcattgtctttgggtttggatcaatgatcggtcgcttggtttctgatgcgggtggttcataccgtatcgcttcaactttgattaacaagttcggtaagtcaaagttgcaatgggcggttgctggtgcatcattcatcatcggaatttcattgctatttgaagttggattggttgttttgattcctatcgtcttcacaattgctttggaagccggtgtgtcattgctttacttgggaatcccaatggctgctgctttgtcagccgcacaaggattcttgccaccacagccatcaccaactgcggttactaacgcattgggtgctaacattggtgtcgtattgatgtacggtatcatcgttgccatcgtcgcaatgttggttgctggacctttgttcacccgtttgattcaaaaggttgagccaaaggcatttaagattactaagaagcttgatgctattggtgaagttaagacctttaaattggaagacacaccatcatttggtttgtcacttgtaacgtcattgatgcctgtgttcttcatgttgatttcaacgatttacacgttggctcacaacggtggtaagcaagtttacagtggtatggttggtgatgcagcctggaaggctttgacgcctgctgcacaacacggttacttgactgacccaacggtgcttgatcgcattatcgctatgcttggtaatccagttatcgccatggttatcgcaatggcctttgctatctggtcaatgggaccaaagcaaggacgtacgatgggtgaagttggttcatcaatgtcagaagctttgaagtcaatcgctaacttgttgatggttatcggtggtggagctgcctttaagggtatcttgactgctggtggtatctcaacagctattgcttcagcattctcacacacgtcattgtcaccaatcatctttgcatggttgattgccgttatcttgcgtgtctcagttggatcagctacggttgctggtttgacgactgccggaatcgttgcaccattggttgctaaccaaacggctgttaacccagccttcgtggtattggctatcggtgccggttcattggctgcttcacacgttaacgatgccggattctggatgttcaaggaattctttgatttggatgtcccacaaacgttgaagatttggacagtgcttgaaacaattatttcagttgttggattgattgttatcttgattttgtcagcattgttctcatagaattctactacggaacctagcttccacatctcggttgccgagatgaagccaaacgaaaaagcaacgttagttgcccttcttagagggacgaccagcgttgcttttttctgtacgttgattgttgatatattcttcgacaacttgcttcgacatgtcacccaacgtaccgatgtagtaactaggagaccacaagtgaccaccccacagcttacgcttcgtttcagggtgagccgtgaaccacaagcgggcgctagaccctttgagtatcttgacgacatcagccggtgcaagttttggcttaaaactaactagcaagtgtacgtggtcgggcataacctccatagattgaatttcgacatcatgattaccggcaaggtaattgatagcgtctttcatatcttgaacgagcttaggtgtggtgaatactggcttgcgatacttcgtgacccatacgatatggtacgaaaaattgtagacgtaaccgcgttcatttttaatcatctgtaattgcttctttcggtgtgttataatgattataacatgaaaaggagctatcacatgaaatcagaaaatctttctaagactgttgatgatatctatgttcgacgctaccgtgtggtggtgaccccagaactaattgagcatcacgcacgcaacatgcagacgcaaaaccaactttggaactttgctaacaagtatcttgaaaggacgtatggtcgtaagcatttgaaccgtccatatcccaacaataagaaacaaaagagcgtggtaatcgacgatattagggcgaaatttatcaaagaaaactacagcctagaccgctggaacgcaaaggttgttgggttgcactcacaaggtgccaacgagtttctaacaacgttattgaccaacttcggtcagtatcgcaaagtcttgtatcacgcttcaaaaatgacgacacaagagaagtcagactgtgtgaacaacgttcacggcaataactcacaacaccgttcgtggtatcgcaaagggtctctaaattacttgcacggtaacaactcattcaagacagtttcactaccaaacaacaatcaagttgaaatcgtatcagcacaccacatcaagatacaggattacggcaagctccaagtcgttgagaacatcagtaatctacgtaacgttacaatcgcgattacaaagttgaagcgtaagagtaacggtcagtttgagttgcaactcgtactcaagcgacaagttgctcgtgttgaaccaacagccaaggttgctggtgactggaacatgactaacaacaaggtcttccacacgtcaaatgacgaagaaatctacatcagcaatgacattgtaactaaggctgacgccttagaacgtcaaattaacggtttaaaatcaaaacgtgacaagtccggttggttgggtcaaagttcacgtcgtatcgctcgaatgaacgacgaaatcaggcgtcttaacatcaaacgtgaaaacgtccttgatgaacagtacaggcaactagcgcacgttctcatggacgattacgacgtggttgtcattgaagatttggacgccaaagacatgcgtgccaagaagcgacaagcacgcagtgctaaccgcaagctggcaatgattaaaccgtatcgtatggcacaattaattgaaatgttggcgaaccgcaatggtaagacgctgatcaaggtggatgcctacaagacatcgcaagtagagttcggcacaacccacgaagaaaagcacgacacatcagttcgtgagtggatttcaactcttaccggcaaattggttaaacgtgatctgaactctgcatggaacatcttatactggggattgcatcccgaacatcacatcaaactaaaagactacccacgcctaagcgtaagtagtctagtaactatcaactaagaattacgggcgagacagaaccttgtcgtccttaatggctataagaataaacgtgatgcgtattgccctgacctagcgaaaacgggcacgacacggtatttgagtgccttaactgacacccgcccgcaagggtgcattgcctaaacgttttcggatagaacctgtttagctgcaggtctcgacgccgaagttcgttacttttagtgacgagagagttcacttacttctgacgtcaattcacaaaaagcgcaaactttaatcgaagtttgaactgaaccccatgagttggagtaaatctaacccatggggttttcttatgttctcgaaagaaattcaaattgaagcagtatcgatgtaaaggattagggggaattatttgccccgctgaatggcgtccgcgccattcggttgccccaatttgaactttgccggagatagtcccacacttctatgcctcgacgcaacgcgtcgacacacaccactgccctactaaaaaacgactaacccgcaaccgagttagtcgtttattttttatcacagcagctattggtctaagattcccggcttttagccaggaatcaagaccaagaacgcacctgataagggcgacttggtcacgtcggaggtctactttatagtgtcatgcgatactcttgcaaaagtccttcgcgtacacctgatgctgagaagataaccttgtcagcgccagtacgtgaaatcaactctaccaatggcaacaaaccactgataatgatatccgcacggttagcttctgtgcccaacacttcagcacgctctgcatgtgtcatgttggccatttcatcaaacgtcttcaaaactgattccgttgtcatttcatagccgtggaagtttgagtccgctggcaagccgtgacgcaaacggtcaagacgagccaatgagcggttggcaccacctaacaaaatgattggcaacgtcgtcgtgtcttccaaccatggcaagtgatcgtattgatcagaaacgtattgtgaggcacgctcaattaggctcggctcaatcttgccttcgccattcaaacggaacttttctgacaagttaaccgccccaaatggcaaactgataaagtttgcggccatacgttcttcaataccaaccagctcaacactggcaccgccagtatcaagtaaccaggcatctgaaatatccaaggctgaaacagccccaagatagtcgtaataagcttcttggtcacccgttagcacacggatttcaacgccgactgctcggtacacacggtccaaaaagtccgcttgattcgttgcttcgcgcacagctgcggtcgcaataccgacaactgaaacgccctcatatgccatatagtcatcacggaactcaatcaaagcttcaacaacgcgtgtcattgccgcttcagttagttcacctgcattttgatccatcccctcagctaaacgcgtatctaacttacgacgcttaagctcaacgaatgtgccatctgcttgtagttcttcaacaaccattcgggttgagtttgaccccaagtcaatgactgccaaatagctcataatttatacccctctaaggattaaccccagtattggatgcccattgcgttacggacttcgttcatcgtttcttgcgccttagcacgtgccttgtcagaaccatcgcgtagcatttgcaaaacggcgtccttgtcttcagcatacttagcacgacgctcacgcataggtgccaattcggcattcaacacttcgaacaagtacttcttgatcttcatgtcacccaagccaccagcttggtattgtgccttcaattcagcaaccttttccgtatccttgtcaaagatgtccaagtacgtgaagaccatgttgccttcaacgtgaccagggtcttcaacacggatgtgctctgggtcagtgtacattgacttaaccttcgtccacaacgtgtcttcgtcgtcgcttaggtagatggcgttgttcaatgactttgacatcttggcattaccgtccaaaccaggaatacgaccttggccctttggtgggaacacaccttgtggttctaccaaaataccttcaccgtagtagttgttgaaagtacgtaccaattcacgtgtttgctccaacattggctcttggtcatcaccaactggcacaacttgtcccttgaacaaagcaatgtcagcagcttgtgaaactgggtagatgaagaaaccagctggaatactctcaccgaatcccttttgttgaatctcagtcttcactgttgggttgcgttgcaaacgagcaattgaaaccaagttcaagaagtactcggtcaattctgacaactcaggcacagctgattgcacgaaaatcgttgacttgcttgggtcgatacctacagctaggtagtccaaagcaacttccaacaatgagttgtgaatcttctctgggtcgcgagcgttatcagtgaacgcttgcttgtccgcaatcataataaatggttcgtagtcgcctgcattttgcattgcgacacggtttttcaaagaaccaacgtagtgaccaatgtgcaactttccagttggacgatcaccagttagcaaaacttgcttttctgccatgttttccatctctttctatcaacggttccccgtcaaaactaattcgtcattgttcattgtaagagtttttacacccgataacaagcgcacaaactacctgttttttaatcccctaaaacactaatatccaacgtcacttgcacgtcgcgaatcaaacctgaaactggccccacgctaatcaacgtcaacgcgtgcatggcgcgtgatgccaaggtatataacaaccctgtcgcttcactatctggataattagtttgtgaaacgtcgtatccaatgactgcatcgaattccaatcccttggccaaatagattggcatcactacgaaattagatgttcgtgtgcgatcactagcttgaagtaattggaacttctcaggatacttgcgtagcatgcgggcaacagcttcggcttgatcttgtgttttagtcaaaattgcgaccgttcgatgttctgctttgagttcatcgacagcctgccaaataacttgttcctcttcgtccgccgtcgtgacaattagcttaggcttcccacctggtcgggtgaacgccatgatgttatcaccatcttgcaacaatgctttggcaaagtccataatttcttgcgttgaacgataagccttgttcaaggtaatcaaattagggtgtgtcgccttaaaggcctggctgtacttagccaacaaagctgccggtgtctcaacatctcggaacaaagcctgttcagcatcccccaacaccgtaaacttagcagctgggaaagcatgcttcaagtacaacaattgggccatactgtagtcttgcatttcatcaacgaagacgtagaacatcgacttgttcgtaccaccacccgtaatcaaatcacgcaagaacagcattggtgccgcgtcttccaaatcaatgcggtggtactccaactcacggaggaatcggtcacgctttgctagccaccactcagtatccaactcagaatgctcagccatgtaagccaaaaagtcgccgtattgattataaatatcaaagaagtgcatgttgtacaacgcatcatcgacaacctggaattcacgttgcaataaacgcttagccgcaatgttgatggcatcccccatctcttcttcttcagcaacttgctcagccagttcgtcacctaacaaatcacgatactgttggtcgtccaagttgttcagctcttccaacacccagtcttcgttgaccaattgatcaatacgacgttccaaacgctccatgaaacgcttttgtgtcatttgaatacgttcacgaaccgagtaattctctgagaactcagcaaacacacgtgtcatcgcttctttgccaaagaacacttcatcttcaaagtagatgttgtcaaagcgcaacgtatctggtgtgagttgttcaacaaaggctgttaaatcatcaacaacgcgcgcactttccaatttctcacgaaccctaagactagccgttgtcgcttcactgtgaccaatttcataacgttcaaagagcgtttgaacctgtagtccttgtagacgcgcactgaagaattccgccagtgtgacttggcgcatgtttcgttcacccaaagatggcaaaacatccgcaatataacttgagaataaacggttgggtgagaacagtacaatttggtcagaattcaactcttcacgcgcgtggaacagcaaaaacgcgatacgttgcaaaattgcagatgtctttccagagccagccacaccttgcaccaccagcaaatcactggtcgtgtcacggataatttgattttgttcttgttgaatcgtcgccacaatattgcgcatggtcaaatcattttcttgtcccaaagcatattgcaacatttcatcgccaaccgtttcattggtatcaaacatgttgacgatttgcgcatcttcaattgtaaattgacgcttcttgagcaattcggcttcttgttcacccattggcgtgggatacgtcacggcacctagcgttccgttgtagtagattccgctaatcggggcacgccaatcataaacgaggaaatcgccgattttatcctgtaccgatgccaaaccaatgtatagggtatcttcatcgccgtcttcatcaatatcgacacgtccaaaatacggactaggtcggagcatggttaatgtatcgaccgtctttcgcataatattttcagtttcagttacacgggccacgatgttacgttgctgttgaatttcggcgttcgtttccatcgcgtcatcgacttcgaaggtattaattgatgtattggcaatataatttccttcaacggcacgtgtttctgagtgagcttgcgcataggcttccttagcacgttcgagttgcccgtcgatttcgacaaccaccttatcgagccgcttttgttcagcgggttggtctgcatgcatttattcggccctcactttcgtatattcaattcaactattataacgctttttcaccagaaaaccggtgtaaatggaaaaagcaccgggtctctccacccgatgctttacaaccatttctctttcaccctcttagccactctacctgccaagagagagcccagtgttaacacactgtggcgttaaaaagcttctctactaactttttaacataatttattgtaagtataaaaagtgaacgaattcccgtataaatgtgaagaaattgtgaacgccactttttggtaagtaaaaaacgagcaatcagcgcaagactgattactcgttaatttgacatctattaagcaaagaagcccatatctgatgcgattgatgggtatgagtacaagttgtgcttaattgcccacttgtcttgcttttggttgatggctaccgtgaagtagttcaacaactcatcagcttcagcactcaaaaccgtcgcaccgatgataacacccttttcattcaagacaaccttagccttagcaattggctccttgtggcgccagtatgctagccatggtgtcatgtcgattgagttaaccttcatgccctttgactcagcttcgacagctgacataccaacttgccccaactttggtgaaccatacaccatcgttggaatagcagggtatgaaatttcttcaggctcagtaccagtcaacaaaccagccacataacgtgcctcataggcaccagttggcgtcaactttggcactggtgattctgcaacgtcaccaaccgcaaaaatgtttgggttagtggtgcgcaaatcagccatcaccttaataccgtttccggcaacttcaacgccagcagcttcaagattcaaatcttcagtgttacctgcgcgaccggcagcgataaatggcatgtcacttgtgacacgacgtccatcagcggcaacaatgtcaaagcgaccgtcagccgtttcttcaacagcagctgtatcaaagttccagtggaacgtgatacccttgctctccatttgcgcaatcaaatcttgcgtcaaatcttgatcaaactcacgcaaaatcacatcgtgcttagccacaacgtgaacctttgcgccggctgctgctgcgataccagcaaattcaattgcgatgaaaccagcaccgatgaaggcaacttcttctggaatcttaggcaagttcaagaagtcttcattgtcgtgcaagaattcgtcaccaggcacttccaaacgagctggacgggcaccagtggcaataatccacttgtcagccgtaaacgtttccgtaccagttgaaaccgtgtgctcatccacgaagtaggcgtgaccatacttgtgggtaatgccggcatcatcaagtcccgcaatcttacgtgcaggaactggatccgtgtaggccatcttgtgttccatcaatgcaggccaatcaatctcattgtgaccaatcaaacctgtgtgttgcatccactcagcttgttccttagcttctaccgcagccaaaagaaccttcttaggatcgcaaccataattagggcaggtaccgccccagagatactcttcaacaataacaactgattgcccagctgcttgcaatggaaaggctgctgacaagccagcaggtcctgaaccaataacaccaacattaaagtgttccacgagtatgccctccttctttttataatgtcattattttaacagtttacacacacccttatgcaaaataagggtgtttaaaccagaccaagactaattaccaacgcttgatcaagcttggcaattagatgcccgggaactaaaccgattttatcttgcaatcggcgcttgtcgattgtacgaatttgctccaacaaaataactgaatcgcgtgcaattcctgtattttctaactcagatggcaaacccacgtgggttggcatcttcggcttcgaaatttgcgccgtgattggcgcaacgattacagtcggtgcgtgttgattaccaacgtcattttgaataatgacaactggacgttgcccgccttgttccgaaccaacaaccggtgataaatcggcaaagaagatgtcccctcttttaatatcatgtcgatttgccatactactctctctacttcactaactttcgtggcaaacgtggtgacaatcccgttgcaatttcatatggaattgtccccatcttgtttgccaaatcaaccaaggtaattgacttgtcgtcaactgacccaatcaatgttaccacagttcccaccggtaattcttctggtagcttgaccatcaattgatccattgcaatacgaccaatcaattcaatttcacgaccatccggcaacaaggctgtcatgccttgcaacgcacgtggataaccgtcggcataaccaactggtagcgtaccaatccattctggttcagaagttgtatacgttgcgccgtaagaaattgatgcccctgcttcaacttgcttcacgtgaaccaactcagcctttagagacaacaccggttggatttcacgcatggccaattcaccttgtgacgggtcaaagccatacatccctgcaccaacgcggaccaagtcagtgcttggttgctcatgccacaatgatgtccctgagttcgctaagtggcgccaaatatcatctggcaaatcaagaccatccgtcaattcgtgccagcgttgcaattgttgctcaaagtaagccgtgttgccaccgtcagcggtcgcaaagtgcatcccaattgctttgaattcgacgttctctgtatcatttagctttgcgacaacgcgctcaagttcagcacggtcacgaataccaatgcgacccatacctgtatcaacaccaactgaagcaatgagtgtcttgtccgctggcaaaagggccaacgcttcatccaaccaggcttcgcttgcaaccacgggcatcaattcaaaggtcgccaaatcattaacatattcagccggcgttacaccaagaataaaaataggcttcttaatgccaaagtgacgcaaccaaataccttcatcgatcgttgccacggcaaatccatcaacgccagccttttcagccgccttaacgatttgtggcaaaccgtgaccatacgcattcgcctttacaacggcaaagaaacgttgggcgccggtcagttcacgaatataagctacgttgtgggccaacgctgactctgaaatttcaagccacgctggacgacgctcactgaccggttggtgtaaagaagccaacgactccaaaataactgaactatgtacggtatcacctgtatgagaaatcgaaatatgtgccaccgcctcgtcttgcttggggtgcttaaccatgactggttgtccagattcgttaggaacaatttccaaatcatgccaatgtacatcgccaccgatccctgttccaattgccttactgtacgcttccttaattgaaaagcgcccagccaagaactccatttggtgcttgcccttacgcttatcaaaaacctcgcgctctgctggcgtcaaaatgacgtcaataaactttggtcggcgttctgccaatcgtgtcacatcactaatcatttgggcatcaatgccttgtccgattatcatgctaacttcctcctagattattgtttcattatacgctgtttatcgtcattttactgtaacatcatttaatcaaactaaaaataagcaaacgacaatatgccagtttttggagcaacaaaaaacctccgttcaacacagaattgaacagaggtttcattttttaattagtcgttgttcttgatgacaaagtcacgtgattgacgacgtggtgcacctgagcgaccgcgttgtgaacggtcacctgatccagtgcgtgaaccgcggtcgaatgaacgacgttcgcgttgtccgcgctcgccatcacgtccgtcacgaccaccttcacgacggccacggtatccaccgccacgacgctcgccaccttcgcgacgaccaccacggtatccaccaccgttgcgtgaaccgccaccgaagcctgaacgcttgcgaggcaatggacgctcacgtgacaacgtgaactcagtatccatctcagctacgttagcaactgcacccaacaaagccgtagccaaagtcttggcatcgtacttttcaaccaacttgtcgatgacttctgagtcaacggcacctgaagttgccgcaatgacatcttcaactgaatcagcagcaactgacatacggccagccaatgcttcttcacgggtaggtggcttcaatggttgcatacgcttcttagtcaacttttcgatgtccttcaagtagtccatctcagcgtttgagataaacgttacagaagttccagtagcaccggcacgaccagtacgaccgatacggtgaacgtatgattctgaatcttgtggaatatcaaagttgtaaacgtagtcaacaccagaaacgtccaaaccacgagcagcaacgtcagtggcaaccaaaatcttgatttcaccgttcttgaattgcttcaaaacttgtgaacgcttttgttgcgtcaagtcaccgtggattccggctgcgttaaagccacgcaattccaaaccacgtgtcaattcatcaacacggcgcttcgtacgaccaaacatgatagccaactttggttgttgcacatccaagatgcgcgtcaacgtgtcgaacttttcaaagtcgcgtacacgaacgtagaattgctcaaccaaatccgttgtcaattccttggcagcgatttggatgtgctctgggttcgtcataaattgcacaccaatgcgcttgatagcaggtggcatcgttgctgagaacaacaacgtttgacgttgatcaggaacagccttcaagatagattcgatatcttcaaggaatcccatgttcaacatttcgtcggcttcgtccaagaccaaagtcttaacgttagacaagttaatcgtgccacggttgatgtggtcgatcaaacgtcctggtgtaccaacgacgatgtgagcaccgtggctcaaaccgttgatttggcggcgaatgtctgcaccaccaaagacagcttgtaccttaacgcgcttatcgcgtcccaacttgaatagctcatcttgtgtttggatagccaattcacgtgttggtgagacaacaagagcttgtacttggttgctgtctgtgtcaatcatttccaagattggcaaaccgaatgcggccgtcttaccggtacccgtttgggcttgtccgataacgtccttaccagccaaagtcaaaggaatcgtttgttcctggattggcgtggcctctacgtagccatgcttctcgatggccgtcaataggtcttgtgtaagacccaactctgaaaacttcaaaatatttcctccagttgcgattgcggagtcaatcgcgctctatatatcgcgaactacgaacaaaattcaaactagacacaatccggcgtccatactgcgtttgattttggcaacagtcctttttgtaacttatccatcttatcctgttaacaactaattagcaagtgcaatagtcattcataaaaaaatacccaacagaaatcaggtttctgttgggtattatctttgatattagtcttcagcaatttggatatcagcgttcaacatcgtcaacttgtgaataatgtgatcgtaaccacgcaaaacgtgttcagcgttcgttacttcagtgataccatcagccatcaaacctgccgtcaccaaagcagcccctgcacgaatctcagcagcagcaacacttgcgccatggaagttattgctgttagcaacagtaataacaccgtactcagggttttcaatcgcgacaccaagcttttgaagctctggaatgtgacgcgtacgttctggataaatcgtctctgaaataatgctctcaccttcagccaacgtcaaaagtggcgtgattggttgttgcaagtcagtggcgaaaccagggaatggtgccgtcttaatgtgaataggcttaaggttttcaacctttggtacaaagatgctgtcttcgcgaacatccaagtccacacccatttcaatcatcttggccgtgaatgactccaagtgctctggaataatgttcttaaccaagacaccatcaccctgcgctgcagccaatgccaaataagttcctgcctcaatacggtcaggaataattgtgtgcgtattctttgactccaacttaggcacacccgtaatacggataacgtccgttccagcaccacgaatttgcgcacccatgttgttcaagaatgttgccaagtcaataatctctggctcgcgtgcggcattctccaaaatggtcgtaccttcagcgtgtacggctgccaaaatgatgttcatcgtagcaccaactgaaaccatgtccaagaagatgcgtgcacccttcaaaccgttttcagcagtgatgtaaaccgtatcgttttcttcacgaaccgtcgcacccaaagcttcaaagcccttgatgtgttggtcgattggtcgaggtccgatgttatcgccacctgggaacgtgaccgttgcgcgaccaaaacgacccaatagtgagcccataaagtagtatgaggcacgcaaagacttaattgccgtagatggtaattccgcttcaatgatctccgttggatcaatcatcaattccccaccaacaaaggtagacttaacattcattgattccaagataacttgcaaattgtatacatctagaatatctggcacgctgtcaaacttcactggtgtttcagccaaaattgcggctggaatcaaagccacagtagagttctttgctcccccaactgttacttcaccactgagtcggcgtccgccatggataaccaacttcttcattctttcaccctttataaagcctttagtacttctatgcctacaaggctcgttcatttcgtttaattatgaccgtacagaccaattgattatcatcaaccaggaactcacactgaattcaaagtaacagtccttaacaagtctacattacatttatatgaataacaagaaaactagacacacaaaattaagccataacatttactttatatttaatagtccgaggtgcattttttcataatctacaccattgattacgaataaatacagcctaaataaattttatcggcattaatcaaacaacactatatattatagcaataaaaaagccccaagcccttaaaaacaaggagttgggactaaagtttactcaataaaggactaagcttccttcttatccaatgcagcctttacaaaggcaccgtacaatggctctggacggtatggacgtgacaagaattcggggtggtattgggcagccacgaagaagtcattctctggcaactcaataatctccatcaaacgatcgtcaggtgaagtacctgagaagaccattccggcatcctcaaattccttacggtagtcgatgttgaattcgtaacggtgacggtgacgctcttggatctcatcttgaccctcgtaaatgtccttcgtcaacgtaccatccttcaagtcagctgggtacaaaccaagacgcaaagtaccaccacgatccgtaacttccttttggtcgttcatcaaggcaataactggtgctgacgtctctgggttcaactcgattgagttagcatcatcatatccaaggacgtgacgggcgaactcaactgaagccaattgcattcccaagcatacgcccaagaaaggaacattgttctcacgagcgaattggatagctgaaatcttaccttcagttccacgtgctccgaatccaccaggcacgatgacaccatcggcatctgccaacaattcagaaacgttttcgtcgttaaccttttctgagttaattgcgttgatttcaacatcagcatcaactgcgtaaccaccggcacgcaatgcttcgttaactgaaatgtatgcgtcttgcaaatcagcatacttaccaaccaacgtaatcttcaacttcttcttcaagttgcggatcttttcgatcattgctgtccattcagtcatgtcagctggttcagccgtcaatcccaaacgcttcaagataacatcgtccataccttgcttttgcatgttcaatgcaatttcgtacaagatatctacgtccaatgactcgataacagcttcaggcgcaacgtctgtgaacaaagccaacttctcgcgcatctctggcgtgattggttgttcagtacgaacaaccaacatgtcaggttggatacccaatgaacgcaactcagcaactgagtgttgcgttggcttcgtcttcatctctcctgcggcacgcaagtatggaatcaatgacgtgtggatgtaggcaacattttcagcacctacttcacgcttcatttgacgcaaagcttcaataaatggcaatgattcgatatcaccaaccgtaccaccaacttcagtaatcacgatgtctgcgtccgtcgtttcagcggcacgcatcatcttttctttcaaagcgttcgtgatgtgtgggataacttgaacagttgcaccatcataatcaccacgacgttccttagccaaaacttcagagtacacacgtcctgacgtaacgtttgagtacttgttcaagttaatgtcgatgaaacgctcatagtgtcccaagtccaaatcagtttccaaaccgtcatcagtaacgaaagtttcaccgtgttggtatggtgacatcgttcctgggtcaacgttaatgtatggatcaaacttttgtacggcaatcttgaagccgcggttcttcaacaagcgacccaatgatgctgcgacgatacccttacccaatgatgaaacaacaccaccagtaacaaagacgtacttagctgtcataaaaaacaatcctccgagttctgtttgcaggagcaataaaaaataaaaaagctcccaatgctattatagccttgggagcattaatcaactttgattacgtcttgtaaactaatacaagagcccggaacttaataatacaccaattccagaaattgtcaacttttagttataatttgttagtcatgatcggcaatgcgcatgctcttcttgaaccaaggagacgcaaagaaggcaatcaagtcatttcccatgtacaacatgtacgtgaagaacaataccaatgaggcatccccttgtgcggccgtaacaccccacaaaacaacttgcgcaattccttgcaagaaccacatgtagtaggcctctgagaaacgtaacgtcgtcaaaactgcccctgtgataccaatggctgctgccccagcatcaatcattgggcgtggtgagtgcgttacatagacatcaaagaagtaaagtgcaatgtaagaaatgataaataccagcacaaagaacgtacgggtctttgcaaaagtcatcttctcaccacgttccttcacttcgctcagcttacgtacacgcgtcgcaacgttttctgaccacgatggcatcaaaataactggcaaatcaagcaaaataatataaacgaattgcaaaactgcatcggcaggattacccgcatctagggccaagccaatataaacaagcgctgaaatcaatcccaaaataccgttaattggtcgtgcatttgtaatcgcaagcgtcgtggtaaagcccaacaacgctgcagctaatgtccaaattgccattcccgtaattggattagcaattgtttgactaatcaaaaagccgaaaccaaacatcagcaacaagtaagatggcaaagcccatcctctcatttgctcaacataccaagatggcttaaaaatctttgcaacgtgcgcccaagaaaacgatggcgtcttttgtggttcattcatcatgaaaacctctttcttcagtttactttattacgcgaggactctctcgcggttactaataaaaagcaactgtaccagtgtacgctagttttataaggtttgcaaaaacgtttcacctatttgggataattaataaatttgcttctcaaaaatcgccatcatcttctttgttgcggtgtgcaaaaagatatcgtactcagcgaacgatggcgacgatggccagacgaacaatgtggtttcatcagacatcgtcaagtgatccgcgataacgatatctggcgtttcttcttcatccgttacgaaaacaacatttaacatttcggtggtcataatcatccgttgaatatgttgcgccaacaaattgtcttgataatctaggcgaacatgaatcgttggcaacattttttcacgtggcagcgcctgcagaaaggcgttataaaagtcagtttccatgcgtcgcaaaatcgtgtcagtctgttcatcgaatgataagccaacgtggcgaagcaccttttgcgtgaataatttatatgtcggataaagcgtgtgcccagtggccatgccatcctccgcctgataattaatgcgacgcaaaaacatcaacacaacaactggctgaatcaacaataatggccagctgcttttttgactctccggcaaagcctcaccgaaaaattcgcgataggtggttgcgacgtttccaaagaccgtctcatacatatctcgcaatgctggggttgcatgatccatcatatttccgtgcaaaatcgcatcagtcattaaaacgcccattgcaaaatttgcttctgcgtctaagcactctggcattaaacgacgataacgcaaaacaatggcacgtaacgtgcgatacggcatcttcaactcatcgtcatgcccaatcgttgattcaaaaatattactaatcgcttcatttttatcaatcgtccggcttgattgtagtcgcgtaatccagacgcccaaaaagacaaacaatcgaattcgttgtacgttgttcaaactcacaacgtggtttccttcgaaaaaggcaactgtttgacgcgttaatactagaatgtgttctggaaaatagcgcgccaaatcagcttctgattcgacgatgtcggctaacacacggtacatcataattcgaattgtcgactcatttcccgtcaattgcatattatgaccgagtgaaacaccactgccagccaaccgttcattaagcagtacccggtcagcagccaaatggttcgtcgcaatatcaaggcgctccgccattgtcgctgatgacaccggctcgcctgatattccttgtacaagcatcgctaatgcatgtgattcaattgtgtaaaaatactccaaacgcatgatgtttacttgataacctggcgtccatgaaaccaagccacctttttcttcaaacttcagcgccgcagtattcacaatcccaaaacgagtttcgtcgctaacgatttcgttcaacaacgtctttgccatatatttcgaaacattaaaacgacgctctacctcttgcaatggcacacttgtcttattttgttgatataaaaagcgcacaacttgcagctttaggttttcacgcttacccaatagccattccatgatcatcctccatctcaacccacaacagttttatcgtaaactcgtcaaatgattcccccatcacttggtcgtagtatggccaattttcttttggctggaaggtatgaaccatctcacgcactgtatcgtatttttgattggctagcatccgcttgtccgcaacaacaagtcgaatcactgtaattagctcgcgcaagagcgaggtcatccaatcatctacttttaccggcatgctataaaaaatctcaactaactcatccatcaactgaccagcgccgtgctctgcttgcatcatgatcaattcgaacaggagcaagccaatcacctgcgtcgcttcatggcggatagcaccttgataatctcgactcatcgaaatttgtaatctcacgctgcgtaacaacttcttatactgctcccgcaaatcgtcataagaaaaataattcaagtacaacaaaacaactttcaactcagctaatgtataactttcagttcgtcgtagtaaatccagtaagatcggcttcaatcggacgaccagctcttctggcaacgtcgccacagcccattggtcatccgattttgccagcgcgataatgtctgttaccgttcgtgtttgttggtaactatcaattgcacgttgtaattgatcagacggcgtatccgctatctcttcgcgtggcatatacatgccgatttcagccagtcctacgttaagcgtctttagaatagcgtgcaacttatgaacggtgatatcaccttgtccattaataaacgtataataccgaccacttgaaatcgcggtatgttgcaacatatcacgcacagaaatatgcttcacatcaatcacttttcgaaccgcattcaaaatcggcgtatcaatccttgtcatactaaatttcctctccaaacctcagtcttgtttttgtctatgtcacttacattcgggaagtttaacacaagtatttttctcttcacttgataattttatataaagcgcgaaaaatagtatcacgtctggtttttttaaatttttcgaaaatgaatacgttttcaatcgattttttgaaaaaaataaaaaagcgagcattgctgctcgcttttttatcgatatttaattatcgctcgatgtcacctgaaccgtagtcatcatcgactggtgcaatgccaccgatttcttcgccgataccaccagcaacttcgtcattaccgaaatcatctgatgaatcgtcatcatcgtcgtcatctgcatcatcatcatctgaatcagcagctgccgtctcgtcttcgtcttcaacttcaccgaagtcgtcgtcttcaggatcatcatcgttgtagtcgataacatcgtcatcatctgcaacgtctgccaaaaaggcgttgatcttcttacgcttcttcttctttggttgaccttcttcttcttcaagatccaagtgaacggcttcatcaattgagtcgattgggtaccatgaacgtagtccccacatgttatcacccaatgaaatgaatgaaccgtcaatattcaaatcagtgtagaattgtgccaagcgcgcacgaatctcttcatctgacttaccagtgaatgattgtacttcattcaacaagtcgttaaacgccatggtgtcatgacggtcagacaaaatcgcacgagcaacttcaatcattgaaagctcagccttattttggccgtcaaattgtgttaatgccaaatcactgcacgtcctttcgcggtcttactcaatgtcttatcttacaatatttcagccatttcggcaaatgttattcttcgcaaattaagcgagttctggtacatcacgtcccaaaacccacttttcgacggcaacaccaacaccatccgcgttttgtgtcgtcgtttctacgtccgcaactgccttcacttcaggcacagcatttcccattgcgacacctaatccagcggcctcaatcatcgtgacatcattttgttggtcaccaagagccatcgtctcagagcgatcaatacccagcttagccgccaacgtcaacaagccactccccttcgtcgcatccttgtgcatgaactctaagtgttgtggcgttgacttcacaatgtaatacgcttccttaacatcagctggcaatgcatcgcgccaactatcaatatcagcttcatccccaatgaacataaacttaacgtagtggtcgtttgggtccatttcatcaaccggcttaatgatcaatggcatcttaatcaaaaagttttcacggctagcccagtagttaatttccttagcagacgtataagctgcatcgatcgtctcaacttgcaagtaagcacccaactcatcggcaacctcgcgcaaacgtaggtaatctgagtacgctagttccttaccaccaagttcttcaccattagttgtttgcacaaccccaccattgtacgtgatggcatattgatcatcttggtgattcaatcccaattcatccaaatattcttggacacccggcaaagggcggccagtcgtcaagacaactttaacgccttgcgcagttgcttcttgtagcgcagccttcacacgaggtgtgacttgcttagccgtgttaactagtgtgtcatcaatatcaatcgtaatcaacttaattgccatatctgtattccccttacttttcagttggcttaaccaatgtttcgttgtgcacataacgttggaattctgcataaagcggtgccatcacgtcatcgaccgcttgcgtattcatcatctcacgtgggaagaagaaacgcgcatttccgaatatacggcccgtcatcgcagccaccagcgcactttgtgttgatagttcaaacaattccccagccggttgcatcatttcaatctgtgtacgaggcttcttatcgcttggattatacgcatcgtatggcaggtcataactgtcattttcagccgtgtaataacgctcgtcaaacccagctgacgcaatcaacttcgtaattgccggcaacaaattgcgggctgaatcttcaatcaaaatcgacttcaacggcttacgatccaagaaacgcgtggccaaatctgccaagattgcatcatcagccaggcgccactcactaatattagctagcataaccgaatcgtctagcatcaagtattgttctagcgaaaagtcgccagcgaacaacggcatcaaagccggtgagataaagctcgttgaaatacgcgaatctgtcttactctcatcatacaagaactttgcacgctctagcaggtgctgcaacagcacttcaaatgaacgtgacactgggtggaaataaacctggacatacatttgataacgcgacaccacgtaatcttccacggcatacattcccttttgatcaaaggcaatcccgcccttgtatgggcgcatcacgtgaatgatacgagctagatcaaattcaccataggtcgcacccgaataatatgcatcacgcaacaagtaatccattcggtcagcgtcaatttgacttgaaatcaactgcaccacttgcggattttcgtaggttttagcaataacactcgctaccttggccggaaaatcaggtgcgacctggcgcaaaacttgattaatttcagtttcgggcgacaaaataatttgttgggtgtacgactcatgatcagtattgaaaatgtgttcaaacgtgtgcgagtatgggccgtgacccaggtcgtgtagcaaagctgacgttagtagcaccaagcgctcgctagggtcccacaacccatcacccggctcctgagttggataaaacttttctagatggtcagcaaactgacgggcaatttcatatacacccagcgagtgtgaaaaacgtgagtgctcagcgccgtggaaaacagcactagccacgcccaattgcttaattcgtcgtagtcgttgaaactcagatgtgccaattaaatcaagaataacttgatcttggacacgaataaaattatgtaccgggtcacgaaagaccttttcctttacttctgtcgtcataagtcgaaccttgattccttccctatttccgaactactgattcgttacttacattataacctagaaatacctgtataatggaagtaataggcttattgaaggaggaaatttgtatggcaaattcagccaacggatatccagtaacattgaaattaactacggtcatccgtcaagaaggcgacgaagagaccttcacgttcgaagaaaacggtacaatcaccccaatgggcgacacattatacctacgctacatcgaacaccaagccggcttagaaacgccggtaacctttaagatgacacccgccggtgaagtctcattaaagcgttctggtcaaagcgacgttcgtttgcaatttgcacctgatgctacgattccaacgcgctacgtgacaccgcaaggatcaatgtcaatcgacgtacgtactaacgacttaaagactgtccttgatgaagattttggtcacgttaacgtagcctactcactactagctggtgagacgctactgggtgattattcgcttgaactccattttgaaaagtaacacgaaaaagcctcgccaatgcaaatgcatcagcgaggcttgttttttggcacaaaaaaagaccatcgtgcaagagggggaacgcaacgatggtccgccgccggctactatcgcaaccagcgaggggggtgttacatactttggggaaatatgtaacgcttcatgtactttggggagtaatgaaatccactaggaacagcggatatgtataatatatctaatccgtgtgaacaacgtgtaaaaaaagtgtttcaattagttaacaaaactaacaaatcataagttgagtgttgcaaaaaagagactacctaggtagtctcttccattttttctgactaattcgactcagatgatgatgttaatgagctcgttgtctttgttaacttagcatcaacggtcttttctttaccatcgcggtaataagaaatcttaatggtatcgcccaccttgtacttgtacaaggcatcacgcaaatcaccagatcctgcgatttcagtatcgtcaatcttagtaataacgtcgtatttcttcaaaccggcttcagcagctgctgacccatcagtcgtccccatcaccacaacaccaccagaaacactggttggcaacttcaagacgcttgattgatcagatgttgaaacattactcaaatcaaccatcgtgacgccaagtgctggacgttctaccttaccattcttttccaattcgttaataatgcttacaactgtatctgaaggaattgagaagcccatcccttcaacagatgtaccatctgaggatgaagccaacttcattgaattaataccaacaacttggccggctaggttaaccaacggtccaccagaattaccagggttaatcgccgcgtcagtttgaataacagtcgccttaccaagagaattaccactctcatccgtcgcatcaacttcacgctttgtcgctgaaataataccttcagttactgacgttgcatattcagaacctaatggtgagccaatagccaacaccgcttgaccaggttcaatctttgatgaatcagcaaagtccgccacttctgacaccttagctgagtcaatcttcaacacagccaaatcagtttgctcatcagttccaaccaaggttgccgtcaatttcgtaccgtcacttagcaagacttgcaacgcatttgagccagccaccacgtgattattcgtcacaatgtaggctgtgccaccctgcttcttgtaaataacaccagatccttcagaagctgtttgcaaatctgaagagtcactattcttacttgaactattaccgtagtcactcgtcaaaccaccaaacattgaatcacccaatgattgttgcttttgcaagttaataaccgatacaaccgcgcccgaaactttgttaaaggccttcgtcgcgtcagatgttcccttcacatttgagttgctaactttaactggtgttgtcttaccagtcgtcaccgctgatggcgccagcatacctgagttgttcaagtaggcaacaccccctgctgccgcaccgcctccgaccaaaccagcgaccaaaccaacaatcgccactttcatcgttgctgacttgctaccactacgcttttcattttcagtcatgggtaaccccctccatattatctctgattatttactcatattgtaacggctatccctttaagtcgtcttaagaaaactctcttaaatgtccaataacttcgttgcctgagctggatcggtatcaaatagattaaaatcatggcctaccccaaagtcatgttctttcaaaactgactgcaccgttaaatgggccaacggcttttggttattctcttgactcaagtgtcctaagaaaacattcttcgtacgattccccaaaatctcagtcaacgccaatgccccatcctcattagataagtgaccttgatcacttaagatgcgttgcttcaaattccaagcatatccgcccatacgaagcatctcataatcgtgatttgcttccatcaagactgcatctgcgttacgaatcgtaccaacaatgcgatcattaacataacccgtatctgttagcatcgcaaacgtcttattgtcgtggtggaaagcataaaattgtggatccgctgcatcgtgggaaacgctgaaactctcgacgtccaaatcaccaaacagcttcgtctgaccagcctcgagaatattcatctgttcaggtttgattttaccaattttgcctgccattgcatcccacgttttcgcattcgcatagacatcaaagccatacttgcgcgccaacacaccaacccctgcaatgtggtcactgtgttcgtgtgtcacaaacaacgcgtcgacatcggacaatgaacgaccgatttgattcatcagtccatcaatcttttttcccgacaaaccagcgtcaaccagcaccttgtgtgtcggcgtttcaatgaacgtaacgttacccttactgccagaggccaacattgacacatgaaaatcacttgccatttctgccatccccattctttttattatctacaaagtaaaaacgccgtatgacaaaagagtcacacggcgtttcgtcgttatctattttaacacgtcattatttcattaatgcgccattcaatgcattgattcgtaataacgtcgtattaccagtaccgtccgttaccgaaaagatccatgctggtacaaaaatcgtatcatcaccgaccgtcgtcaacggcgcgtagcccatatgactccaattcaacttaccattatttggaatttcattatattgataagcaccaatcaacgctttttcttccgaaatcagcgtcgtcgagtcacgcaacacttgtgcattcgacacatacgtctgtgtgtagcccttcaaatcatgattcttatccaacaagaatctaatttgagcacgcgatgtcataaattggcgtcggttcgtcattttctgtgtatagacaaccatcgctgaattatccgaatcattattcgcatactccgtcaatttcgcatcgtacacgtattgcgttcctgcgataacctgcgttttgtcattgactaatttttgtaatgacttacgcacgtctgaacgcgacgtccccataaacactggtttatctagcgttgccgtcaattgattaccagttagtttagtggaccatcgcttatccaaactgtccatattggccttcaaaaagtcgttaccgtcttggccgccaatataggcacccgtttcagaatcggtatctaagttacctacctggataccatcgctcttcatctctgacaaaatactttctgtcgccgttggattagctgttggttgatggatttgaaaccactgaaaagccaaaaagatatcgatagccacaaaaaccactaagaaagtcgctaagatttttttgaaatccatcagttcgttcctccttgattttcagctaacttgtcattaacagcttgccaggtgctgccaacttcaaagtaccactcaggttgcaacgtcacgatgttttgattcgtatctgacacccaacgataaccataagccatattcgtaatcgactgttttgacacgccggcgtcagccaattgcttaatcacttcatccgacgttggcaatgtcacacggacattattgtccgccggcaaaggcacttgcaatgaatactgtgaaaaatcaatttcttggtggcgactatcatgttgcttcatttgaaccgtaccataagcagtttggttgaaaattggcaacccattaacataaagacgataaatcaagtgacgtcccatatcatgactttcaaaaaagtagatattatccggaatttggtgaattcgaacaagccaatcatatcctttggccatgcgttgattaaatgtcttacccaagtcagcgacatcataagcatcatacttcgcgacaccagaaacggtatccactgtcatttgacgagatacaccatcattataagtcagaacattgccatcacgatttgcacttggcgtcgtcgttcccgcaaagagcgctgacagataattatttgtcgcattcgtttccattaagtagctgtacgaacgcaatgagacggtttcaagtgcatcagttagcacacgcttaccgttaatctcgaacttaactttcacccgttcgtcactcattttgaaactagcaaatgactttggcgcacttttaatcgtgtactgataaatcgtccgatgcttgtcgtccatgaacaccaaagcgtccttgcccttttgcggcacacgaatacgatttatttcaacattgcttggtaaatcaacatcatttgccaaaatttgattaactacaccgccagcaactgcatccggaaaacttatcatgaccgtgcctttttttgataaagcgtcaagataagctgccttcgttagcttttgcttcgtgtaatcaccgacttcccaggtcgctaaacgcttaaccattttcgtcgtcgttgggcgatagtcaatgattgaatattgcacattatcttcgttgtacaccagttgatcaaagccataaagatcggttagcgactttgaagcaacgacttgctgagttgcgtctgcgttgcttttatcgcggttcaagtcgcgaccaggactgcgccataagctaaccgatagtgcgatactaacaccaattgcaagaatcagcatcgctaccaaaccaaagcgacgaaataacactttgaaacgataatgtagtcgattaatcatcccattcaccatcatcccactcgtcttctgccggatcatacgcttcataaggcaatgaaattgagaacgttgaacccttgccttctgaagattctacccaaatcttaccgccaaagcgttcgataatttccttagaaatagcaagccccaatccagttccaccttgggcacgtgaacgcgccttatcaacacggaagaaacggtcgaaaatgtgccccaagtctttctttggaattcccaatccttggtcggtaatgcttagtacaacttcagtcttacgatcaatcatgcgggccgtaatgacaccaccatcaggtgaatacttaatggcattgttcataatgttatccaccacctgggtgaacttagacgtatccaactcaacccaaatttgcgaattcgtaatctcacgcttgattgtgtagtacttttcaggcttatcatcattcgcaatgatcatatcgaaacggttcagaatgtaattgaacaattcgccaacgttaacatattccgtttccaacttcattgttccagagtccatacgagacagctcaagcaaatcgttaatcatgtgaatcatacgagttgtttcatcttgggcgaccgccaagaaactctttgcaacttcagggtcctcaatcgcaccttcttgcaaggcatcaacatatgactttacagaagttaacggtgtacgcaactcgtgcgaaacgttcgaaacgaattggcgacgctcttcttcaatacgttgttgctcggtaacgtcgtgtagcacgatgaccaaaccagaaatgaatcccgaagcacgttgaatcaaactgaagtacgcgcggataatcaattgacgttcttcattactgaaatcaagcaacaattcatcctgattatcaagcaactcacgcaagttatagcgatcggcaatctgcaaaacttccaaaatcgactgacccaaggccacgttactatcttccatacccgtcatttgcaacgcagccgtattaataatgttaatacttccgcgacggtcagtagcaataacaccatctgtcatgtgttccagcactgaatccaaacgacggcgttcaaactcagtcgagttcgtcgtctcttcaattcgaactgccagtgcgttaacattttcagccaattgtccgatttcatcattagaacggaccaaaatgccgcctgagtaatccccttgcgcaattcgcgtcgtacgatcgttaatttccgcaatcggctttgtcaaactacgtgaaataatcacggccatgacaacacccaagaccacggctaacaacgatgctgagaagtaaatcagcgaaatgtgattcaaattgtcataagttgtttcaaggctcgctcgcacttcaacaactccaatgatgttactctcaccaccggatgaactcaccaacggctttacgacaacttggtaacgaacacccgaacgttcttcaattgggttctttgtgtacttcccacctgccaacgccgctttgacgttagcatccgttgttttttgcccaacttcatcttgggaattaatatcactcgtaccgcgaataatccctgatgaatcaatgacctcaatctctgaaattgaggcattattaattgacgtcagaatcgtgtggatatcgctattcgccttcgtttgatctgtgctgattaattgctgcgttagcgaatcattcacataagctggcaacgcaatttgtgttctaaacgtcgccagattttgttgctccaaacgtttaacgaagaacgctccaaccagttccaacgttactagtagcgtcagtgtaaataccaacgcaattttaaaatggattgaagaaaaaaacttccgccaccttttttgctctgtcaattcttcaaaatctgccatcgcgtttttaattctcccaaatttaattaaaaaaatagtgccatgccaatcggcacggcactaaccagtctgctttattcttctgaagccttcaaatagtaaccgacaccgcgacgtgtcatcaaaatttgtgggtgacttggtgtttcttcaatcttttcacgaatacgacgtaccgtcacatcgaccgtacgaacatccccaaagtaatcgtaaccccataccgtttgcaacaaatcgtcacgcgtcataacttgaccaatgtgcttagccaagtggtgcaacaattcaaactcacggtgtgtcaattcaatatcttgaccgttcttagataccatatatgcatcagggtgaatcgttagggcaccaatcttgatgtccccgctatcatccataacattttgaccggcaactggcgcttggcggcgcaagttagccttgatacgtgccaacaattctcgatttgagaatggctttgtcacataatcatcagcccccatttcaagtcccaaaaccttatcgatttctgagtccttagccgttaccatgataacgggtgtttgtgacttcgttcgaatttgacgcaacacttctgttccttcaagttcaggcaacatttggtctagcaaaactagatcaggctcttcactctcaaaaagatccaacgcttcttgaccgtccatggccacgacaacgtcgtatccttcctttgtcaaattaaacttgataatatctgaaattggcttttcgtcatcgacgactaaaattttactcatctgttctttatcctcccagtggcgggtatcttgtaactattatagcatgttacaaagttttcgtaatctttcagaaacagaaaacatttattttacaaaaaagggttgcaaaacattcatatacttgttattatattatctgttgttgaggcaacgaagaaaattatgggcagatagctcagttggtagagcaacggactcttaatccgtgggtccagggttcgagcccctgtctgcccatcccatagccgctaggtcatttgatctagcggttttctttttgtccatgcctataaatttatctccgtcatgaaaaaagcgttttttgttcaagaaagtgttgcattcattttcagatggtggtatattaatatctgttgttgagagacacaaagagaattacatgggcagatagctcagttggtagagcaacggactcttaatccgtgggtccagggttcgagcccctgtctgcccatcccatagccgctaggtcatttgatctagcggttttctttttgtccatgcctataaatttatctccgtcatgaaaaaagcgttttttgttcaagaaagtgttgcattcattttcagatggtggtatattaatatctgttgttgagagacacaaagagaattacatgggcagatagctcagttggtagagcaacggactcttaatccgtgggtccagggttcgagcccctgtctgcccatcccataaccgctaggtcattgacctggcggttttctttttgcctttttatcacagctgctgtcggtctaaaacctccgacattctcaatctgctttatcgcacgatcgcagcaactaacaaactcatcaaagatagtttcggactatcccccctctccagcctcactctattttagaatcacttttttcaaacaaaacacttgcacacttactaattatctggtattattaattctgttgttgaggcaacgaagaaaattatgggcagatagctcagttggtagagcaacggactcttaatccgtgggtccagggttcgagcccctgtctgcccatcccataaccaccaggtcatttgatctggtggttttctttttgcgcaaacacaaaagccggttcgcatcacttttcggaccggctttaatttacttagctgcggcaatcttctcatcgaagttcaacgtcaacaaacctaaatcaatcaatgattcgatttgatcttcattcgcttcacctgggaactttgcttccaattcattttgatacgtctcgacatatgtatcttcaaatgcatcgcgaatatcttcagctgaacctgtcttgataatgccacccttttggtcagcgataaacttatccaggtcccccttcagacgatcaacaacctcttgctccgatggcaacgccactgatgtcgccgttcctgccgcgcctgaagatgacacagcagaactcgttgacgaagacttagcaatcgattctgaatacgaacgtgcaacacttgattcgtattgacgctcaaatttttcctcttgatgctcgttgtacatattcataccaaccgcacctaaaattagcgctacaactgctactacaccgctaataagccatttcttcataagtatgttcctttcccttgtttgtccaaagaataccgcacaaacgtgtcagaaaagccgtcaaaacataaaaaaagagtgaaccagcaatgctgattcactcttttaaaggttgttactaaaagcgtatgctattagtcttctgcaacgaatggcaaaagacccataacacgtgcacgcttgatagcagtcgtcaccttacgttggttcttagcagacgtacccgtcacacgacgaggcaagatcttaccgcgttctgagatgaaacgctccaacaattcagtgtccttgtaatccacgtattcgatgtggttggctgcgataaagtcaaccttacgacgacggcgagggccgccaccacgacgttgttgtgccatgattaattcctcctgatagacttatgtcgttagacaattagatatatcaacttagaatggtagatcatcgtcagagatatcaacctcttgaccaccaccgaaaggatcatttgatggttgtgaaggttggctaccaccaaacacattaccatttgatgatgaagaaccaccgaatgggttttgtgctggtgcggcattaaagccgccttggttgccaccttgttgaccaccgccaaagttgttgcttgcaccaccgttttgtgaacggcgttgttcgctttcagctcgactctccaacaatgagaagttatcaacgacaacttccgttacataaacacgttgaccttgttggttctcgtagttacgagtttgcaagcggccttcaactgccaccaatgaccccttagaggtaaagttagcaaagttttcagccgacttacgccagataacggcgttaataaagtcggtctcacgctcaccattagcgttagtaaactgacggttaacagctagtgagaaagttccgacagcagcacctgaagtcgtgtaacgcaattcaacgtcacgcgtcaagcgaccaaccagaacaacacgattaatcatatggaaagtctcctttcaatcggtcttaatgacctgcaactaagttaataaaaaatgttagacaattaagctaacaattactcagctgatgcaaagtcgcgctttacaaccatgtgacgcaagatatcttgtgagatctttgccaaacgatcaaattcgttgatggctgcgtcatcttctgcagtaaagttaacgatgtggtaagtaccctcacggtaacctgcaatttcgtatgcaaaacgacgtgatgaccagtccttagactctgccaccgttgcaccgttgtccgccaagatcttgtcgaaacgctcaaccaatgccttcttagcatcagcgtccatgtcagggcgaatgatgtacgtcaattcgtatgccataataacttcctccttttggtctatggccgacttcctgccggcaaggagagctgttgaaatttaattcaacataactcacaagaactaagtttacacgcgatacaaacgttttgcaagtgaaatatccattacaaattcacgtcataccacgtgtcatacgctttcatgcctatcttacttaggaactaaacctctcaacaaatagcaaaaaagcacgactttcatcgtgcttagttagcttacttaaacaatgctgtcgtgtagttcatgaagcgttccaaatagaatggttcatcaactgcaacggctgcgaagttattcttgtgtggatcacgcaaacgagatgggtcaccaatcgtgcgaccatcttcaggcgtaaccatcatgttcaatggcaacaacgtcaccaagttagggtcaacagcgacaccaactgcaagtgggtcgtgcaaagccgccccagccttgttgatatccaagttgtaataagcgtcaatgtagtaatcgaaaatatctgcgaatacgcgacccttttcagttcccaaatcacgccatacttgcgtttccttcttcgtcaaaagcgtttgcaatgtgacatccaagccgaccatcacaaggtgcttagcgtgcttaaagacatagtcagctgcttctgggtcttggttaatattcgcctcagtatatggcgttacgtttccaggtacaacaagcgccccacccatcaacgtcacattaccaatcaagttttcgatttcaggatccttttggtaagcttccgccaagttagtcaatggaccagttggcacgatgaccaaatcatcagcatacttgtgagccgcttcaatgatgaagtcaactgccgtttgcgcttcaactgagcgacttggtgttggcaattcaacatccccaataccattcttaccgtggatatccattgacacttgcatcgtttcaaagttatcagtcgttgatgagtgcgctgcaccaataaagaccggtacatcttcgcgtcccaacaactcaagcaacttcaacgtgttttcaccagccgtgttaacttgcgtgttaccaaatgatgaaacaaccccaatcaaatctgaatctggcgttgccaaagcgtatgccaacgccaaagcgtcgtcaacaccagtgtccaaatccaaaatcatcttcttctttgccattagaatatcccttctttatagaaaaagcactgccctaaattagtattagaacaatgctttaaaaactcaaattcggttagtcgaccgtacggtggaaacggttcttaaacaatggagataccgcttggttctcattgatacgcttaatcgcttcaccaatcaattctgcagtcgtcacttgcaccaacttagggaacttcttctcttcaggcaagttaattgagtcagttacgataaccttctcaaagactgagttttgcaagttgtcgacagctggacctgagaagaccgcgtgtgttgccacaacgtaaacttcagcagctccttcatccttcaacttttgtgcaccttgtgaaatcgttccaccagtgtcaatcatgtcatcaatcatgattgcgcgcttacccttaacatcaccgatgatgttcatgatttgcgccacgttcgccttaggacgacgcttatcaataattgcgataggttcttgtgaacccaacaattcagccaatgcacgtgcacgcgttacaccaccgtgatcaggtgacacaacaactgtgttgtcatcagcaataccagacgtgattaggtagtcagccaacaaaggcgctcccatcatgtggtcaacaggaatgtcaaagaatccttggatttgcgcagcgtgcaagtccaaaaccaagacacgcgttgcaccaaccatctcaagcatgttggctaccaacttagctgagataggttcgcgtgaacgagccttacgatcttgacgggcgtaaccatagtaaggcataaccacgttgattgactttgcacttgcacggcgcaaagcgtcaatcataatcatcaactccatcaagctatcgttaacgggtgctgacgttggttggataacgtaaacgttatcaccacgtactgactcttcgatattgatttggatttcaccgtcactaaatcgtgcaatgttaatttgtgacaattccacgccaattgaagcggcaatcttttctgccaaaggctgattgctgctcaatgaaaaaatcttcaaatgcggatccgcatacgtcgccatgttgtcctccatagacacatcactgtgttcctcaagtgttcaatagttacattgtaccgtttttttgtatattcttcaacgaatacgccgttcagatttccgaacactttcatattctcttcgaatttcgttaacgaaaaaagcgacaccacaaacatggcatcgctttcattaatcattacttattttcaaaaaaggcatcccaagcagccttagcatcgcgctttgctgattcggtatcatcaaacttttcgtgcaatggcgtacggttccagaaatcatacttcgtcacttgacgcgtacgagcaattcccatcgcgtgcgttggcacatcatcagtaatcgttgagccagcagcaataaaggcttcactaccgatgttaaccggtccaacaatcttagagtttgaaccgataaaggcacggtcaccaacattcgagtgccacttgtgcaaaccatcgtagttaacaaagattgaaccagcaccgatgttaacatccttaccaattgtcgcatcacctaggtatgacaagtgtcccatcttagaacccttacccaagtgtgccttcttaacttcagtaaagttaccggcgtgcgcttcaacatccaagtaagcagctggacgcaagtgcgcaaacggaccaaccgttgcgcgctcacgaatttcggcttcttcaaagtgtgatgcatccacttgggccccatcagccacaattgaatcaaccaaacgtgagcccgtcgtaatcaaaacgtttgatccgatttgcgtcttacccttcaagtaaacgttaggctcaataacagtatcgttaccaatcgtgacatcaacatcaatgtacgtgttcgctgggtcaatcaacgttaccccgttacgcatgtgcatttcgttgacgcggtcacgcaaaaccttgtttgcacgggccaaagcaacacgatcgttaacgcccattgattcgtcaaagtcgtccatcacaaacgcaccaaccgtgtggccttcgttgcgcaaaatctccaacgtatctggcaagtagtattcaccttgcgcattgtcattcgtcacttgcttcaaactgctgaacaacaattggttgtcaaacacataaacacccgtgttgatttcatttatggcagcttcttctggcgtagcatccttttgctcaacgatgcggataacattaccgttttcatcacgaataatgcggccgtatccagttggatcgggtgcaatcgccgtcaagacagtcactgcgttacctgattgctcgtggaaatcaaacaacttgttaaacgtatcaaccgtaaacaaaggcgcatccccagaaccaatcaacgtcattccttcggcgtcacctagttgtggctcagccatttggatagcatgtcccgttccaagttgttcagcttgcaacgcaaactctgagcgaccagccaaaacagcttcaacgcgctcagctccgtgaccgaccaccgtaacaatcttttcagcgcccgctgcttgagacgtttccaaaaccatctcaaccattggcttaccgccgacttcgtgtagcaccttaggtaggtcagacttcatacgagtccccttaccagccgctaaaataatgacaaaacgttgcatctttctttctccacaaataaaactttaatcagcagaagtggcgtcagcaggtgatccaccaccgtaaatttcttcagcgtagtttcctggctttaccttgataatgccgtcatccttgttggtatcaacgtgtaccaaagatgtgtacttatcaatgacgcggtgttcaacgcgaccttcagccacgacagcaacaccgacaacttggccttcaaattccttaaccaaagaagccattcctcgaattgtaccaccagccttcatgaaatcgtcgacaataaggacacgagatcccattggcaatgaacggcgtgacaattccatcttctcaagacgttgtgattgaccagtaacatagttaactgacatcgttggtccttcggtaaccttagtatcgttacggacgattacaaatggcacattcaacttttcagcaacggcttgtgcaactggcacacccttagtagcagccgtcataacagcgtcaattggctcacgcaagtattgcgtggcaatcaaacggccgatgcgttgcaagaaccaaggttgtcccaacaaatctgacaagtaaacataaccaccaggcaagacacgtgtctcgtcatcaatggcgtttaccaaagaagcaacaaattcttctgcttcagtttcaagcatgtatggcgtaaagcgtgcaccaccagcagcacccggaatcgtctccaatagaccaataccgcgctcttggaaagtgcgcttcaaaatcgtcaagtcttcagaaattgatgacttggcgctctcatataattctgcaaattgtgtcaaagacaccaacgtacgtgggcgctccaataagtagcgcgtcatatcgaccaagcgatcactgcgtcgtgttttcatatctcattaaacctcgaacgttcggtaatttttattattatgacttaattataacacgttcgttcatgtaaaaactcaaaaataggtttaaaaccgaaattacaaaaaaatcacgtgggttttccacgtgattttcggacgttcggctttttaagttaaccgtttaactaattattgccaagaaattgttcgttcctcaccatcaactcgagcacccaaagccaattcattaatctcgggttgatcaaatacaggcagcatctcagcaaacgtatttggcaacacataccgtccatcaagcagcttttcacgcgtcgtccagaagatttcaccttcccgacctgagtgaatcgttcctgaatactcagttgccttgtacaaaaagacaatatagcgcgcaccattgtctagtggccattccttgatgcccatcaattgcgggttcgcaatttccaaaccagtttcttcacgcgcttcacgaaagacagactgcgtcaccgtttccccgacttcaacgtgaccacccgggaacgtcacgccgggccactttggatttttgcggtcttcaaccaatacctcatgagtctctggattctcaatcataatcatattcgttaattcaatcggtgtgtatcgatctgccattactactcgctcctttttgtgacaaaaacagctcagctgacaaatgccaactgagctgttacaaaattcatttttagcgaattagcccttgaagacccattcgttgccatccttggccaacaaatcgtttgatgcttctggtcccattgaacctgaaacatagttagggaattgttcacgcgttgcatcccaagcttcttggattgcatcaacgaacttccaagcaattgctacaccgttccagtcggcaaagtttgaaccgttaccgtccatagcgtcgtgaatcatacgctcgtatggctctggcgtcaacttcttgtcttcgtctgaaaccgtccagttcaagttaacaacacgcgtcaagaattctgacgtcacgtccttagcgttaatcttgaactcgataccaccctttggatcaatcaaaattgtcaaaacagggttagccaattcaacgtcaccgccgaagatgttcaagcccttcttgaagacaacatcgacacgcgttgacttagcggccaaacgctttcctgaacggatgtagaatggcacgccttcccaacgatccatctcgaattgcaacttaccagccacaaacgtgttgttttgtgaatctgctggcacgtccatttcgtccaagtacttcttttgtgtaccatcggctgactcgccgtattggccacgtacgaagttctcggcaacctcttcacggttgtaaatcttcaatgagttaaaggctgcgttcttggcagcacggatatcaacgtccttaaatgacgctggcttttccatggccaaccaaccaacgatttgcatcgtgtggttttgaatcatatcgcgcaaagcaccagccgtatcgtagtatccggcacgctcttcaacacccaaaacttctgacaaagtcacttggatgttttcgatgtagtccttgttccatgcagcgtcaaacaatgggttaccaaagcggacagcagcaatgttttgaaccatttccttacctaggtagtggtcaatacggaagatttgggcatcttcaaaggcttctgacaattcgttttgcaactcttcggcagtaccaaacgatgttccaaatggcttttcaatcatcaaacggttgtactcaccgttttcagtaatcaaaccttctgacttcaagtacttagcaaccgttccgaagaaacgtggggcaactgacatgtagaaaatgcggttacccttcaagctgtacttggcgtccaattcgttgttcaagtccaacatagcagcataaccgtttgcatcagtgatgtcttgttggatgtagtagaagtgagaaatgaattcttcagcatttgcttgatcttcaacgaagtcagcaattgattcgcgaaccatttcgtggaactcttcagtcgtcaactcttgacgggccgtaccgataacggcaaagtgctcttgcaagaaccccttcttaaacaagttgtacgttgatgggtacaacttacgcttagccaagtctccagttccaccgaagaatgtcaacaatgttgtaatttctgcaggcacgatgaatgctcctttactctcaaaaaatcgaaataatcattagcttataagttcaaatcagtaacagtatctcacactcttactcaataaccacattataaacttttttacagcgttttgccacaaaaatgtaaaacgcttacattaaaaacttatgacatacattttatatgcttaaccctcagaaaagtatcgcgttgcggcgattgcattatgccatccattcaaaagggcttcgcgacgttctgccggtaatgatacatcaaaatgacgaccacgttgaatgtattgggccaggtctgacaggttctgccagtacccaaccgctaagccggccaagaacgctgcaccaagtggtgttgtatcttcgtcaattgaacgctcgatttcaatgttggcaatgtcggcttggaattgcatcaagtacggattacgtgacactgttccatcggccttcatcttaacgacatcatacttagattcagctttcataatggccaaaatatcagccgtttgatacgcgattgattgcaacgttgccttcacaaaatcagccttatccgtgccacgtgtcataccgaacactgccccacgaacttgtggatcccaatagggcgctcccaatccgttaaaggccggcaccacatacacctcatcattattttgtgactgctcagcaagttgccaggcatccaattgcgtttcaattaagcccaaacggtcatgcagccattgcaccgccgatcctgctgagaagatggcaccttccaaagcgtaggtcggttcatcaccaacttgataggcgatggttgtcaccagttgattttgtgaggtcaccggctccttaccggtattcatcagtaagaaagcacccgcaccatacgtgttcttaattgtgcctggctcaagcgctagttgcccaactagtgatgcgttttggtcaccgatgacactggcgactggcacacgaccaccaaagaattgcatcggattcgtctgggcaatcacctcactgctggtgtgaacagttggcaacatgcttgccggtatattgaacagctgtaatagctctgcatcccaagcttgtgtgtgaatgttataaagcatcgttcgtgacgcattacttgcatccgtggcatgtgtttcaccatccgttaattgccaaagcaaccatgtatcgacagtcccaaagacaagctcccccgcttcagctcgttcttgtgccccggcaacgtggtctagaatccaacgaatcttagttgctgagaagtacgcactgattggcaatcccgtcttctcacgaatcatctcagcatgtccggcattattgagcgcatccgcaatggattgtgattgtgttgatgaccaactaatcgcgttgtaaatcggttgccccgtttgtcggtcccagataatcgttgtttcacgttggttcgcaatcccgattgccttgacttcatcgccacgaattccagcattaatcaacgcatccgcaatggccgtctgcgcagtacgccaaatatccatcggacgttgttctagccagccagtgtgtggcacgattggtgtcatttgcaccgctgttgatgtcacgcgacgcgcattgtgattgaaaataactgcacgggtccccgtcgtgccctgatcaatcgctaaaatgtattcaggtcgtgtaatagccataagctttccccaattttttcgtttaaaataatttcatcctctcttagtataacaagttgttagaatgtgctacacttttctgcataagatatacgatttagacatgtcatcaggcatgtcggatggaggatttatgtcaatctcgtcagcggatggcgaagtgctcaaaccgaagcacgtagaaattaaggccccaattctttatataacaaccctcttccagtcaactggtgcatcgctaatttggcctatcgccacgttatacatgcacaatgtgttgcacgagacaatgaccatggccggcttagtcgtcatgggcctatcaatcatgatgatgattggtagttgggttggtggacacctatttgataaatggagtcccttcaaatcaatcgccagtgccgttgcccttgcaacgacgatgttagccttgctaacgttctggcactcatggccggtattcgcggtatttatgctcatacttggtttcgccgacggtatcatctacaccttgttaaattcatacgccgctacaattcagtcgctggattcacgccgtgtgtttaacatgcagtacctatttatgaacgtcggtgtcgtggttggaactgccattgttggtttccttttcaatcacggtgtgcaatacgtcttcggtggcgcaaccatcatgtacgcgattttcttcgtgctagtgctccgccacttcaacgtgaagggtatgaccgcgcaagcctcaaaggaagctgctaaggctgccaagagtaacttcaagacaccggttttgatttacgccttgctcggtttggcattctcgctttatatgggatacattctgtgggagaccgttgtggcaacgcacatgaccgacctcggcatgacgacgcaagactattcattcctatggacgttaaatggtatcgtcatcattgttggacaaggtttgctggatcgcatcattgaaaagttgccattccgattgacggtgcttggtggaaccgccttattcgcgatttcattcatcttcttgatgagtgccaagacttatccaatgttcatcttcacctttatgattttgaccattggtgagatgtttgcgagtccacagatgccagcttggattgatgatattagtgatccaaatgctaagggtcgctcacaaggtatgatgaccatggcgatttcacttggtcgtgccgtcggaccgctatacggaggtttgatgattgacggcggttcatacaaagcgttgttcgggtcaatgtttggtatcatgatgctttttgtcatcatcaccttcatcctcgaccgcgctttccgcgcccgcaagcgccgtttaaataattaacctttgcaagcacctcaatttcggttgaggtgcttttttacgcaaaaaaataaccgccacatatctgcgacggttattagtagctctggcttttgtaagcttttaggagcatcgttgttaatttgattcacagccagaatgtcccctctcacgtgggacgttattctgctgtgactatcttacaaactcttgaaatcgaagaccatgcgtcccgtgatttggttgttgtgcattgcttcgataacatcgttaatgtcacgcacatcagcacgcgtcacgattggcttaaccttaccttcagcaccgaattggaaggcttccttcaagtcttcacgggttccaaccaatgaacccttcacttcgataccatccaaaacagtcttcacaacgttcaattgcatgtcaccctttggcaaagcaacagcaaccaacttacccattggacgtagtgaggcgattgattggtcaaaggcttgggtgttaacggccgtaacttgggcgttgtgcacaccgccaaccttttcttggatgatggctggcacgtcttccgtcttacggttgatcaacaactcagcccccatcttctcggcagctgccaacttgtctgggtttccatcaacggcaacaacgtgtgcaccgaagacattgtgggcgtattggatagccaagtttccaagaccaccagcaccaacaactgaaacccattgaccaggcttcgtctcaccaaccttcaatgacttgtacattgtgacaccggcacaagtgattgatgaggcttccattggatccaaaccttctggcaccttaacagcgtacttggcattaacaacaacttgttgcgccatggcaccgtcaactgagaaaccagcgttacggaccttgcggcagaacgtttcatttccagtgttgcagtactcacagtttccacatgcatcgtagaaccaagcgattgaaacacggtcaccaagcttcaaaaagtctgaagcaccttcaccaagcttcgtgacaattccaactccttcgtgtccgattacacggcggaatggacgtgggttaatttcgtttgggtttccaaaatcaccagcggcaacgtgcaaatcagtgtggcaaagaccactgtattcgacgtcaaccaaagcttctccaaagcctaaagcgcgtggctcccaatcatcaatcaagtctacaaatccgtctaggttctcacgtacgacagctgctttcatttcaataatctcctcaaaatcgcaaattgttacttacttcacaagttttattgtaaaatacttcacaatgttatgcaagcgctttcttgaataaaaataagaaatgggacaacaaaaaacgcgtcctcccaaatggcggacgcgtttctaatttttaatccaatgtaataatcttttcggcgctaaatgcatagataaaacgacgtggcattggcttacccatcgcaacaagtgcttgcgcatagatgtttagctgaccagagtagcggctcgttagcgtttccgctgcgtcctccggcgtgacacgatcagtcttgtaatcgaataaccagacctcaccatcaacttcgaagtaaccgtcaataattccgtggaccagtaccttctcatccccttggaaccccttgtacaaacggctagcatccaacagcaatgagaattgcacttcacgttccaatgaatcagcatgcattaccatttgcttaccaagtggcatttccgcaaagaaacgttcgatcttagccaatgaaattagcggtgcaacccgttcttcaatcaaaccttgcgtggtcaaatcagcgaccaattcacgcaagtcatcacgcgttggcgcaccatgttgcaaatcaactcgttgcaacaccaagtgggttgccgtaccgatggcagctgatgaaatacgcgtttcggcttcttgcataaactcaggttccggcaaggtttcgtcagtcaaacgtagtccactcatatcggcaacatctaggcgggcatcaactggaccacggcccgcttgcaaatcagggtcttcaaacaaacgcttgatttcagaaactgattgataagctgtcgcacgcgtcgcttcttcaaagccgtaatcaaagttaaggacttgatgccaatcggcattcgcaacaacgggcgcattcgcctctgttgccacgacagcttgtggcgtggcaaccgcttgatacgcgtccagcgctgaacgcaaatctgcgctatccacaatttcaagaccaaaactaaatggcttcttaggggccttggcacgaatttcgctgaaatcaacgacatcatcctcatcatagcgacccaacgcctcttgtagcgctggcgcttgtgggtgacgcatcaacgccatccccatcaaatccataaacgactttccagacaggcgcacccagtccggcaacatccaatcggaaccattttcagctaacgaccactttgaccatagtgccttcacgctactgtatgagcccaccataaagaggtgttgttcggcacgcgttaaggccacgtatagcacacgcagttgttccgcaaaagcgccacgaatacgggcatccttcacaaattcgcgttgtggcgttggcaacttcaaatggtgttccaaatcgacataatccataccagctcccgcctgggcatccaacaggacatcacccatcgtttcgcgctgactaatcatcttacgcgtactgttcaacacaaagacgattgggaactccaacccctttgaacggtgaatcgtcattaatgacacactatcactcgccacgttggcatcagcttcacccaagtccttgtcttgtgtttgcaactgcgtcacgtagttaatgaactgatacaagccaacaaaactactcttttgatacatcgccgcacgttcatatagggcgtgcaagtttgcttgacgttgtggacctgatggcaagccaccaacataatccaaccatcccgtcgtgttgtaaatctgccatagcaaatccacaatttgattctgaaccgccagcgtacggaatgtttccaagtcggccaagaagcgttgcacggcagcaattgtttcatttaccaattcaacagaaaccccttcaaccgaaattgtgagcgggttgttcgccaacgccttcacggccgtaaagaaatcatcatccattgcttgggtacgaatcaacgccaaaccgttttcatcaataccgtacaaaggtgaacgaagcaccgctgccaacggaatatcttgatgcggattatcaattacttgcaacaaactcatcatgactgaaatttcagtggtttggaaatagttttccgccccattcaccacaatcggaatatccatctcacggaaaatgtccaacacatccaagttctgattcttagttggcaccaaaaccgtcatatcactatagcgaaccggacgcttctcacccgctttacgatcaaagatttcgaacttcgtatccatcaattctttaatcttcaatgccatcatgcgaatttggccagtcgccttcgtgaaaccatactcgttcttcacatccggttcgtcttcttcagcgtcgtcggcatcatcttgatccaagtacaccatcatttgggcttcctttggcaagtcagccggatagtaatcagcccccgcaaccaattcggcctcaccggcgtattccacatcgcccaattgttcgctcataatctgcgcaaaaatgtagttgatgtagtcagttacgttcggttgtgaacggaaattctcctgcaacgtaatcacggtgttgccgtcagtcttgggatacgtcgttagtttatgaccaaacaacgttggatcagcttgacggaacttatagattgattgcttaatgtcacccacttggaacgtgttatcaccagtcgcaatttgtgacaaaatcgcttcttgcagttggttcgtgtcttgatactcatcgaccataacttcgttgtaacgcgcttgtagttcagcagctaccgcgggttggctaacgatttgcaacgcaaagtgttccaagtcgttaaaatccagcaccttgcgacgaagcttctcggtcaagaacgcctcgcggaaagattgcgtgaaatcaaccaattgcttaatgacttcaccagccccaccaatggcaagttgcataccggcagcatccaaagcaaagtagttttcttgtagcttctcgaaacgttctttgatttgctcacgttgggccttaactggctcccaagccgcctttagttctgggtcatgctttgacgtaaagttctttccttttccgtcttcacctttaccccaacccatcaaagtcactgctgcaaatgcctgacgtaaatcatcccaactagttggcgtatcttgtaatagcgtcaacagacgaccatacgcattggcatcgttttgaatgttcagtaaacgatttacagccggtggttcatccatcgtatccggtgcttgattaatcaactgtgtgatttggtcattaatggccaacatctcactttgcaacgttggcaataattgcgtcttaaagaaattagatgatgcaaaatcatccccaatctcatagtcatccgccaagctttccaaccaggtcgttgtatctggtcgtgccatcgcaaagttgaacaacgtgaacactgattcttgcaacgtgcggtcatcagttgaacctgacgcaaattgggccgcaaacttcgcaaacgtttggtctgggtcctcagcataacgttgctcaagcaaatcaccatagacttccatcatcaacaaggtacgctcggcatcatcagacaatcggaattgtgggtccaaatcaattgtgtagtgatattgctcaatcaagcgcaacgcaaacgcgtgcaaagtcgaaatattggcaacgttcaagagacgcagttgcttcaacaagtgctgacgttgttcaccttctgactcggccaacgcaccgcgaatcgcgccctcaagacgttccttcatttcagccgcagctgcttcagtaaacgttacgatcaaaaacgtattcacgttttcgccggccaacaagcgtcgaatcacacgctcaaccaagacacgcgttttacctgaaccggcggaagcagacaccaagatgttttgaccagttgtggtaatggccgcttcttgtgacgttgtaaaattcattagtcctctgccccctcttcttcatcttcgtcgcccgtaatcagattttgcatcgccttcaaagcatcgtctgccttgagctttttaatattacggtattcattccccatcatggcatcaaacatcatgaccggcttataagccgtgtacatcatacctgtcttatttggcccatcacggaatggcaatagtgggaattgtccggccaaaatgtttgtcgcaatttggcggattttggcctcgttaaattgcagtaacgtattcaagttgtcttccgtcacaacgtcagccgtcttggcaaagccaccactcttcaaacgcttcaaggcaaacggtgtcttcacaccttcaacaccttcaaggcgctcaatgtaggcttcattgtcacgcaagacaccacggtaagcgccttggctggcggctgctttatcagcttcttcctgcaattcagccaacgaagcacctgaaatatcagtggccttaatccatggattttggagtgaccagaacaccgcaccacccatttcactggttagtagcacatccgcgttggtcagcatcgccgtccaatacgtcatcaattgcaattccaaaccagcataggcttgcgtgtagtcaaaggtacgcttaccagacttgtaatcgacaatcgtcaagaagttaccggccggcgtttccaccaagtcataacgatccactttcccgcgaaccgtcacgcgaccaattggcaactcatattgcaccggcttcaacttgctctgtggcaaaccaaaaccagcttcaacaccaagggtatgcaccccaccgtcaattaattgaccgcgcttcatgttctgaactgtatcgtgcacttgttccgccaaacgttgtgtcaagaattgcatacgggctgaactcgtgaagatatcaaacgtcgcatccccactttgaagcaatccatgcagaatgttttgctccaacagacgtaattctgcatccgtgaattcactcaacgtcttgttctcacgaatcaattccgtgaacaaacgttccagaatcgtgtgcatcaacgtccccttttcagccggcgttagttggagcacctgacgctcttgcaaacgcaaaccgtattgcaagaagaattcaaatgggttcttcgcatagttctcaagacgtgaaatcgacgccttcagatcattaccgaatagctgactcatcaacggcgccatgatttggcttggtcggttttcatacgtcaaaccgcccattacacgggcagcctgggctggtgtcagttgcttaatttgtgcctgcaagccttgccaagcaccgctcaattctgccgactgacggtcttgcttttggttttctgcttggcggttcacaaccaccaagtgtgcgagcgtacttgcaaccgttccaacgtattcgtgaacatccatcgcacgtggatcaggcaacgccttgaactcatgcaccggttgatggaattgacgcaccaaacgcgtcacgtacgttgacgcttgttgactaccttcaccatcactagtggcgtacaaccaaatcatgcgggttgctgccgtcatcatcgcgctgtacatcaacaaggattcttgcgccatttgttgctcagatgtttcacgcaagaacacatgctctggcagcttgtcttgcaataattcacggtcaccatcgtgcaacaacgcctttgtacgagtcgttgctggcaaattaacactggttgccccaaatacaatcaccgtgtgataaccctgacgttgcacgattccgctttcagacacacgcacctggtccatcgttgctggaatacccgtgtacttggcactttcaaacgccgcttggagtagttcttgcaacgtttcaaccgtcatttcagtgtgatcaaacactgccacaaagtcatccagcaccccaataaacgtgcgccaaacttgttcgggttgttgggcagcccataggtcacccgcttcaattgcggcatcacgccaggcaatcaaacgttgttgaatgccgatttgcgtcaaaaagccatatagttcacgcgccatctcacgggcatctttggcttccgctaggcgtgataagaatggcgccaccacctgactgatttggttgtgaatcaatgccaattgggcatccttagccgccacgtgttcgcgaaccacttcatcatccgaatcggcgacgttgcggtcaaactgccatggcgtatcatccgtccaacgccaccctggcaaattcttagccaacgcatagttttccgtttccgccaacgcctcgcgataatcggccaatgtgacatcttcaggcaataatagctccgtcttcaacaaccccatcacatctgaaatcgtgtaggctggtgccaaacggaacaacttgtccaaaaaggccacgagcgggtgcgcccccattggtcgatccaagtccataaacaccgggatttcgtaacgggcaaacaccgctggtaagatattctcatattgccccaagtcacgcgtcatcagcatgaaatcacgatagcgtcgcttgccactggccacttcttggcgaatcatacgggccatttgctcaacttcttgatagcgcgtcgtcgcttgccacacatcaaaatcaggtagcggtgctgattgcgtttgttgctgaataccgtgttgttcataatcaatccagaacgattcaatcgccgcaattgtgtcacttattggacgttgtgctgttacagcattcgccgtcaccgggacatcatgcgccacagcgaaatcacgcaattggcgtgccaaacgcttaggttggtagaacaagtcattttctgacaacgtcacatctgagacactcgcagccccgtcgtcagcaggcagtgcaatcgccacgccacctgcacgttcaatcaaagcctcaacaaccccgcgttctggtgtcgtcatttgtgaatacccattaataaagtagtaatggtgtgacgtatccgtcttttccgtcgccaaataaacgcgcaaagccgtcagcaattcactattcagatattgcccacggttggccaactcttgatccagcgcttcaccaatcaaagccaggtcctgcaacttcatttgcaacgtgccttgtcccgataggttttcagccatttcacgcacttctggccacgttaaaccagcttgctttagctcaagaatctgactcgcaaattgactaataaacccttgcttggtcaacaaactgccgtacagcaccaattcatcttggtgttcacgtagcaaggcctgtactagcatcgtcataccagtcgctgacaaattggcttggcgataaatcgggtcatcttgcatgtagtaccaagctaaacggctcaatgaaaagacttgcacgtttggcactgcgactgcggccccgtgacgattttccagctcagccaaacgacttagcacttggatttctgtttcaaacttaatgtggttcggtaccacataaaaaatctcggcttgctcatcggttgccaagaccttctgcacacgctccaatagcgctaattcatggtcagcactcgcgcgaccaaacaacaattctaaagccatgtgcgccccctttttcataacgagttgtatcctctcattttaccagctatacgtgaaaaaaggccccaggcttttgcccagagtctgtcagatttttagttattgcgccaactttaacaacgcttcagcaaagattgccatcgagcgcgttaagttagcaactggtgttgattcatttgcttggtgacttgtgaccggcacatccgggaactgaccaccaaaggcgacgccacgcttcagcaaacgggcatacgacccaccatttgatgtgcgcggattcataaacatccccgtctgcttggcataaaccattgataggacaccaaccagttcatccgtttccggcaccaagtgtggttccataccccctggccacacttcgaccgtcgctttaaagtcgccaaggtgtcgttggacttgggtcatcaccgcttgcacattaaccccttgcggataacggaagttcagcaaaatcgttccctgtccattcaaactaaaacgcatcaccccgacgttcaacgttaggtcacccatcgtttcgtcgtgataacgtaaccctaaattgtcagcgccaatatcgtcatgcaccgtctcaccaacaaactgcaaaaaggtcttagcatcatccgcaaacgcataccggtttaggaaatgtgccaaatatgtgccagcattctcaccatcttgtgggtaagcaccgtgagcctggaccccgttcaacaagagccgtaattcttgtcccttaatttcggtcttaccactcaaaaatggatattgggccaagtattgttcaaaatcatgcaccatctcgtccgggtcgggcacgaccacacgcgcacgcgcatcccctggcacaacatttggacgcgttcccgcaatgaaacgacgcaaaatatagtcgccagtcgagacactcggaaagcgtaattgcacggtttgaaaggccttttcaccattcacaaccggaaacgccccgtccggtgagaagcccatcgttggttcgccttcctgttcgaaatagcgtggcaaatcacgccaaccattctcttcatcagtcccaataatcaagcgaatcttgcgagttaatttaatttcgtggtcagccaaatacttcatggcataatacgcactcatcaagtcagctttcatgtcagccgccccgcgaccaaagtataagccatccaaaatttccggcttgaatggatcgcgtaaccacccgtcgccagccggcacaatatcgatgtgtgtcagaattgccacggtctcatcagcgtcggctggaccatattcgatccaggtcaccatgttatcgacacgaccataacggaaaccgtcacgggcagccaattcttccatcttcgctaatgcacgcaccatgtcggttccaaatggtgttagctcagtttgtgtgtttggatctagaatcgatgatattttaacaatttgattcaaatcttgaatcaaatcggcctcataaggctttgttcggtcagcccattccatgacggccctcttttctcatttgtttttaatactttgattttaacgatatctgttaacactgtaaagtaaaaaagctaccaggtggatacctgataactttgcaaaattcattaagaacgcttcttgttgtagtagtagaatactggcaatccaatcaaaaccaatacgattgaaatggcagcacctgtaaagtcgttaataaccgttgaaccaatcacaaacaaggccccgaaaattgcaaccaatggcgtaattgggaacaatggcgtcttgaacaaagtgtccatttcttctaacttgccttgcttgacttggcgacgcaacatgaagacaccgaagaacgcagccgtgtagaaaatccagatagtgaagatggcaatgtctgacaaacgatcaacacctgacgtgtagaagattgccaaaaccaacgtcataatcgttaccgtcgcaatggcgttcgttggctcttgcgtcttacgtgtcaactttgacaagtacttagggaacaagccgtccaatgacattgcatacgccatacgtgggaatgacaacatcttaccgttcaacgttcccaacattgaaatgataatggccaaactcaaggcgcgtccaccaaagtcaccaaacgcagccttagcaaccgcgaacgtcgcgttgttttgcaaagcgacaaccttttcagctggcaaagcgtggtaaacaccaaacgttacaccaacgtaggcgatgacgatcaaaatcaaaccaccaacgattgagcgcggcacatcacgacgggggttcttcaactcaccggcgatgtttgacaacaaaatccaaccatcataagcgaacaacgttgccaagatagccattccgaagccaccacctgattgtgagacttggtgaactgtttgtcccaaggcatcaaccttaccaaagaacaaaccgtaaatgatcaacacagcgattggaatcaacttaattgacgttgtaatcacttggaagctagcagccacacggttttccaacatgttcaatcctgcgatgaacaacaggaagacaactgaaatccaagttgcagctgatgttggcaagcccaagaagttagccgtcaaaaaggcagcgtaaccagcaattgaggcaatgacggctggtgcgtagatgacaacttgcatccatcccgtcaagaatccagcagctggaccgtataactcttcgatgtagctgtacaacccacctgtctttggcaagcgggccccaatttcagcaatcgtcaaaccagcagctaacgtgatgacaccaccggcaacccatgccaatagtccaagcgttgatgaaccagctgtttgcaaaaccccggcttgcttaaagaagattccagaaccaataaccgttccgataacgagtgataaccctgaccaaattcccattgatcgttttaattcaactttgttttccatgacctactcctagattattccgttcttgcataaaaaaacagccacccaatcccagtgattggatgactgctaatcgttctcacagttcaagcgttaaacgaaaacgcccaatcactttttgtgttgagttgaaacgatcattattattattgttgttaacaaaactgaacataatcatttctccttccaaaaagtgtgcggttttcataacgattaaaatcttatcatattctaagaattctgacaataaaaaatggtgaacccatttggattcaccatttctattagttacttattaagcttcttcgtaccatgagtagtggtacatttcaccagctggcttgtccgtacgctcgtaagtgtgagcaccgaagtagtcacgttgtgcttggatcaagtttgcaggcaaaacttctgaacggtatgaatcgaagtatgcaaccgcagctgacaatgatggcactggtacaccagcagccgttgccaaagcgattacgcgacgagcagctgcttggtacttctcagcgatatccttgaagtatggatccaacaacaagttgtgcaaacctgcttcgttgttgtaagcatccgtaatacgttgcaagaagcgggcacgaataatcgcaccagcacgccacaattgtgccaactcaccgtattgcaagtcccaatcgtagtgatctgaagccatgcgcaattggtcgaaaccttgtgcgtatgacatgatcttaccgaagtacaaagcctcgcggatgtcttcaacagttgcgtcgatatcaccttcgaagttgaattctggaccagccaaaaccttagaagcagccacacggtcttccttcattgctgaaatgtaacgtgcgtaaactgattccgtaatcaatgattgtggggcaccaacttcaagagctgattgtgatgaccactttccagttcccttgtttccggcacgatccaaaatcatatctaccattggcttacctgaacccaaatcgtcatcacgcgtcaaaatatcagctgtgatttcaatcaagtatgagtccaactcacccttgttccactcagcaaacgttcctgccaaagcatccttgtccaacttcaacaagcgcttcaacaagtcgtatgactcagcgatcaattgcatatcaccgtactcgataccgttgtgcaccatctttacgtagtgaccagcaccattaggtccgatgtaggcaaccgttggcttaccatcttcaggggccttagcggcaatttccttcaagattggctcaaccaaatcataagcttcgcgttgtcccccaggcatcattgaagggccttgcaaggctcccaactcaccacctgatacacccattccgatgaagttgatgcctgattcagcaagcttctctgatcggcgcatcgtgtcctcaaagaacgtgtttccaccgtcaatcaaaatgtcacccttctccaagaatggtagcaattcttcaataacagcgtcagttcctgcaccggccttgaccatcaacaaaatacgacgtggggccttaattgacttcacgaattcctcgacagtgtaaccaggtacaaacttcttatctgagtgcgtttgtaccaaatcttcagtacgagcgcttgaacggttgtataccgcaaccgtgtagccacgtgattccacgttcaaggccaagttacgacccattacggccaaaccaacaacaccaaaatctgcagttgccatgttttattatcctccaaagtgtgtccttaatccctcgattgactataagtctagtcttctttattttaatgtcaaaacaaaaagtgtctgtgaattaaatgtgaagttgtttatgacatatacaaaaatcagataatcctatgacaataggctgtattactaatttttgcaaagaaaaacccacgcagatgcatgggttagtttcattattcatattgtgccaaaacggtagcgacaacgtcatcgctagctgaagtcgtcatgaaacgacccattggcgtaatctcgtgacgatctttaaaagctaacttctttgtttcaactaacatgaccgtcaaattattttcagtcaaaaagagttggccaggcttacctaacttgcccttcgtatgcttaccaatgcgccagctgtgaaaatcagctgccgttagcggattttcctttggctcataagcaccactattactttgcgtcatcacaacgccaattaattctgctgttggatatttatctgccatgtttaacctcggtagtatgcccacggtacttgtggatcgaattgctcatcagttgagacaacgagccccttcttaaagcgcgtcaacaaccagaaacggagtggctcagggataccaagcatctcaaaatcactcgttgagatagcatagcgaatccctttttcatcattattcatgactttttgcacccagtttggatcgacaatcagttcacgtgcaatcgcagctccatcaacgccggcttgcacaagcgcttcaacttgctctggcgtacgcaacaaaccagcgacaatcaacggaacgtcacccaaaattgccttgtacttggcataaagtggctccttatcttccttattcataaatggcgtttggaacgcatcctttaatgagatgtggaagtatgaaattggtcgcttgataatttcttgagccatcgctaatgaatccgtaaagcgaataccaggcgtcgttggctcttcaggtgattgacggtaaccaataatgaattgctcatccgcaaattcatcacgcgctgcgactacggcatccaaaactgctaaaccgtaacgcatgcggtcgttcaaatcaccaccccattcatcagtgcgttggttggcgtgctctgagaagaattgttgcatcgcatacatgttggcaccgtgtaactcaacaccggcaaagccagctgcaatggcacggcgagttgcttcaccaaagtcggcgatactttgacgaatttcctcatcggtcatcggacgtggcgtggccatccctggttggtgacctggtacatcagaagggccaacgacgtcatcgtgcaataccgctgccgtttgtgcaatacggccaccaaacgacaattgcaaaaccggcactgatccacggttcttaatcacgtccgcaatcttcttcaaccctgaaatcttctcatcagagtcaatgccaatttgaccaacgtatgtcttaccagccattgaaacgtatgccatttcaacgatgaccaaaccaggtccaccagcacgcatcttgtagtagttcacctcatcatcagtcacaacaccagtcgcaaaagatgatcgcaaagtcgttggtggaaatacgacgcgattctttatttcaacaccattcgccaacttgaatggttcaaggaatttataactcattgtcattaactctttcttattattagtgacactattatagcattatgtacaactattaaatttttgcacctctttttcttgcggaaacatcaccatgtccttacaataagtctattcatttcattgttaacattttcaagcaaagaaggggacacaaacatgaagtttgaaacaaaggttattcacggtggtacacaaggggatccagttactggtgctgttaccacacccatttaccaaacatcaacctatcaccaaaaggagctaggtggtggcgctaagtatgagtacacgcgcggtgagaaccctacccgcttcgctttggagtcagttatggctgacattgaaaacggaacggatggatttgccttttcatcaggaatggctgctatccacgccacaatgagtttgttgaaggccggcgaccacatcgtcatggccaacgacgtttacggcggaactttccgcttggttaaccgcatcatggccgagttgggcattaagtttacggcggttgatacagctgatagcgatgctttgaaggccgcaatgacgccagaaacaaagatggtttacttggaatcaccttctaacccattgatgcacgtgacggatattgctgaagcatcaaagattgcccacgaaggtggtgcaattgccgtggttgataacacattcgcttcaccatacaaccaaaacccattggacttgggtgctgacgtggttgttcactcaggaacgaagtacttgggtggtcacgccgacctattgtcaggattcgtggtcgtgaaggacgctaagttggctgagcgcattaagttcatccaaatgtctattggtgcagtcttgtcaccacaagattcatacatggtgcaacgttcaattaagacgttggctttgcgtgtgcaacgccacaacgaaaacgcgatggccttagctgagttcttgaacaaccacccaaaggttgccaaggtttacttccctggtttgccaggtacgcctgatcacgagattgctaagaagcaaatgcgtggtttcggtggcatgatgtcaatcgagctacaacctggtttggatgttaagaagtttgttgagaacttggatgtcttcttgttggctgagtcacttggtggtgttgaatcattgattgaagtaccagcagtgatgacccacgcttctatcccacgcgagattcgcattgctaacggcatcaaggatgagttggttcgtatctcagtaggtattgaagatatcgacgacttgattgccgacatgtcaaagggcttggatgccttgtaatattgataaagtaaactccccaacgattctggtcgtttggggagtttttcgttaggtagttggtggttagtgtccgtccaccactaactaacactcaaccaaaagtgcaaaataaaaaccgcgtgaacgtatatctacgtttcacgcggtttttcagtaagctactgataaagtcaaattactttgactccaattcagccttacccttggcccattgttggatgttaacaacttcagccacacgagccttctttgcagaatcgtgtgatgttggtcgcttacgagcccatgagttgtatggtgattgaacagccatgatcatttcctccatttatgttatcgataactttactagtataccgataaaaacaaagtgcgtcaaacttttatcccaaatccgtcaatttttcatcgcgtataagttgtgaacactcagcctgcgccgtatactaaggttactatgattacacaaaaaacaactttcccagatttcgtctggttccaagtacatgatatgactcctgaggaacgagcatggttgaccaaagaccaacttattcccaacgaactcctaagttatgccgtcgacccatacgaaagtgcccgtatggaatatgacgaagcagctgatttgacattgatgatttttgacgtcgtcacaccaacatcacctcgtgccacaactgaacccgttggcatgctctttagtaatgaccaacaacgcctctacaccttcacccgtgaggaaacggattacgtagacagctacctaagtggtaccgaagtcagccgccgtcccttgcccgaccacgccacgccacttgatgtcattttgaatggtacagagctactttcttcaaagtttatgtcggcaattcttgaaatcaatcgccgtcgtacgccaattcaaagtgaaattcgcaagacgaagcaaacgcaaaagacgattgatcaattgatggatttgcagacggatttgatttacttattgaattctttgcacaccgaccgcgacttgctacgtagctacaaggcccgccacaacattcaattgaccgatcaccaatcagaacgtattgatgacgtcacggtcgagttgcaacaagccatcgacaccggtgagttgtcacaactagttaccaaccgcgtttcagacgcctttgttaacctagccaattcaaacctgaactggacaatgaagctgttgacggtctcatcaatcgtcctaacggtacccaacattgtgtcagggttcttcggtcaaaacgttgaccttcccttcatgcacacccacatgggctggattgtgacgctcatcatcacctttattatgatgaccatcacgacaatcgtcctttggcgatcaggatttttccgcaaataaccacttacagcagagcctttttcaggttctgctttttctatttttcttgtggataacctgttgaaaagcagctaaccttcccacaagaaaatgagacttatccacaaaactccagacttttgcacacctacttgtggataaagcggtgcaaaaaagccgactgcaactaaatgcaatcggctaatttcgtttacttcaaatgtagtttgtgcgcgatagttgctgcgcgttggccaagaacactttcaccaacgtgagtcttcagcattgcaacaccgtagataccagcaccaactagaccaaccacaaccgtaacaaccaattgtgccatctttgtatcaggcacgaatagcgtcaacgtgttcgtcaaaagtgctaccacagcgtacataaccaagccccagaataggataaccatcaatgagaaattgaacggtgcccattcgatggcatatagcacgctaagtcggcggattgaaataatcaagccaaccgcaaaggctaggactgttgccatcaaaggtccggcaccttgcaaccaaatcgtcaaaggcacttgcaagatcaacttcaagatcaaaatcaatcccaacaccttcaccgtgaatgacaactcattcaacccttggtagatggccaagacaaccatgtacaagcccaaggcaatggccgtgaagctggcgaattgcaagattaacgttccatttgttgcatcattcgtgttatagaacagaatgtatagtggatgtgcaacggcggccatccccaatgaggcaggtaccatcacaaacgctagcaacttaaaggcgaattgaatttgatcaccaatgttctcgcggtcaccaatctctttagcacgtgccaacattggcaatgccgtttccgccataccaacggcaagtgacacaaccaacatgaccaacttgtttgagttaaaggcaaattgggcaaacatcgcttgcatcgcattatgcgttgctgaggtgaacgccctcataatgtggaagaacgtatattggtcaatcacttgcacaatcgcaatcgcagaaccagcaaagatgactggcaatgattggcgcgccatgcgaatcatgatttcgcgtgggttgaaatctggcgctggaatattcatcgccatcttttcagcaaagaacttacgacgcttccagataccaaataccaacacgatgattccggctagcgcaccccagaaggcagccaacgttgattcaaccgtggcatcgacccatgttccgtgatgaccaaccataatccagtacgtcattcccaacatgtaagccacacgaatcaattgttcaacaaactgcgacagcgccgacagtcccatgaactcgaatccttgcacgtatccgcgcaacatcgatagcgttggaatcaacaccaatgcggccgatagcgaacggataacaggcaccacgttcgcatccccttgtgataagactccggccagcaagtacaagatagcaccggctgcaattcctaacacaccaccgaactgcaacgcttggcggaagatgcgactcacggcttcatagtgacgtgaaacgccatactctgcaaccaaacgcgccaagacatttggcaaccctgccgtcgcaatcaacaaggccacactataaatttggtaaccttgtgcatacaatgagttggcagaattgaaatacacatttccaatcattgccacccatggaatgacatacaaggcacctagcacacgcgatgccaggctaccaatcgtcatccaggcagaaccacgcaacatacgtgacgctgcgttactgtcatcaactaaatcagtttcaatttctggaatggtcgttaattcatcagctaccataattggcgcctcagccaatgtctccgcttcttccgcgaaagcctcaggcagaacacttggctcagataccgtaatcgtttcgctagctggactaacaaccggcgcaacgtcaatttcactagccggctcatctgattgcgttggcaattcagaacttgctggcaattgtacgtcagccgctgcttcatcaattgcttcactcgcgaccgacttaggcgtatcctcacgaacaaatgtatctgcaacttggtgtaccttaatcgttgatactccttcaggtcgcgttaccacttctgccactgagtgcgactgcgtaggtgtcgttgtcgcttctgatgttaccttttcttcatcacgtgcttcaaagatgtcatcaatcgtggccccattgaggagagcagccaattcttcaaacgtgatgtcgcgtcggaatggtgactcttcatactggggtgatttttcatcagccatgttgaccgttcccctttctttcataaaaaaatgacgctacacagactcgaactgtgatctaagacttaggaggtccttgttctatcctgttgaactatagcgccaaagtattccaagtaactattatacacaagaaaacccgttgtttgtagttgatatgtaatatcaacccatccaacgggtatttcatttaggcgacaatgtcttgccactttgccagaattgccgacaattcaaaatctttggcacgttccaatgacttcgtagccaataagcaacgcatttcatagctttgcaacatcggttctaaacgataccacaatgcgtcagcatttttagctgccaactcaccatagataccaccgtccaaaatttcgaccgctcccgtattgtcagtcgacagaatcggcaagccaaagctcatcgcctcgaccaataccaagggcaagccttcccaacgcgatgtggcgaggaaaatcgaggcttgacgataatgttcagccaattcttcatcatgtaagccaccacgataaataattttatccgcgacttcattcgctttaattaaacgctcaaatgacgccatgtcatctggtagtccttcaccagcaatcgcaatctgccaatcatccggtagcttcttagccaagttcaacataatatcaatgcccttatgctgaatggcaatgcgacccgtgaacgcaatcgtatgcttgtttagatcagcccgaccactcactggcatcgtcaacggattccaaattttaacagcccggtcagtcactgtttggaagccttctaaatcagtttccgtcaatgccaccactgtatcggctgctttgacacccgccacaaattcagctcgcatatcacggtaatactgattaaagtaggtatcgatattattatgcatccaggcaatcgtttttagttcagggagtcgtgacttcaggtatggaataaagctcgttaagataccggcatttaaaatcacaacatcaattttctcttcaatcaaaatatcagctaaatcggtcatttgttgctgataggtgtgcaatggatcagggccatttgctggcatgaccggatgaggcgctgaaattaagcgtcctttcaattcatagtacgacggcacatcagccatctggtaaaaagcaaccgtggcgaattcagtcatggcattgccaacaacagttgctgctcgcttcatgccacccattcccaggttctcaacagccatcaaaattctctttgccatgccctgcacccccttgctttgcatactaaaagaggaacccccacaaatgcgagagttcctcttcagtatagtcactattgtttaaaaagtggcgctagatgtcttaaaacctgacatgcagattacaaaacaacgttcaccaacttacctggcacagcgataactttctttggttgtccgccatccagttgcttttgaacggcttcgtcagcgattgccaactcagtcatcttctcacggtcagcgtccgcaggaatcgtcaaacgaccgcgaaccttaccgttaacttgcaaaacgatttcaatttcgtcttcaaccaaagcagcctcgtcaaacgttggccatggttggtacgtcactgattcgttcttgtgcaagaagctccacaattcttccgtcatgtgaggggcaattgggttcaacaacttgatgaatccttcaacgtattcaacaggcaagttttctgccttgtatgcttcgttgatgaaaatcatcatttgtgagatggccgtgttgaaacgtagaccttcgtagtcttccgtaaccttcttaaccgtctcgttgtagatcttgtccaacttgtggtcgttaaccgtcgtgatgtggtcgcgtagcttgtcttcatcatcgatgaacaaacgccatacacgatccaaccaacgacgtgaaccagccaaaccgtcttctgaccaagcgattgattgttccaaaggtcccatgaacatttcgtacaaacgcaatgtgtcggcaccatattcttcaaccacgtcatcagggttaacgacgttacccttagacttagacatcttctcgtggttttcgcccaagatcattccttggttagccaacttttggaatggctccttagtgtggacaacacccaagtcgtacaaaaccttgtgccagaaacgtgcgtacaacaagtgcaacacagcgtgctcagcaccaccgatgtacaagtcaacgttcttccagtatgcctcagcctctggtgaaacaatttccttgtcgttgtgtggatccatgtaacgcaagtagtaccatgatgaaccagcccattgtggcatcgtgttcgtctcgcgcttacccttgcggccgttttcgtcaaccacgtttacccagtcgtcaacgttaaccaatggtgactcaccagtacctgaaggcatgatgttatcaacttctggcaaacgcaatggcaattggtcttctggtacaagcgtcttttcaccgtcttcccagtggataacaggaattggctcaccccagtaacgttgacgtgagaagatccagtcacgcaagcggtagttaacttgcttgtgaccaacaccttgctcttccaaccaagcgattgccttttcgatagcttcttgcttacccatgccatccaagaagcctgagttgatgtgctcaccatcgccagtgtaagcttcttcagcgatgtcaccgccggccaaaacttggcgcattggcaaatcgtacttcttagcaaattcgtaatcacgcgtatcgtgagcaggaacggccatcacggcacccgttccgtatgatgaaaggacataatcaccgacccaaattggcaactcttcaccattaattgggttaattgcaacggcacctgtgaacacacctgacttatccttattcaagtccgtacgctccaaatctgactttgaagcgattgacttcttaaaggcttcgatagcatccttttgatcatcagaaacaatttctgataccaaagcgtgttctggtgacaaaaccaagtacgtcacaccgtacaacgtatcagcacgcgtcgtgaagacttcaacttcagcatctgaatccttcaccttgaagtttacagaagcaccgattgagcgaccgatccagttacgttgttgttccttaatggcgtctggccaatcaacatcgtccaaatcttccaacaagcgatcagcgtaagccgtgatcttcaatgcccattgacgcattgggacacggtaaactgggaagccaccacgctccgtcttaccgtcgatgatttcttcgttggcaacaaccgttccaccattgtaatcaggggcccagttaaccatgatttcatcttcgtatgccaagcccttcttgtacaattgttcgaagatccattgcgtccacttgtagtacttagggtcagtcgtgttaacctcacgtgaccagtcatatgacaaaccaagtgtcttcatttggcggcggaagttcttaacgttctttgccgtcacgacacgtggatcctcacccgtcttgattgcgtactcttcagtaggcaaaccgaacgcgtcgaatcccattgggtgcaaaacattgaacccttgcatacgcttcatacgtgaaacgatatcagttgccgtgtaaccttctgggtgcccaacgtgtagcccttgccctgatgggaatgggaacatgtccattgcgaagaacttttcctttgagtggtctgatgacgtcttaaaggtttgattctcttcccagaagcgttgccacttcttttctacttctttgtgttgatatgccatgattgataacctcactttaatgttctaactttaacaaaaaaatgccgttctttcaataaatgagcgggtttataccggtgtttcacacgactaataattaatccaaattgtgatacacttagttaatgaaaaagtagtgaaagcgggtgtccatatgtttcaaatgcgtaagtttgattattttcagcttgcggttgcctttgcggggttaatcctatttattttattagcaattggctatacccaccatttgggttatatcgattggattgaccagtttggcttcaaacatatccggcaaccagtcacgccagagcgctcttggttcttccgtaacatcacccgtgccggtaacccaaagtggacgttgattgtgatgacagcgaccgccattgtggcattgctagttcgcaaaatcgacgtagccgtctttatcgttttgaacgtcggcgtcttcggacttggtgtcatggcactacttaagcacgttttccaccgaccacgacctgacatttatcatgtcatcagccaaggtggtttttccttcccatcgggtcacgcactcaatgccgtgctattatatggttcattgattgttctcgtacattattacttgaaacaacacgaccaggtgcgctatgccatcatgacattattcgccgcactggtcgtcgccatccccctcagccgtgtctatctgggtgtccactatttgtcagacatcctagccggttttggcttaggcacctttttcctaattatgtcgaaggaacttattttcaaatatcaaacacgagaggttttcgaacatgcgatcaactcagaatctagcgcaaatcacgctgaatgaatatttagtaccaggcgacttggccattgatgccacaattcgtcgtggcgacatcacgcgcttcctcgctagccgtgtgggtgacactggtaaggtcttggccttttcagatgttaaggctgaaatcgacgacgttgccacatcacttttcttgagtggtttgcacaatcgcgtcgacctaatcagcaaggacttctcagccgttaccaactatttggacccaacgaagccaatcgctgctgccttgttccaagttgacgaaaacatggatacggcgacattgacggcgaccgttaagacattgttgatggtcttgaagacaaatggtttggtgttgttgctaagtgacaacccagccaacctagccgacgcccaagcttacgtagcacaattgccaacggattcttacggtgtccaaaaatacgaagacgtcctaaccggcgaaaccgccttgttaatccaacgtcgttaatcaaaaaactccctgagcccgcaagctcagggagttttattttacttattaattggctcaaacaccgccaccgcttcaacgtgagcagtttgtgggaattgatccaacggttgaatgtcgcccttgatgcggaagcccttgtcaatcaagtacttagcatcgcgcgccattgtctctgggttgcatgacacataaacaaagcggtcgggattcatgtccgcaacggcatccaacaaatcttccgtcaaaccacgacgaggcggatcaacaaagataacgtccggcttcaagccaccgcctttccacttttgcatttgttccggtgcatcagctgtaacgaattcagcgttcttcacattgttgttagcgacgttcttttgcgcgtcgattacggcacgctcaatcacttcaacacccaacaccttgtcgacacggtcagcgaccgtcaaaccaatcgttccgatacctgaatacgcatcaataaccgtatcagattccttcagctcaccctttgttgcggccatgtcgtacaacacttccgtcgtttgtgggttaacttggtagaacgaatttggtccgatttcaaaatcgatatccaacaacttgtcgtggatagcgtcagcgccccacaacgtgcgattatcgcctgacgttaaaacgtgcaagctacgtggattgtggttcaagatgatactcttgatgccgtcaactgcctcagcaatatcagccgcaatcgcatcttcatccgtcaatgttgccgtttgcgttaccaataccaccataacttcgtgactgtaataaccacgacgtaccataatgtagcgcatttcaccttcttgggtatcgtcatcaaaaaccgataccttgtgggcgtccaaaatatcacgcacgattccaatgatttggtcgatcttttcgtcattaacgaagtaatcatccaatggcacaatgtcacccggcgtacgcttcttaatgaagccagtcgtcaacttgccatcaacatacttcaccggcacaaccgtcttattgcgatagtgggttggattatccatcccgatagtgggcgcaacatcgacatcaataccgtattccttgtacagcttttgcacctgttgttgcttcaaacgcaattgcgcatcgtaggccaagttgacatatggtgcgataccggcttcaagcaaataatccttaccagacgccacacggtccggtgacgcttcaagaatttctacaaccttggcacgaccgaacttacggttgacctgcgtcacctcaaataaaattttctcgccttcgaaggcattttccaaatgaattggataatcatcaaccatgatgactcccaatccagtgtaaagcacgtcgataacaacaccttctcgttgctcacccagctttaccggaataattgtattactcatattttctctcgtttatcctttttagtcgctttccattataactgaactgaattacttcgtgcgaccccacaagaaatcgatcattgcatggttcacctgctgattgttttcgtgcagcttactgtgttgtgcttcaggaccactaatcaagcgctcttgatatgactttggccggtcaccgagcaagtattgcagtgacttggccgatgtcgttgaaacgcgcccgtccgagtgcgtgccatcatccaaatcaccgtaaatgttcaacacatcaacttggttctttggataattatcttggcgggccaacaaccaatcatagtacgacaccgtcttttcgggcttaccgagaccatccaaatgattatcggaaacttgcttatcaatgccaacaatcccatcgaagtgacctgcaatcgatacttgcttgcgtaactttggcaatgacttatcttgaccgtatgtcatttcataagtcatcaagcccaggtttcccatcgaatgtgcaacggcattgaatgacttaatgccatacttatgttgcaatgcaaccacgacattctttatccacttggcatctgtttgataatccgtattacgattatctgaaaataccacttgcaccattggattaaaacggttcttatcccaatgtcctgacaacttcacgtgaccatcatcagtcacgcgcgccgtcaacattttcttagccgccccagatttttcagctgcccggactaaatcctttgttgaattcagcgtgccaccataaccgtgaatgaacaaggttggtgtgttcgaatagacatacttatctggattacgttttagcttcaacgaatagttcaaagcaaaaataaccgcaaaaatcgcgaccaatccaactataatactgacccatcttttcatcgtgcatccccctttgcattccgaatgagtgtttaattcattttttgtccgtgttcaatgacataggctactgaaactggcatcatcttgccactgtattctactgccaaagcgcgcgccgtttcgtcttgcgttggcacaaccgccacaaaagatccgtcatccaagcgatacatatccactaattgccccgcatcattcaacaagaatgaaaaatcaatcaaatggttgtagtcgtcaaacttgaacggacgctcatctacgcgttcttcgcggactggttcaaccggttgctcaggcatacctgctgccaattgcgcaaccaactcaaaacgtaggttcttcatatccaacaattgcgcttggaatgaaattggcgcttcatcaaccaccgaccgcacaaacttaggcaacaagcgctttggacgcgtaattggcgctgataattctgagaagaatgcgtagatactcatcttgcgatcaatcaaatcatccagcgtcacttcaatgtgcacatcatcgttctcaatgcgccaaggcaattcctgcccgttcttcaaatcacggtctgaaaccaatggcgctaccatcgtccccagcgtaatcataatcaagccatcaacttggttaatcgtcacatcaaattgcttggtggcatcttcaaacaacatccctaccgtgcgtgttgagaacatgtttaccatgcgaatatctgctagtatcgcagttgcggcatccgcattcttgtctgtaattaaatcgaccaactcgtggtacgtctcaaggctctcaaaatcagttggcgttaggattagttcgccataatcgtcaaacatttcatttagtaacatgtaataccattccaaactcttcttatttattaataatgataccagcgtttgcgatgcaatggtaatcatgagacactactggtagattcatcagaaagaggggatattatcgatgacaaaatatgataaagaagcattacgtcaacggctcacacctgaggaatacgccgtcacacaagaggctgctaccgaagcaccattcactgggaagtatgacgcatggttcgatgacggcatctatgttgatgttgtgagtggcgaacctttattcagctcaactgacaaatatgacgctggctgtggctggccatcattcactaagccaattgagaaaaaggccgttaagcgccaccttgatacctcacacggcatgttccgaactgaggtgacatcaacagatgctaactctcacttaggtcacgtgtttactgacggtcctattcaagagggcggattgcgttactgcattaactcagcagcgatgcgatttgtgccggttgatgaactagatcaacaaggttacggcgattacaaatcattattcgaataacgtaaaaaagacggcaatcatatgccgtcttttttattctaaatatttggtataaaaaccattgccaacacaactaaataatctggttctccacgtattctcggtaaagcggatgtgtattcataagttcgtcgtgtattccaaatcctgtaacttgcccgctttctaagaaaattattttatgcgcatcaacaattgtagagagcctatgagctaccacgattgtgactttatcaggagcttgactatacatagtatttttaataattttctccgtttttgaatctaatgcagaagtcgcttcgtcatacaaaacaatatctgcattttttaacaagattcttgcgattgataacctttgttgctgcccgccggagatattagcaccgcggatacctacacttgcctttaaacctaatggcatattattaacgtcactcaaaaatccagcttgctcaattgaaagggaaatatttttttcattaacgggttttgatagtccgtagattaaattatcattgacggtccctgtgcgaagaaaaggccgctgtgtgacgtaacctatatagttgcgccaactgcttaattggtagtcctttatattcgtatcgccgtattcaatacttccggaatcaatgtcatatagccgttcaataagcgacagtatagtagacttaccactaccagaggggccaactattgccgttacttctcctcttttcgcctcgaacgacacatcttttaaaacatttttttcagcgtcgtgatacgaaaaagtgacattcttaaaatttaaattcccagatttaataacggaaaatcctgaaatcaaatcctcagtcttatgattaaataacttgactaattcatttgagcttcccagagctttactagtttctccaaccagctggcccatttccgcgattggcgcaaccagctgaataatatacattagagaactaacaagtatccccaatgtaatttgcttattcgctatctggtaaactccaaaagatagtatgccaaagatatccaatatcactagcatagttacaaggggcacaataacggattcatacgcagtaccttgcaaggccgtactatatagctgatttatatttttcgtaccttggtttacttcgaaaacttccgtgctgtttatctttactagctggatattgtctaacacttcagttgcatcaccaataaaagtggccatattcttctgatttttaaccgttagtttttctaaaattgaaaccacaggaaccactaataataaaaacatgggtagcgaagtaagtaaaactaatgagaattgccaatttaatgtgaataaaataattaccgtccctaaaatcaaaataatcgactttattaactcaggaagtgtgacagataaaaatacatttacagtcgttatatcgctagtcaatcgagatattttttcgcccgttttccatgttgagttaaacgccattgaatattttaaataacgatcccacaaagaaattcggagtttttgaatagctaattgtccaaactttgcaagtatgtaccccgaaatcatcgctgctaatatttctacaagaacccaaataatcacgctaattaaatcatctgatttgattcctttggaaaaattatccaacagtaccatcacctttttggggacaatcaattgactaatgaccgcaattattccgaacaaaatccctacagaaaacaatctccatttaggttttgcatcatttatcagtactttatatgcttttatccttaccacgcctatatattcctaattttaaaaacaatcagtttgctgattatataattcaaaatgatgaccacgatattatcaataatcttccaaacaataggatcctgatttaggagttgaaccccaaaccaaattatcaccatctccacaaccagcgtcgctaatctagcaatcataaaagaaatgaactcgcgcaataattctaccttggtaactgctccagaattgaatacccagactctattagttaagtaagcaacaattacagctagtaaccatgaaacaacaacagctatttgcacgtttattccaacgaataaaaataatgcgtacgaaacaacgttgataattgttgttgttactccaaaaattccgtataaaataagtgccttatatttttcaaatctggcaaacatgcgtggacgctcctttgtaataaataaaatagaggacgaaatttctcacgtcctctaatcacttaggtcagtatattgtcaaattacccccacatgttgtgcttaatacggtagtttgtatatgccgtaatccacttaccaatcgtacgcatgacattcccctcctgctgataaatatttgcaactcactatgttcattacataacaaattatatctctaacaaaaaatttatcattaataataaatgcatttcatttcaaatattcgataataacaattataaaaatatgaacgaaataattaaaatacattaatagcatttttgtttttaaacaacaaaacattatgagcaaatggccctataccactagataaatagttcaccccagacacccttttactcttctacttcttgttgattagtttcaaaaatagcttatgctcgatgaacgatattcaaaaggcagctgatttcaccaatgtgaaatcaactgcctaagcgaggtccaaaatattaaattttactagtcatcagtaccatctggctttgagtctcttttcgtttacttcactggcaccttcacgtcaccagaaagaatttgcttcttagctgcttcgactgcagaccatgccttatctgacatgttaccgcgcgtcaccgcaacacccttatcatccaaaccgtaaaccaagtgcttaccacctgggaacttgttttcatctgccatcttcgtcacgtcagtcacaactgtgccaacgcccttcgttgctgacgtcaacgtgaagtttgatgcgccgtcagttgccttgtattcaccatcggctgattgatcaatatcaaccccgataacccaaaccttgtcggcctttgtttgcttttcgttcaagtccttcgcctcagtaaagacacccgtaccagcgccaccggcagcttggtaaatgatatccgtaccgttttggtacattgaagccgcgattgtcttggccttaccagcatcagcaaaatcaccaacatattgcacatcaacttgaatatcagggttaactgacttggcacccgcaataaagccggcttcaaacgtatcaaccaccgctgacttcatcccaccaacaaaaccaagcttgttcgtcttcgttgtttcagctgccgcaacaccggctaggtatgatgattgttctgagtggaacgttactgagacaacgttcttacgcgtctttgcaacgtcatcaataatcataaagttgttctttgggtacttcttagcggccgcattgattgatggcgtctttgggaagccaatgccgtagatgttctcgtaaccatttgaaacggcttggttgatgtttgtctcaaagtcagctgacgtcttggcttggaagtatgtgtaaccacccttaccttccttcacattattcgccttcgcccacttcgtcaaaccttgccaagctgattgttggaatgacttgtcatcgataccagctgcatccgtgatcaacgcaacagatgtgtgctcgttcttagcttcaactgagccagagtgcatatatgccccaatccctgcaccaaccaacacaacagcaccaattcccaaaacaactttacgattcattatgaaatccccttaatagatataaaacacgaacatttatttcgtttttaacaacttagatatcataacccgaacttatgacgttgtaaagggtatatttcgtaatttaatcgttttaaccagctaaccccttactaacaaacggttaaaacacgaactttagcattgtcgtttacataaagttcgtatttagcacaaaaagtcaagacatcgcattgcatgtcttgactttccatcatttattaatttgccaaaatgttaacaatatacaatcctagcttctgatgcatcacgtgtgcccggtgtgtctcttgcacaaccgacttcaactctgacacatcatcagtaatttcgccttggacacccttagcataggtttcaaccatgccctgtgagtcattcaccgtccaggcataaatccccttaccacgctcattcaaatcatcgacctgactttgcgtcaaataagagtattccatcgtgtagaaatccgccttcgtcactggcgcaccaataaagtcacccggcaaaatcatgccgacttgcagcttcttatccagcgtcttcaaacgctgcacaactgaatagttcaaactgtgcatctgccaaccgtttttatccattgttgtttggaattgattcaagaatgaatcagctaagtcaggcgcattagttcgctctgtcttaatttcgactagtagttttacattgcaacgttctgctgctttggcatattcttcaaagctcggaatcttagcttggtgaccattctcatagacggtcaacttagtcgcttcggctaacgtcaaatcagaaactgacttgtccgaagcgccctttgtcaaagctgccaaatttggatcgtgcatcaccacccatttaccatccttagtttggcggatgtccatttccacaaaattcggacgagcatgcgacaccgtatcaatcatcgccggaattgtgttctgtacaccattaccatcatccacaccacggtgtgacaaggtcactaatggtcggctaactgtattcacaacgaagaacaatgacggtcccgctccttggatcaacgcacctatcattaggattaacccaacaacacgctttgtgtggcgtggcttcgtagcataatcaacaagctgcacaacctgataatcacgggccatcagcccaataatgaactgcaaactcatgataccaaagaaaatatcaatcaacgtcgccaatgtgaaggtcacaaccgctgtcagggaactcaccatgaatggtgcaaaccaatcaacaatgtattgcgcactccaagtcaatccaaagacaatcaatgttagcaaaccaaccaaaatcgaaccagccaacagtgtcagtgctaatttaataccttgcgcaccactcgttttacgccaactgtttttgattgccaatcccgctttatgttcagccagcataatttccggtaatacgtagaaaaatcgaattgcgaagaataacgctgccaaaccaagtacccagataagcgttaacatccacggtgtgccggtaatagtcggccacacgaattgtggaatgattaaatccgccgttaattgcgagtggaatgccagcattgggaacggcaatacgacaatgccgtaaaacaaaatcaacaaccatgcaccaacaccaccttggcgcaagcgatgcaacgcggtcttcatgacactcgtcgcagtcggacgttgcccctcgtgtactgccgaaaagccaatcgtgtaactggccaattgactgataaacaccgttaatagaatcagcaccgtgatgactaaaataaccgtgaagattggattttgcatcagcacttgccccacatttgaaagggacataaacggcacttcatcaagccattgaccgacgtacaacaaacctttcaaaaccgggacgacgataactgaaattaaaatcgtaatcgagaagaacagccgactcagcgtccatttcgattgccaaaaccgacgccataacagcgtccagattgtttgtttcatagtatttttctcccctaaacccacctgttttgccaaattataccaaacagatttgtttattcgagtttaaggctctcactattggtctttcttgtctttacgacgcataatccacgctaagaacatcgcacagaatgtaaaaataccaacaagatatggtcgtacgtcagccaccttttcggtttgttcatccgtttcctgtgactcgatttggccatccgttacttctttgcttgagccgttgtaaacaatgcgatcatcaattgcctgaccttggtgtgagcctccgttagttgcgacgtatgggttcgatgcacctgacgcatccccattagacgaaatcatctggtcacccaccgcattgggtagtgaactagttgctgtctcacccgctggggtgatgacattattctgtagaccattatcgttccaaataggcgtgtccgtcgattccgtcgctgtgccaactgtcgctgcttgagcgttactcaaaggcaacggtgctgccactacgttattcgttgactcatcattcgtcgctacgttcattgcagtatcaaccgccactgtttcgtccttttgataatttgtggttgttgcagcattactcgttggaaccgaatcactttcagctgtttgttccggttcgggttgctcattggcagccgttgcttcctccacaacttcttctacttcggccacggtatctgagtcactggcttcactgctaaacgaacttaccaaactagctgacaagttagtcaggtcactgatttcgtcatgtgcccactcttttgcatttgccaagttagttgcttcggcttcgtcaataatcgttgtgacctcatctgaagttgtcgcatttacaacacggtccttgtatgacgctttttcatcatcagacaaatacgccatttcatcgatttgcgtctcagcggttgcttgttgttgtgctaactcggccgccaatttggcatttgcaacgatttgctcaaccgctgacactgtatccgcattcgaaatctgatcaacaaacgactgcttcttatcgtcagccaaatgctgtaagtcatcaatctcagccactgcgtcagtcttagcattcgccaaattttggttcgtcgcatcagtgacaattggtacgatatcggcaacattctcggcgttagcaatctgttgcttaaagtcggtctgctcatctgatgacaaataacttagattatcaatcgttgctgtgccatcgttttgtgcctcgaccaacgctgagtcagctgcctgctttgcatcggtgaccgcttgttcaaccgtcgcgacatccgtcgcctgattgacttgattcgtatacgtcgtttggtcagtgtcagacaagttcgctaggttactaatctcagtcgtcgctgcttctttggcattggccaaattttggtcagttgcgtcatcaaccacggcgttaacccccgcaatatcagtcgcatctgaaatttgttggttataagccgacttctcatcgtcagtcaaataagtcatgttatcaatttcggcctgggcatctgacttttgttccgccagcttatcagccgcctgcgcatcggcaacgatctgctcaatggcactagttgtctcagccactgaaacttgattatcaaatgattgcttcatatctgcatccaaattagccagcccagcaatttcaccatttgcccaatccttggcattcgccaaattttggtcggtcgcttcggacacactctgctcaacatcagcaatcgtcatggcatcagctacttgttgctgagcatcatccttttcatccgccgacaagtacgtcaaatcagcaatcgctgtgtctgcgtctttttgcgcttccgccaatgctgccttatcagcgttcttcgcattagtcactgcttgttcaacagtcgccacatccgtcgcctgattagcttggcctgtatacgttgattggtcagactcagacaaattgactaagttgccaatctcagttgccgcgctttcttttgcatttgccaaattcgtgtcagtcgcttcgtcaacaacagcattaacacccgttgcatcagtcgcatctgagattcgttgcctataatcaaccttctcatcatcagacaagcaggtcatatcatcgatatccgcttgtgcatcggctttttgtgcagccaattcatcagctgctttggcgtcagctacaatttgctcaaccgcgtccgttgtcgtggcgtcagtaagtcgatcaataaacgtttgcttctggttatcactcaagttctgcaaatcagaaatttcagtcgttgccgattccttagcgttcgccaaattttgtgtcgtggcatctgtaaccgtctgtgtgactacttcaacgtctttcgcatcagcaactgcttgcttaaactcagacttttcattcgttgacaaatatgccatgtcatcaatggctgtttctgctgacgcttgggcatttttcaaatcagttgcttgtgcatcggcaagaatttgttcaaccgctgcgacatcatacgcctgcgtaacttgattgacgtaatcagtccgctcggaatctgatagattagccagattgccaatttcagttgttgctgaatcctgagcgttcgccaagttagttgcatccgcttcgtcgacagccttgttcaccccggttgcatcagtcgattcggcaatctgtttcttatacgttgatttctcatcatctgacaaatacgtcatagcatcgatttcaacttgcgcatcagctttctgtcccgctaattcatcagccactttggcatcagcaacgatttgctcaactgcgtccgtcgcatctgcattagtaacttgttcaacaaacgtttgtttctgactatcatcaagatttttcaaaccgttgatttcatctgtgcctgattccttggcgttggctaaattctggttggttgcctcagtgacgacctgcgtcacatctgtaatggttgttgcgtcggttacttgttgctcgaagtcagtcagctcatccgctgataagtacgtcaaatcagcaatcgttgtatcagctgttttttgcgcttcagctaacgccaactcggccgcaccctttgcatccgcgaccgctttttcaacagtcgccacgtccgtcgccttgttagcttgttctgtatatgttgtttgatccccttcagacaggttcgctagcttgccaatctcattcgttgctgatgccttagcgttcgtcaaattcttgacagtcgcatccgcaatcgccttatcaacatcagtaatcgtcgttgcgtcatcgatggtttgtgtcgcagtcgacttttccgtatctgacaaatacgtcaactctttaattgtctcagttgcttcagcctgagcttcctgcaacgcgctttcgtcagcagccttcgcatcagccacgatttgttcaaccgtggccaccgtttcaacatccggcaacttagaaataaacgactgttgtgcatcagtatctaagttattcaacgcactgatttcgtttgttgcccaaacccgtgcatccgccacatcagcattctttgcttgcgcaacaatcgcagcgacattggtcaccgttttagcattggcaatttgattctcaaagtccgcattctcgtctgatgacaagtaggtcaacgcatcaacagtcgctttcgcctctacttgtgcatccgccaatacggctaaatcagctgcatttgcgtcagcgacaatttgttcaacatctgccactgttttggcatcagccaatttatcgacgtacgttacctgatcatctgatgccaagttaggtaacgcattgattgctgttattgccttgtctttagcattctcaaaattcgtcgccgtggcttgcgtaaccacgtcatccacacccgtgacagtcgtggcattttcaatatcttgcttgtatccagctacttcttccgtcgataaataggtcaacgtatcaatggcggcgttggccttcgtacgttcagctgccacaacggctgcatccgccgctttagcatcggccacaatctgttcaacttgcgccacagttgtagcagtcgtcacctggttagcgtagccttgtttagcatcagcatccaggttaaccgacttggtgatttcatcattcgcccaagactgggcatttgccaaattttgatcagttgcatcagacacaacgacattcacaccagccacgtcagttgcactcgccaccttcgctttgtagtcatccttttcagcggtcgacaaataagccatgccatcaattgcggtcgtggccgtcgttcgtgcgtcagcaagtgcggttgcgtcagctgtttgggcagccgtaacaatttgttcaacttgctcggtcgttgttgcgccttgtatttgtgttgtgaaactttgcttcgaagtatcatctaaattcgttaggctagtaacttcaccagttccccacgtcttagcgtttgctaaattttgggctgttgctgccgtcaccacattattcgtatcttcaaccgtcgttgcactcgcaacttgttgcttgtatgcagccttttcatcatcggacaaataagttagcgcatcaatcgcagtattagcatctaactttgcttgtgccaactcatttgccgattgtgcagtcgtgacaatcccatcaatcgcatctgtactagttgcagcctcgacctgactcttataatctgcgcgttcggcatccgtcaatgcagtcaaagcatcaatctgcgcattggcatttgccttcgccgtcgtcaaatcaactaagacatcagttgaactggcaacaccagcaaacaaatcaagattaatcgcatctgagctcgcaattgctcccttaacttcgactggtgatgttgagccatctggcgtgattgtcgtcggaaccgtgactgttgtactacccaacacagcagcatctaccagttgattaacagtattaccagttccggaagacaagctggtgatagtcggcgtcagcacgccgtcaatgagcggcgacgttattgaactgatatcaacacccagaacactaatacttttcactgtattcaacaaatcagtcagcgtcttggtaagcgtttgactcaaagcggttcccaatccgccatccaaatccaccgacaaatactgactgccatctggcaacgtttctactgtcgcttcgctaggatcaactgtgtaatccgctgtaacagcaccgtttttcaaattgtctaatgttttattcaggttatctataacttcagaaccaatcgccacttttatgattgttgtatccaatcccgttaagaccagttccaatgcatccacaactggatcaagaaccgtccccagtccaccgattacttcaacgtgcacttgaattggcccagctgcctcaatatccgtcccagccggcacctgcaatgccacttctcgtgacgtgtcgcctagtactgaaacatcagccgcaccacttgcatccatcgtgaaatcaacattagttggctgcccaaccggtagtgattccgttgcattcgatgtcgtttcgacgttcgtaaacaattgaccatccacgaccgctgcgtcagccgttctttggaccaagtgaacgccattgcgatcaaccgaaatatccggaaagtctaacgctacgcccccgcctaacgtcaaacaggaaatcccggcaatcacccacatcttcttggacttatacatccgcttgcgttgttcggatgtccccaaggctttgtttgccttattcatttttaaacccccactgttatatactctctaacgtgttccgacctcgtccctctcggagctcactcaccactccacaaggtcaatacagcttagttttaacacatatccagtagcggtaccaaagatagctatcgcaacggtttcacccaccaaaaacatgcgcaaaccgtgatgaagcgtagaaaaaaagcgttgcacaacgagaattattctcgcggcgcaacgcttgtatatcgacatatgccttattttaaaatatccagttatttcaattaatgacgcttatttggattccttaattgaaaatatacccattttttcaattaagaacactcagtcggccgtccttatttaaaaattacccctatttttcaattaagaatccaaatagctgtgtgtaacattgaaattccagtcaccttttcaaaaacatttttgtaaattttgacagttcagagacatccgtacatggaattacatcacatacagaaattgtctcaccattgtatctttttaatccaatagtcgttcctctatcgcatcataaaatcgcttttcatcatagtcttgtaatcccgagacttgcccgtctcccatctccatgacaattaactcaccatcgattgctcttacaaaatctaccgtataaaaatcagacgcaacctgctcagttactcgattaataatttgtaaatccgtttctgataattcaacaacgtcattacgccaataatcaataattaccagcggtttatgctgcatataaaagactcgatactcttcaaaaattggcgtgtgactttgtggatgctcaccaattgatttcaaatcaacgaatttccgaattaccaatccacctactaaatcatcaccctgtcgtgaaatgaaattatgaataactcgtaacgcattttgctcatccgctacatctggaatataaaaagcgtccgaccactcaaacttcctgctcttcacgtaatctttaatcgtgaccgcaccagaaaaatgagacagcatttttctgatggcatcatccgataaatcctcagtccagacagccggaacataactaccatccccctgcatccaatttggcagaaggtgcgtgtattcataggctgattgatctgtaaacatacggccaccatgatgcgtcacataggcaaccagcaatgcatattgtgtgggcttcaacatccacccacgatatataacaacatcgccatttgatattttcaaatttacgcttacttcgttttggttgaaaagcttttcttgatttatcaaactaaccgtaaaatatcgtttagcagattcgtattcatttttataatcaaaatcaggttcccggttgtttaagaagtccgacgggaacaagaaaacatattgattcgacatcacattcacctccacctgtcgcctcttatcactactccgaattgtagcatattcgtcctttgcgattcctaaactacacatatttcgctgcgatacaaaaatggtcgctaagcatttgcctaacgaccattttcattatcttatctattacttgttaaagtatgccttcaaagcatcaaccttatccaaacgctcccatggcaagtccaattcaggacgaccgaagtgaccgtaagcggcagtcgcttcataacgaggcttgcgcaagtccaagtcctcgatgattccggctggacgcaactcgaacaagtcacggattgcagctaccaattcatcatcagaaaccttacccgtaccgaacgtgttcacgttaactgaaacaggctttgccacaccgatagcgtaggcaacttggatttcaaccttttcagccaaaccagctgcaacgatgttcttggcgatgtgacgtgttgcgtaggcagctgaacggtcaaccttggttgcatccttacctgagaaggcaccaccaccgtgacgagcgtatccaccgtacgtatcaacgataatcttacgaccagtcataccggcatcacccttaggtcctccgattacgaagcgaccagttgggttgatgtagtaacgcgtctcgtcgtcaaccatgtcggctggcaaaactgggtcgatgatgtacttacgaacatcggcacgcaattgctccaatgagattgactcacggtgttgcgttgacaaaacgacagcatcaatacggattggcttgtcgttttcgtccaattcaaccgtcacttgcgccttggcgtcaggcaacaagtatgacaactcacctgagcggcgcacgtcagcttgcttcttaaccaacttgtgtgacaaaacaactgacaatggcaagtattcgtccgtttcgttcgttgcgaaaccaaacatcaagccttggtcaccggcaccgatttgatccaatggatcaacaccaccgtcttcacggtgctcgatagctgagtcaacaccttgcgcaatgtcaggtgattgctcgtccaacgttaccccaacgtggatatcgtcagccaagaaaccagcttccttgtcatcgtaaccgatgcgcttcaatgtgttacgaacaatttcgttaatgttaacgtaggccgtcgttgacatctcaccgaaaacgttaacgtaaccagtcgttactgacgtttcaatggccgtacgtgcttgtgggtcttcagccaaaacggcatccaaaatggcatctgagatttggtctgaaaccttatctgggtgtccttctgaaactgattctgacgtgaacaaacgcttttctgacatataatctaatctcctaaaataaaaaactcttgtgaaattaaataaccccgacataccactcgtaggcggcatgtcggggttcagtcgatatgcgcctatctgctagaaagtaccacatcgcccaaaacgggtaagttggcgtcagatcaaagggtctagtccctccctgaactctcgataggaaagtcgaatttatttactttttaatacctaaattactatacgtggttttgtacaatcacgcaagctaaaaagttaactaattttttagtcacccatcgcactcacgttttgatcggtaaccgtcacgtcgccaaaggcttggcgcaccgcatcaaggtcgtggtttgccaaccaatcattaacatcgatagagaagtcgtgcatgccgtcgccattaccgccgctataacgacctgtaatttggctcacaccgccatccccagtcaatgaatattgcacaccaataccgtttacaccaacaccaaggtgcaagcttcctttaccagatccaacaccgccaaccgttccggctgtaatgccgtttacatcagtggccggcttgttatatcccgacataacaacctgcgcaataatctttgcacggtcagtacggcttaagtccgttgcaacaacaccaggtgtgctacccgaaaagtccgacgccttggttgaacttgatgagctagcgcttgatgaacttgaactactacttgaagaagaaacagcacttgatgtcttatttgttgtggcctttgaaactgacttggctgacgatgcaaccttagctgtgccattgtcagacttagagtgcgtcaacttgtatgtcatcgcaccagccacaatggcaactacgacagccaacaacaagaacagtgctcgcttgctcttaccactagattttttcgcaactgctttgggcgctggcgcaactggcgctactaccggtgcctcttcaggttcaaaattacgtgcagcagctgcacgatattcttcacggcgcgcaacgcgcccatgttctttgcggaatttatcttcccattcttgaccagtcatggatttacctcctgcaaattatagatacttcgcatcgaattcaggatcctgacttgtcaaaatctttggaccctcttccgtaattgcaatcacgtgctcgtattgagctgaccatgagccatccaacgtcgtcactgtccaaccatcttcttcagacgtttcaacttcccacgttcccatgttaaccatcggctcaatcgtaattgtcataccaggcttcaagcgtaggccacgccccgcaacaccatagtggaacacatttggatcttcgtgcatcgtaggttgaataccgtgaccaacataatcacggacattaccatagccgttttcatcttcaacaaaggcgttgatggcagccccaatatcacccaaacggttaccaacttgtgcttgttcaattccgatgtacattgcttctttggcaacatccatcaagcgttgggcttcaggtgagacttcaccaacggcatacgtccaagctgaatctgaataataaccatccagttcaaccaccgtatcaactgtgacgatttctccttccttaaggaaaagtgccttacgtggaaacgcgtgcgcaacctcttcattcactgaaacggtcgtggcgtattcatagccttcaaagccgatttgcgcagcacgtccgccgtgactctcaatgtattggcgactaaattcttcaatctcccaggttgaaatacctggcttaataatatcgcgtagtccttggtgcataccggcaatgattgccccagacttacgcattccctctatctcacgaggtgacttaatcgtaatcataataatctctcttcactaatcatatgtttttattttacacgtaccacttacaaaaaagccacgcaaacgcgtggctttaagagtttctcagtaaataaccgttgctagttgtgacgtcaaaaatagatcaacgtaagcacggtccagcaacatcttcgtatcattcattgacatgaataggaattgcaagtaaccacgtaccaattcatcatcaggcaaagctgacaactttggcaagcgctctgataactctggcgctgacaaaatcatttgctcattcgcacgcgcaatacgtggaatgctcttgcgaatcgtttctgccattgaagcaaccatcgcgtcatcaatttgaagtgtaatacccatttctctgtcctcacttaacttttgtcagtcattattataaccaaaaaagttgcaataacgatttttcaagggaaagtcttgaaatattgcttttgtttttgcaccaactgagtagaataagaaccaaacggaggggaataatatggcaattcaaacagcaattttcgcaggtggatgtttctggtgcatggtcgagccattcgagactatgcctggcatccaaaaagtgcgttcaggttacactggcggtttcgtcgccaacccagcctatgcacaggttgcatcacaccagactggccacacagaagccgttaaaatttggttcgatgatgacgttgtttcatacggcgatctggttgaactatattggcagcttgccgacccgacagatgccatgggccaatttgccgaccgtggcgacagctaccgcccagtgattttcgtagcgaatgatgagcaacgacaaattgccgaggcgtcaaagcgcgccttaaatgattctggtcgtttcgacgcaccaatcgttacaagcattgaagacgccaagcccttttacgatgccgaagaagaacatcaacaattctataagaagaaccctttgcgtgagtacatgatgatgatgccacgtaaagcctaccaaaagaagtattggtctgataaagactagctaaaaagccggtttcgtctgcgcatagacgaaaccggctttgtttttaataaatcacatggaaattcgttggttggtcaatcttaatatctgggtgactcataatgtaatcaccaatcaaatcagctgtttcttgttgcacttcacgaaccactttatccagtgagaaggatgcgaagttacctgcaccacccgcacggtaattattcattgcaacttcgtattcgccggccaaatcaatcggctcaccatcaacaagcacttcaatcacgcgttcaccttcacgacggcgcaaatcaaaggtgtaatcaatcccgctccaaacatcatagttatagtgttcaaccttaggctccaaaaacgctggattaacggttggttgaccgttatcatccaagacaaagtagcgtgcgttcacttcaagcgcatctttaatatcttgccccgtcaacttttcgacaactaacgtatttggataaatgtaattcgtcatgatgtcacgcaacgtcacttcatcagccaatcccttcacttcgttgttaaacaacgctgtattagcaatcgtcgtttgcgtcgcgtccatttgcacttggttaaccaaggcgataaatgggtgactgtgcaaacgggcctcaaagtgattcgtcacttgcatgttgtgaccaacgtgaccgactgccgtatcaagccagtgattcgtcgcaacgtgtaccggttcaacgactgccttcaccgcatcgttctcagggaacaccgctgtggcaatcaattgggcgtcacggttggtaatttggtgttcattattcaacgtaagcgtcatcaaaccaacttgatcagcgcgatagccaggctgcgttgtcgcaacatgattgataaccgctgccagggtacgatgttggtgaccagtcacaacagcatcaacacctgagacttgcagcaattggtacccttggttttcacccgtcaaacgttccaacggttcaccagtctccaaatcttcagcaaaaccgccgtgataagccaataccatcacatccacttgtgaacgtaattcgtcaacgtaacgttttgccacttcaactggatcagcaaacgttaacccatggatgttagcgggttgttcccaatttggcacgtacttggtaatcaatccgatgacaccaaccttcaccccaccacgttcaataatcgcgtatggacgaccaatgaacggctcaccacttgtttcgtccaacacattggcattcagcaacaaatcgttttgtcctaaaacgcgttcaagataatcacgtccgtaattaaattcgtgattacccaaaatgcgcacatcataaccaatcgttttagccaagtcatcgtacaaactcaccgctgattggtcgactttttcaatgtaattcgttaatggtgacccttgaataaaatcaccgttttcaattgtaatgatgacatcttctggagcagcttgttcacgcaacgtttcaataactgtcgctgcgcgggtcaaacccaacccatcattttgtaatggtcgacggaaatcatcagctcgaaaataaccgtggacatcagaagtcgaaataatagaaacctgcatgttgtactcctttaaacagagaaggccaccgagtactcgatgaccttctaacctattagactaggcgcttacgcaattgacctgacaagaagtcaatgaccgtcaccatgatgatgatacccagcaaaatgataccaacctttggccattgacgtgtttgcaaagcaaaaatcaatggcgcaccgataccaccggcaccaaccatacccaagatagccgctgagcgaaccgcgatttcaaatcggtatagtgtgtaattcataaattcaggcatgactgctggcaacgttgccaacgtcaacccatcaagcgccgatccaccagctgccacgatggcttcatttggtccgcggtcaatgttttcaaccgcttctgagaacaacttacccaacataccaattgagtgaattgagaccgccaacacaccagcgtaggcaccaggaccaaccgccttgatgaacatgatggccatcacgatttcagggaacacacggataaccgtcaaaatcaccttacccaacgttgaacgtggcgtaaagaaccccttcttcgtgcgggctgccaagaaggcgaatggcactgacaaaatagctgagatgaacgttcctaagaaggcaatggccagcgtttcaaccaacgctgtgatcaaatcttcgccatcccctgtataaacgtaagaccaatccggatggaacaatcctgtgaaaatagccttcgtaatcaatagtgcttgtggcttaactgatgacattggaatcccagaaaaagcccaggcaaacaatgcaacaaccaacactgtaataatccaaggacgataacggtgccaaggactttgcttaactacttgcattatgccaacgcctcccgcaatcgatttgaaataccgtcaacaatcaccacgacaaccaagatggccaagataaccacagccgtgcgatcgtaacggaacattgaaagtgtctgactcaagaacaatccaacaccaccagctcccaaatatccaagcactgttgaggcacggacattgatttccaatgtgtataggaagtaactcaagaattggttgaagacttgtgggataaccgcaaacacaatcgtttgcaagctgttggcccccgcggccgtcaacgcttcaattggtccttcatcaatcgtttcgattgcttcatagaacaactttgaaatcataccaaaactgaaaatcgtcaaagcgccgacaccggccatcggaccaataccaacaatcgcaacgaacaacgctgccaacaacaagtcaggcaaggcacgcaccaagttcaagaagaaacggacgataccacgcacaatcgtgttcttcatcaaattacgggctgccaacaaactaaacggcaccgcaataatagttcccaacaaagttccaaccaaagccatttgaatcgtctgcaaaattggcgtaatcaccgccgtaacatatgaccaatctggattcatcatcttaatcaagatatccatgaattgttcccaactgaaatcagttgagacacctgtcatgcgccctgatccaaacaaaattaatacaactagaagcgttgccagtagacccttgacgtgccatttttcgctgaaacgctgttcaggtaaacttacattcatcgtctattctccatctgttgcttcagcgtaaataccgttaaagtcatccttgttaacttctgcgattggcttgtcataaacaagttgacccgcacgcaacccaatgatgcgcgttgcgtattccatggcaagtggcacactgtgcaagttaaccacaaccgtcatgcccatttccgcgttcaaacgcttcaagtcatccataaccatcttggtcgtctttggatcaagtgaggcgattggttcatcggccaagacgaccgttggtgattgcatcatggcacgcgcaatggcgacacgttgttgttgtccaccagacaactcatcggcacgcgtgtagtatttgtcgagcatgttaaccttatccaagttttcggctgccttctccttatcttccttagagaaaagtccaaacgtgctcttgaacgttgagtagtaacccacgcgtccagccaatacgttacgtgccactgatgcgcgttttaccaagttaaagttttggaaaatcatggcgatgttacgacgcaattcgcgaagcttacgtcccttcgcaaccgtgatatcttcaccatcaatcaagatttcacctgacgtcacatcgtgtagtcggttgatggcacgcaacaacgtactcttaccggctcctgaaagaccaacaatcacaacgaactcacctgaagcgatatccaagttaatgttatccaaaccaaccgtgccgttcggataaatctttgaaacgttgttaactttaatcgtgcctttttgggctgtcataataactctccactcttgtttaaccttgttaaccaaatccagcgaattttgctgaaccgttttacatgatatgtacgaagaacggacctcactgggcgctgccagtaaagcccgttcttctcgttttatttagaaatcaagcttacttgatgtcttcaacttgcttttggtaatcgcgaacgatgtcaaagtttgaatcctttgacttcgcaacacctgcccagctgtagacatcgttcaagaccttcttaccctctgacgtctttgataccttgatcatggcgttttggatagcctttgaatccttagctgagatacccttacgcaaagcaattgtatcgttaggaatctttgacgtgtacatcaaagcacgcgtttgcttgaagatatctgggttgtccttcttaacaacattacgagcatcatcaaagataaatgctgcgtctgtgtcgccgttcaagactgacaaaacaccttggtcgtgacccttaaccgtaactaggtcagagtccttcacaacgttcatacccttcttcttcaagtcaacgactgggaacatgtaacccgcgtctgaagtcgtatcttgaacggcaatcttcttacccttcaagtccttcactgacttgatctttgagtccttctttaccaagacaatcgcgcggtagtaatcaacaagcttgtccgtgtttgaaccgtcgcccttcttgtcgttaataccgtaacgctctgattgcaagataaccttggcaccatattgctcgtgtgcgtgtacgtatgggtcaggtggcaagaatcccatatccaccttctttgatcccatcgcctcaacaactgtgttgtagtcagttgagatggttacgtgcactggaatccccaattgcttctttagcaacttttccaatggcttagccttcgcttggatcgtgtcagcttgtgatgatggaacgaattgaacgttcaactccttcaagctaactttctttgaagcggcatcaactgatgcggctggcaatgcagtaacaagcgttgaagctgcaatcgtaagtgcagcccctgcaacaagctttttaaacatgtccctctatactccttaatgtatgtccccttaaaggttgaattaaggataacaccgaactttcttcatgacaatatgcattttgttcatatttatagttaaacgttttaaaaaaatatatatattgactattaatgttcggtaagtagaatgtcgatttatttctccgtaaatcaggactttaaccatgctaaaaggctcattcggagactttttgtatcatacatatgaaacgttacttatttttaattagtcgttaaaaagcagttattgaactgaaccccatgagttggagtaaatctaactcatggggttttcttatgttctcgaaagaaattcaaattgaagcagtatcgatgtactgttggttggatgtcagttggtggtggtcaccacacggttttgtcattcaagattacggccgagcaattgcaagatttgtctaacatgttcaagttgacttacgtggacatcaaaggctaaacctgacagacattttaactggcgctattaactaacgtaaacagctcaaaactctcaaaaacatctcatttgccagttaaaatgaaaccgtctctgaccaagtgttaggggcggttattctgtaataacgattaagattggaaaactatcatgaaaccactaaatgattcagaaattgctcgcctcgctgagattgatatctttgataaagtcgatcaaggtgagtggtaccaatatgctaaggaaccagctattcaagcaattgttaaagcatctgcacagcgcgtgcaaatcattaatgatgttgcgaaaacggacatcgaagaggcgacacgtctgttgcacgagtttttgcctaatttagctgaaacagctgatgtgtacttcccaattacggcgattgaacatccagagcgtttgactgtcggtgaaaatagcttcattaacgcgaatctgcaaattttgagtgccggtaaggtgacgattggcgataactgctttatcggtccgaacacgcaactctacacaccgaaccatcacccatacgacgtggctttgcgccgcgaaggatggcaatacgatttgccaattacaatcggaaatgatgtttggtttggtggctcagtgattgtcttacccggtatcacgattggtgataacgttgtggttggtgctggaagcgtcgtcacgaaagatattccaagtaacacgatggttgcgggtaatccggcacgtgccattaaagatttaacacaaaagtaaacgaaaaccggcgtcatctcaatttgcgagatgacgccggtttcactttagtttgttttcgtccaaacgaatcccttgctggtgatgttcgttggttgtgggatttgaatatccggatgctccgcgatgtagtcaccgataaggtcggccgtctcgatttggacttcacgaacaaccttgtcgatactgtacatcttgtagtttcccgtgccagttgcacggtagttgttcatcgtgacttcaaaagactccgtcatggacatcggttggttgttcaccttcaacgacgtcacgcgattaccggcaggacggctgaaatcaaaggtgtaatcgatgccactccaaatatcatagttgtagtgttgcacttttggttcaagaaaacgtggattcacaattaactcgccatctgccgtgacatcaaaatagcgaccactaatttcgagggcatccttgatatcttggcccgtcaacttttcaacgactagcgtatttggatagatgtaatttgtcatgacatcgcgacgagtgacttcattaggcaacccgcggacttcgtcattaaataacgcggtgtttgaaatgtgggtgcccgtcgcagccatctgcacttgattcactaattcaatgaacgggtggttatgcaagcgtgcttcaaagtgcttcgtgacctgcatattgtcaccaactgtaccaattgctgcatccaaccaatcgttaacttggtcgttcaagggtgagaccaactcaagaatggtcgattcctccttgaagttacccgtggcaattagctgggcattggcgtggttaatatgcaattgctcatccaaatctagttgaatggcaccgacgtattccgcccggtaaccaggctgcgtggtaggtataccatcgacaacttcagcaatcgcgcggtgttggtgcccggtaatcagcgcatcgacacctggcaatttcaagagttcgtaaccttgattttcagtcgttaaatgctccaatgcttcgacagtctgcaaatcacgtgaaaaaccaccgtgataggcaatgactaacacatcaacatttggtcgtagctcagcaatataacgctcggcagttgcaactggatccttgaaaatcagaccgcgaatgttatcagggtgctcccagtgtggaatataagacgtcgttagaccaatcacaccgacacggatgtggttacgattgatgatggtgtagggcttgccgataaacggttgacctgttgttgcatccaaaatattggcgttcaacaaattatttacaccggtcatcgcactttctaagtactcacgaccatagttgaattcatgattacctagaatccgaacatcgaacccagcagtgtctgccaattttttgtaaattggcaaatcagcgcggtccattttttcaatatagttggtcaacggtgatccttggataaaatcgccgttatcgatggcaattaccacgtcatccggcgcggcatgtgtccgcaactcgttcatgacagtgacggcacgggacaagcctaagcgggtattcaaaagtggtcggcgaaagtcatcagcccggaagtagccgtgaacatctgatgttgaaaccaacgtgacatgcatgataatgcctccattaaaatttgtgttacttaataaacagaataccgcaaaagtaactaatttaaaatacattagagcacctaacgctaaggtgttatttaccggacgaaatactttgaccaagtttgacctgttagtggtcttaatggattgacttactttaaatggacgttttttaatgcgtctatgcgcataatgtccgttgcgtaacgaacgaaaaataagaaaactctttcgattgataattatcatgctatactaacggaaagttaggttgatgactgcaaagtcatgactaagattatgttgaagtatgggggaacaatcgtggaagtacggtttgagcatgtcacgttaacgtacagtaatggggttgaggtgctacatgatatggattttgaactgccggatggtgaattaattgccttgttaggaccaagtggtggcggaaaatcaacgaccttgaacctgatttcaggtttgctacaagcgacgaccggtcagatttattttggggatactgacgtcacaaagaaagatgcgttgcagcgtggtgtgggaatggtattccagaattatgcgctttacccacatatgacggtgttggataacattattttcccaatgaagatggctaaggttgataagacgacgcgtgaagccaaagcaaaggaactggccaaattggtccgtgtcgatgatcaactgaacaaaaagccaggtgccttatcaggtggtcaacaacaacgtgtcgcgattgctcgtgcattggcaaaagaaccaacagtcttgttgctagatgagccactttcgaatttggatgcacgtctacgtgtcgaaatgcgtgaagaaatccgccgtattcaacaggaaaccggtatcacgacggtatttgtgacgcacgaccagagcgaagccatgcacgtggccgacaaaattatggtgttgaatgatggggtgattcaacaattcgattcaccacaaacgttgtaccaagacccggctaaccagttcgtggcccgctttattggtgatccggtgattaatgaagtgccagctgatgcgctacgtcaaaccttgagtttgccagccaacgccaccaccgtcggtattcgccctgaggccattcaaggtcttgtgcccggacacccaacgttggccgttgaagcccaacaagtgcgtgcgttcggtcgtgaccgtcaagctactttgaaactcggtgcgcacaagttggtctcaactgaattgacgattgccactaaccaagtatcgcttaatccgctgggagtatttgcctttgatgcgcaaggtgttcgcttgccactagggggtgaataggcatgatgaatcaaatcaagccaacgtggcgtgacaacttaaaggcactggcctatttggcacctatgctggtgattattgcagtgttcagcctgtatccgattattaaaagtttggcgatgagtttttacaccgattacaactttttcacgaatcaggtcaatgcaatgggcttcgataactttaagaccctatggcaagacaacgatttccatctggcagtttggaatacgattattttcgttattggcgttgtaccagctgaaattattatttcgctggttattgcagtgttgttgaatcaaatcaagcgtttagctggtttcttccgcacgctttacttcatgccgttcgtaaccagtgttgtggctatctcaatggtctggcggtggatttacaacaaagatgccggtctattgaactacttactcggtttcgtcggtgtacatccgattgattggttgaacgatccacactatgccatgccggcgttaatcattttggcaatctggaagggattgggatttaacatcttgctcttcttggtggcactgaataacgtggacaagcgcttatacgatgccgcgatgcttgatggggcgaacagctggcaacgtttctggcatgtgaccttgccgatgatttcaccaatgacattcttggtgacggtgaatgcggtgattggctcgttcaaggtgtttgatgagattttcgcgctgttcggcggtcaaccaggacctggtcacagtacgttgacggtcgtttactacttgtatcaaatgttctatgagcaaaacaagtacggcctcgctgcagcatctggtgttgtcttgttcgtgatgattttggtcgtcaccctgttccagctctggtggagcaagaagcacgtgcactactaggagggcgtcatgaaagcaaagaaaacaattgtttatatcattttgacgctcggcgcgattacgatgttgctgccattcttctggatggtgtcgacggcattcaaaaccggtttcgaagccttgcaaacgccaccaacctggttgccgaagcacatgcaatggtccaactgggtacgcgcctggcacgcagcaccgtttgcaacatacctcgtgaactcagttgtggtgtcactgacgaccaccgttggccagttagtgacgtctattctggcagcttttgcgtttgccaagttgaatttctcagggaagaaagtcttattcacgattctcttggcaacgatgatggtaccgggtgagatgctaatcattccaaactttgtcacgttgtcagaaatgcatttggtcaacacgtatggggcattgattgttccttggttagcgtcattcttctcggtgttcacgctccgtcaaagtttcgccagtgtgccggatcaattgtattacgctgcccgcttggacggtgccagcgattggcaattcctctggcgcgtgttggtaccaaacgctaaatcaacgattacagcgattgggttattacaaatcattggtagctggaattcatttatgtggccattgattgtcacgaatacagaggggatgcgcacgctaccagttgggttgcaagccttctcgagtgattctggcgtgcaatatccagaactaatggcggcgtcaacgttcgtcatcttgccgatggtcatcatgtatttgttgttgaacaagtacgtggttgccggcatttcaaatacaggtattaaaggttaattaaccgactgttcacagcatgtttgtggacggtttagtgatgagaagcaattgtcaccgctaaactgttcagaaatatcacaagggccctgtggtatgcctgacagtcattaattgttagttatgtgggaaaaaaggggaacttttaacatgaagacttggacaaaattgttcgcaggttcagctgtattggcattgacatcaggcgcattcgcaacggcggttccaacggttgccagtgctgcatcaaagccaacgaagattacattctggcacgctatgacgggaaattacgccaaagcattggacgaacaaatcaaggcatttaacgcgtcacaatcaaagtatgagattgtcgcaactgcccaaggtgactacacaacgttgaaccaaaaggtcatggcagcagccaagtcaaagacgttgcctgacatggcacaagcaacttacacacaagtgccagactatgccaagaatggtatcgtcgccaacatggatagccaagttaagggtaaaaacggtctttcaaaggctgatttgaagaacatttacccaggattcttggaacaagccaagtacaagggctcatactacgccatgccattctcagcatcagtgcgtgtgatgttctacaacaaatcaatcttgaatcaatacggtttgtcagtgccaaagacgtgggatgatgtggccaagatggcgaaggtcttgaagcaacacaatatcgccgccgttggttatgacaagtcatttgatatggaatggaactcaatggtgcgtgccgctggggtcaagttggttacaccttctggaaaggtcaacatcaactcaaagaaggctgttgccgcagccaagacaattacggacatggtcaacaatggggaagcgttgactgctggttctgacatttacggaacgacaaacttcgtcaacggtaagacagccttgtcattctcatcatcagctggtatttcagctactaaggccgctgcacctgacggcttcgactggggtacggcggtaatgccatcatacgaaggtaagaacgcgacgatgttggctggaaacaacttggtcacgacggcccaagcgtcaaagaaggagcaagccggtgcgtttgcctttatgaagttcttggcatctgataagcaaactgaaaagtgggctgaagctacgggctacttgccaatcacaaagaaggccgccaagtcagcatcatacaaggcatacttgaaggcgaacccattggcaaaggctgcttcagattcattgccaggtgcgttctctgatacggccttcttgggttaccaagagtaccgtacggatttgttgagcgcgactgacgcaatgttgacgaagaagacggcacctaaggatgcgttggatacgttgcaaaagcaaacgcaaaagatcgtgaaggaaagcaagtaacatgacgaccacggtaacagtactaaacggtgttgataccatcggtgggaacgtggtgtcatttgaaacagaacaagcgcgggtcatcatggattttggcatgaactttgcgccggctgatacgcgaccatatgatttgttggcgagtggcgtgctccccaatttgccagacttgttttcggacgaaaaagcgactgagcaggaaacggcgatttttgtgtcacaccttcacttggatcacatgggggcgttgcaatatttgacgaagccaacgccggtatacatgagcccagagtcggctaagttgtatgctgagctgacgcgtcaaggtgttgaagcagcaccgaatgcgcaaatcaaggtgattaacactgagacaccggtcgaaattggtgatttgacggtgcgggcattcttgtcagatcacgatgcgatgggggcttacatgtttgaagtcactgacggcaagcaccgtttcgtccacagtggggatgttcgctatgatggctggcacccagaacgtgtgacggcctggacaacgtacttgcatgaccatcaaccagacatgttctttattgagggaaccgagttctcattcgacgctgacccaacccgtcaacgtcgcacggaagcaaatgtgctagctgatttgtcagcggctatgacgcaaaaagaactggtggtcataaatccatatgagcgcaatgttgagcgattgatgcgcctgcaagccatcgtgcatgattttggtcgtgaattggtttgggatgcacgctttgcggggattctaaaagcgatggggcacaaggatgtcgtgacgttcggtgaagacgtgacgttaaacgatattatggctaaccagcagcattacgtattacaaaatcgcttcgatgacatcgcggtactcgaccatttcgatcgcttcaactatttgcacatgaatggtgagccattgggtgattatgatccacgttatgctgagctggtagcttatctcgacaagcgtggggttgcattgcaaattgccggcgcaagtggtcacgccacaccggatgacttgctacgcattgcagcggaagtgaacgcgaaggttacgctaccttggcattcatttaagcctgaacgagaagcccaggcattgcgtaatatgggactagaaacgtatctgcctaaaaagggtgagacgtttaaattcgactaattaagaaaagacctaattccaattgtaaggagttaggtcttttcgagttatttagcatctagctttcgtttttgttgaataaccttcaagataagaatcacattcaacaaaagagacaaaattagtaaccatgggaaaaatcgatagtaccaaggatttgaaatggtcgtccatcgatcgtttttttcgtcacttgtcagcacatcctcagaatcgtcggaaacgctaatatcactatcgttcacaggtgtatatgttaggccgttagttaatggttcctctgaagtgaggaagttcgtgattgtgttaattgttgttgcactactaatcgttgagtcaatcaaccttttattagttagaagtcttacgctactttcatcggatgattcgaccgtatctgcaccatctttcccagaaaggcttccccttgtttcgttatcctcggcatcgtttgagggtccgataggaagcgtgtcgtcgtcagcaggtgggccaattggctgaacgtcccctttagaaggaggcgcgataggttgcgtgtctgcagtagaaggcggcgcaataggctgcgtatctccggtagagggtggtgcgataggttgtaaatcaggatctgattcatctctatctggtggcgtaataggttgcgtatcaggtgttgatggcggcgcaatcggctgcgtatctggacccggctctataacgccagtaacaattaatccataacaaagggttcgtcgcaaattaacgagtgatgtgtattcaaaagtactagttccgctgatggttcgaaaagttgaaacttcatttgggtgtgcgccaggtgttcgtagcatcacttctttgataccttcagccgttagtctcgcaccatattctttggcgcgtgcactcacagcgccaccggaactacctacttctgctaaatctgatccactaagtaaaaaggcttgcttcgtaccaattgccactgttggtgtggttggtatgacgtttgatgccatagagttataaaatagctgaacgtttttattggtaggatcactgccaccaaacgtatttgattcccaaatgccatatttcccctttttatcgcttaaccttaagttcagaacggaagtaggcgcgatgtaatcttcgtattttgtgccagcgatagcaccaaagccaccagtcgtgccgtgataccaggaatcaagctgcatgtatggcaagctttcttcgtagccatacaagtcattgtcgtcccgagcgaaatagtatgagctgacgccagtaaatgcttgtgaccaagaaagaccaccagaaagatgggcaattaggtatgtgtcttgcttcattgtgccttcgcccggcgctctaataatcgaccaaaggctgtccatgaacgtaatggtaccatccccattgttcacaggggcgtatgccactgctttagaagaatcagtggcagtggcatatgtcagaacaggttcggtaaacgtagttgcaagcagggatgcaaccattattgaaacttttgctagtttaaaaataatcatttcctacctttcgaataattaagtaagttaattttgacaggtcgagcgaataacgtcacaccgtgatttcacggcattggacaaatatgtgaaaatgattagtaagcgattgtgaccattgattattacaattgtttgaactttgtcacgatgaactttaggaatcttatatagtaaatagttgtaggcggtagacagaattttctctctcgcaactacacagtcccaccgcctacatgaaagacacaaaaatgcgcccctgaatttcagaggcgcatttttgtgttgtattaggttgttacgggaattgccaaaatatcttctaatgctgaccaatcggcggcggttggtggcatgtgccattgcagttggaatggcacatcaagatcttgaacgttaatatccgaaacaaatagcaaagtgttttcagtaatgtgacgttcaacgacgatgttggcgtttggccgatctttgaagagcgattttacaagcaaatcaaagttcgcgccctggctaaattcaaagacgacatggaagggcggattgaccaactcgagtggaattgtcgtcatcatcaaaaacaggtaatcatacattatgccagcttggtttgaggttactctctttcgattgtggctgaaagacggcgtaataatgttggtcatttgcgatgcaaattgcatgtagtcgttatattggtgcaatgcgattgtgtctgatggatcaaaaatatagtcggcatttgtgtattcaaaaaaatacagtcgtgaatggagtcgacttagtgaatcgcaaacggtttttgagaaaatcgtctcagatttagtagcatcaagcttgaaatagcgaccgaattcattaatgaataagttgtttaggttactgataacagtgttttcaagcacaatcgcatcccactcaggcgaatcgggtaacatggcctcgctatacagataacgcaacatcatgtagctttctaatttagcatcttcttcaggtaaatttggaaatttggctaagatggcgtttgaaagaccatcgatagtgtgctctggccagcgcatcaatatttttttgaaacgtggatcggtttgcaattgctggcttggattttttccttgagccatacgcgtgaagacaatgtagtagacgtattttactttgattttctgaacttgcgtaaatttaaattttggaccactgattatgttttctatccgtgcaataccttcttcaatggcagcatttgtctcacaatcgaagggaagattttcaccaaaaaatttgaaatacatttcaaacaaaaacgaacggattgaaacttcttgtccttcgaaacgtagattagttgagatggtgatttgatacttttcaaggatgttctcaagtttttttctaacgcgatagacactggttggtgagatgaagtattcgtcagcaaagtcatcgatattatcatgggtcattaagaaacaagcctcgagcaacttgtattcgatggaatttctgacatagtggcgtagccaaataatgatgtttttgtggggcggtgaaacaagcgttacgagattgttttcaaagtggagggagaaagatgattccaaattgaaggccaagatatcgctttgcagatcggtaattatttttttgctggtgtgattcgaaaagtccaacgaggtagctaattcgctaagtgatgtgtttgggtgattttgtaaatattgtagggccttaacttttttccattcagtttcattcaataatttgaacaaactttcatcctgactcataactgctctccttaaaacgttttacgtacaatctagacaatacttcaaaaaacagactgactttcacccgttctgtgaattacttgtgaacttacctatgaccaattctggaattttagctctaatagtggtcctgggagtcaggaataatcaactaaactaaaggagtaacgcttttggttaaaaagaggtaaaacttatgaattgggcaaaagaactcattgaattatcggaacaacatggtggtgatatgttgcaccctgaggttgttaagtacggacattatctgtggcaaaaagcagatgagtcccgttttttggtagatcgtaatcgaaagtttaatgatataaccaagctctgcagtttcctgcagatctcgaacaatgagtttataacacgcgcaaacaacggcgatgaacttaatctatcgaaattgaaaatcaatggtcacatcgtggaaatcaacaaaaagtcgggcagaagtggattcggatcatagttaagtacggtagataaattcatacagcatgaccagaacttttcttttaaccggattatcggacacatgcaaaacgtaaaacacgtcatgatatttgttgctcaacaaaacggggcaaaaacaaatttaaggggttttttatgtggagtcgtaagattaagcgatttacgctgctttcaacagcagctttgatgacggttggagcaagtccagcggttgttgataatttattcaccgtgacggcggctgaaaatgggttgtcatttgatgatgctaaaaacattatcgtgggaatgaatgacacgtacatgtggtcaaatgatgagggtaagagttggacccgaggaactgatcatgatgtattcaaaggcactcaaaaggttgttgttgccaagtacgatgccgatgtagcatctgctgaagcttggaacgctacgtcttcatatgcaactggtgcagttgttgtgtttgaaggtaaggtgtatcgtgcaaaatggtacgctgagccgggtgttaagcccactgctggagaaccttggacgtttgtaaagaacgtaccgtcatcagttgcgacgtttgaatttcatcatttcaccggtgcggatgctgacaattaccaaaagtcagaagccaacacagttgcaaagcaaaagaaagtcattggatacttcgctaactggcaagggtataagacggattatgaaccaagtaatccagactatagcccatatacaggcgtcttagatggtaagggatatgacccacttgatgtgccgttcgataagattacgcacgtgaattatggatttatgattattgatccgaagaccaagcatttggtttctaaggatgcttgggctgattttgacacgtcagttgaaggtggtggaaagaattacattggtcaaattaatcaactggccgaccaacatggtgttgcgtcaatggtttctattggtggatggtcaaattcagttgatgacttggcgttcgataaggtaacggcaacgcctgaggacatggataagttcacgaccgaggctgttgagttcatgcaaaagtatggttttgatggtattgatattgactgggaataccctgacaacgatgatcgtaagacgaagtttgttgctttgattaagcaattgcgtgaaaagttgacggctgcgggtaaggaagatgatatctattatcaactttctatcgcagtaactgcagatcataagaagatgcaatacatcgatccaaaggttgttaaggattatgtggataacgttaatgttatgacttacgacttccacggtggctttgattcacaaacaggtcataactcaggattgtacgctaacgatgcggacacggatcaaaagtttaatttgtcatcagctatggctgaatatgctgaaaagtatgaagtgccaaagaacaagttgatgacaggattgtcatattactctcgtggattctcaaatgttaatgagggtaagattggtgcagcaagtaatgggacgcctgttggtggttcatgggatgatccttacgcaccatcaggaaacaagccttggtggcaaattaagagtcttgaagcagatgctaagaagagtgattcagattctttggaataccactgggatgatcaagctaaggcgccatatatttatgatgcagcaacgaaggaattctggacttacgataataaggagtcaatctcaaataaggttaactggaccatgaataatggttatggtggtgcgattatttgggaaatgtcagaagacacacctgacacagctgaacttggtacattggctgcgaagattgcggatggtaacaatcaagaagttgcattgacagctgaactgaaggaccgtgagccaacactcttccttaacatgtcaaaggaatcattcaacagcaaggataagtactttatctacgtggatggtaagtatgttggaaatacgcagtctggtgtccattactacttctacaagaaggtttcaggtgataaggtaacagtttaccgttcatttgcaggaaaggctgggcaaaagattgaacttcgtcgtgcacctggtggggatgacagcaagatggaagtcttgaattcatttacattagatcgtgatatgaagccggttgaagtaccagaaatcgctgatgccgtgaagaagattacagcttcatcaaagtctactgacatcagcgtcgcctttgatcgtggtgtattccaatcaaagaatcgttacattgttcgtttgaacggcaagtacatcttcgaagcgtttaacggaactggttattatacaaattcaactaatacggttgataatacatcaacgttaacgcgtcgcaacatgacagttaagccaggtgacacggtgtcggtttcgttgactgccggttctcctggatggccaacgggtacagtatttaacgaaactgaacttgttgtggccgaaacggttgtaaagtaacacttcaaatcacacgataattaataatttctgaatagaaagtggtggcgctacgactagtgtcaccgctttttatgttaatacaccattattttggaaggtaaccccaaaaaagcggtgtgttgtcaaaaaactaaagtgatacattttaaacatattgagtctgttgtttttgggttaggagaatgattatggtcaaacgttcatgtttcaatacgctttggacgtttttaatatttgccgggctgagttgctcatctcgctatatttatgggatggattttaatttcatcctgccaatattattattcccgttcgtactaatcgtcatcattatctgggtgattacagttgctgactggttagttgagttctgaagggggagaaaatggcgttaaaaagagcaattaaatccttttggatgcattactacaatctcggtggccgtacgtcgagatcggattattggtgggctatgttgggtcacgtcatcatatttgtcgtttggctggcggtgtttttgtcagttttaggaacaaacgattcgttagaaagtctccgaattactagcgtgagtacaatgtggttagcaattaataattggacgcaaacgtcgagtgacatgatgttagtggttgatattgggctagttgtagtggcctttctgttgttgcccactattgcgattcatatccgacgtttgcgggatgttggcatacatcctttgcttgcctggaatatttggattttgtcggtaatctgggtaatgcctttaaactcggctgtcattacaggcattagtttaagcgctttgcttctttcaatcggcctgacatcgctgccgacttcgagcgtgacgcgcttactacgcatgaatgaagattagtgacgtgattttttgaattttacgacgaaatgctgatttttcgtcactgcattgttgaaaaacatgacaccattatttctagagaaatctgttcgtagtacagatactgaggagggaatatggtgaaaatatttaatcacaagtgggttcgatgggcttggtacaatgtcacaatcattctttttatcgtttatctatgtaatatatacccacctttctttaattcatgggcctttgagctgtttttgacgttcatgtttatcagtggggtgtgcatatcaacaatcacgcatatgaagcgaatccacaaagattggcattaatcacgaaacgtgactgacgacgaatgatggttttaaatggatttaggtcacaggacaatcagaatgacggatatactaaacgtagttactcggataatcatctttctgccaagaaacgagtaacgacatttcttaggtttaatatgatcactgtctctgatctaaagctaatcttctctacggaaccggcaatcaaaatgactttccagtcgatttgattgccggtttttgattagtttttcaacattcgcgtagattgcttaaaaaactgaagtgactggtaatcagtgcgtgcctacaatataaaatcgtgaccagagatgatagcgacttttaatttttggtcaccgagatattaacgttaactatatagttaacctgtttaactagttgagcttatctagttattatcagaggagagtttaaatgtatcagtatcttttaccaccggtcaaaattaagcggctggagttgctacatcatttggtatctggaaaaaatttaaatgttaagtcattggcgcgcgaccttgacttaacaccttctggggtacgacgtttagtggatgtgcttaatcaagaggcgtacgtcctattttcggagccgaatttttttatttttgatgatattggttttataaaaattaatgatgttgacactaaacttgataaacataaatgctttcagacgataaaattgacgtatttacaacaatcgccaattttcaggttattacatgaatttggtattaacccagttcataaggtgattaacttagaagatcgtctggcatattcgacgtcatacatttacagattaatccaccgaacaaataagtttctgacccagtttggttttgaaattcaggaagtggatgctagaaaatatgcaataaccggtgatttgttgtgtgttaggttcttttactatgtgttatttgcagatagctttcaaacattgaattggccttttgaagacgtgactaaaggggcgaatcttgaaaccatggaaatgggtagtgagtataagacggcttccagtcagttgattctaatgacatattggtcgacacttcataaatctcatcgagcaagtaaatttttatcttactcagtaacgagcgacataaatcaagtcttgtccatgtttgagcgagatagagggttttatgatcaaaacgtcgaagatgggtatctgtttcatttttttaaacatctggttgtttcgacgtcgtttgattttgaccgtaaagtcgcgttgggtaaatcattcgcagaaagtgacaacttcatttgccaaacagcacaaaagttaacccagcaacttatcggtgatgcagacgagaatgctgcgtattatgcaaactatgtttttgttttaattattttgttgtccaaattgagtggtggcaaaatgctaaaaattttggaaatcgggtttccgttccccgaattctatcaggtgcaagaaaatgatttaacgactcatgtggaaatggttgtcaatacaacgctccacaaaatgaatgatgtgtcgttaatccctgcaactgaagttttaataaatgcaggattaacgattatgttgatgaacaccaatccgcaactaaatgtttttttgcagttatcaagaacatttacggcgcaccgattggttgaaaatgagttgaagaaatttgtgaatccaaacacggttaggattgtgagcagcattgaagaagcggactttgtcataacagatacgtttgagcatcagcacaaccaaagaccgattttcttttttcaacacttccactctgttgatgaatggaaaaaattgatctcagccattaatgaggagttactcttccgcgcatttaacggctaaaaagtcattgaagcagggcaatcaagtcctgcttttttctttgtgaaaaagcatgttgtgacgactttcatcagccgttttaattttttcgtcacaagtcactcgaaatgtcatagaaaataaaattgtaccaggttggacgatgttgatgaattgtgaataaaacgttttaaaacctttaatggttttcacatatttgcataatggattcaaaaacgtgacgtgagtttaatagagcgttttgtcaaaatatatccaggcgttggaggaggtataacggttgaaaggaatttgataatgggaaagtttaaaaataggaaatggctgattgggcttttgctactgctgatcctgatcgtaggcggagcggtagtgtggcataacatcacaaataaaggcggtgtccagagcgagttaatagcgaatgcaaaagacgctcgcaaaatgtcgaaagaccagttggtcaaatacgctcaaagtaaggctgatgcatcacagttcaatttgcaagtgtatccaaatgcagagatacataaagacatctcaaagggatatttgtatgtgaaaaattcaccgaagaataagtacgcaatcgatatcgatttagtcgacgacaaaacaaaaaagacaatttactcatcgggactaattcaaccaggatacgaagtgacaaattttgggctgaccaaaaaagccaaagcacttgccaatggtgctaggaacggcacaattcgtgtgaagatttacaatcgcgacactcataaattggaaggtgttacggcagccacagtaaaaattaatgttaattaagcaatttttggaggatatgaacatgaagaagacagtaggattttttgcagcagcggttttgggaacgatgatgatgtcaatgcctgtatcagcggaccaaacaatcaacaatggtgccactggttcaacgaccgacacggccgacatgacggttacgggaatcgtcggtgcaatggataacacggaccctaatgaaaacattcctgatggagatgcccgttggatcaacgtaacgttgccaacttcagcattgtttaattctaatccagcaacgagcaacgcaactttgatggcaccagattatgcaatcaagaataattcaggtcgtcctgttcgtgttgccttgaatgatgttaagaataattctcaaacaactatcaaggccgttaagaatgtgacccttgaaggaaagacgcacggcaaaacaacacaagatatcatcttggacggtgtgccacaaagtccatcagcacctgtaaagttggccgatttgggtgacaaccaaggcaagattaacggtcaagatgtgtctgacacgttctcattcacatttacgggaaatgttgatacgacgttgttaggcacaactaaggaaacggttgactatggtttgacatttaagttcacgccgttgaagtcagatggtactatcgcttaattgtgactgcggctaaggcggggatatgagaaaaaaggttatccgaagcactgtagggatgtgtttgtcattgtttgtgatattttttgtgtttatggtggcgcaatatgtttatgaccaggttgtagtcaatcaaaagcacaccgttcaggttactaaacaagataagtctcaaatgcaaatcgaccataataatacgactaccataaatgaaacgaatttgccgacgcaagaagatgtcaattcacgcttgcaacaagattttgaaacgtttaaggggcaagtggttcaaacggatgtcaggtatcaggttccttcatatgctgctgaagtgtttgaggatttgtacgtagatgcgtttgaacaagagttagaacatcaatttccgggtgattacaatgaggatgttattgaaacgctgttagatcgcgggatggcaacgattgactttagcatgacaaccaataacagttaatttgttatgtggtgatattaactacaaatctaaagcagataattcgatttagacttatctgctttttctaataagggatttaaatttcaaagaataggaggtaagtcaacagtgaaacggaatagcgcaattaatttatttatgtcgtttttgttaatttcgcaaagcgtgccagaaacttttggcatccaagcatttgcaagttctatttctgaaacgacacaaaagaatgatacaaaacgaaaagattcatcagacacacaagcaaggagcgtgactgcgagtaagaatgaatctctagagagagtcgccgataagcaatcacgactaacgacttttgataaccgtagttttcgtctaggtcaaagccttggaattgatccatcagctgatgactatggtggagagacaatcagacggtttatggctgattactataacgatgaaagttattacacttatggtgaggcgacattaaaaaactcgttcggtacaacgcaaatgtggggagacaatgctggaactgttacatataagtttcatcgacgacttgaaccagatgctgactatgttattcattacagagtcaactacggggatacaatcaatatattgggcaaggataacgttcgtgcctattcattatctgcatttggtaatgttttgcgattaacacacgacaatagcacgcagcaaattgatcccgcgtatagcggagaatacatgaaaatccagcttttccgtgcgacgacggatccactgaatgaactcgagggaaagtactacccagttgtctcgtccagttataaaggaacagaaaaagttagcaacattgaacaaaataagcagtttaccaatttgctacaagctggagatatcgttcatttattcgttaaagatagaactcgcgttaccagttacgttgagaatgtcaaacaaaattcgattgatacgcgttctggtgagcgggttaaaaactttgtgtgggatgggtctgattttaaagaattgtatgtacagtctctcgaagtaaacaatgaaccaaccatttctgtcgggatgagtcatagtgatcttgataaattggtcgaaagttatgtgccggatttgaagtatttccgcgttggtggtgttgaagtacacggtttttctcaatatccagatacttcaaaagaaggatcgactaaagcaaaaattcgggtcaaacaatatgttggtggccgttggtattacaacgatttagagattccattcaaggtaaagaaagccatttctaaagtcgaggccgttccacagacgtttgattacgcaagtacccttggttcgctggatagcgctgcattgaaaaagtttgtgacggtgtatgatgctgaaggaaaaacgaccgatgaatttgatattaaattggtctcttatcctgatatggtttcatctatcagcgagacacttaaagtggaagtgacggcatgggataccaataatgctgaaaagtacacagtggaggtgccttatcaattaaagcgtggtagccaaattcttttgcacggaattagcgatcgtgaagttgcgcgattcacccttagcggagatggcagtaagattgttgctacatatgacgggtcaaaggggaataataccattcattcatatttccctaatcagcagtactatgcgtataaccagtacaatgtttcagcgaaagatgttgttttgaactcagataagtctgactacaactatgcagcaaacggagatgacctcatcaacagtcttgaaaagtttggtaataagcgagaacagactgtcaaagcaggggacgtcattaagataagtcacgaagaaccatcgcgccatactttttgggagaatgagacggaaagtaacccagccggtggtttgactgatacgttttatcaagtgctaaacgataaatttgaaatgattccgattaataaaatcactgttaaaaagcaaacagttgaattaggtaattcaaaaagtcaaatggatgcgaaattggctgattatctgaagaacgataccggattcaattggcttgagatcgagaaatttattagttatccagatacgagcaaactcggtactactgaagcaactattcgcgttcgtttagaaacccgtgctaaccactatgcatcttttgattacaaagtaccgtttgaggttgtgccacgaatttcaaaagtcgaggcaaagcaacaaactttgacgtatggttcattatcgacggacttcaacctgaagaacatggtgacggtctatgatgcggccggaaagcaaacaagcgactttgatgcgacgttggttagctttccaaatatgattagcagcaaccaaaagtttgttgttcgcgtaacagcatggtattcgaataacactgagacatacgacgtagaaattccataccaactaaagcgtggtagccaaattacattacgtggacaaggtgattttgaaattgcacgttttacgttaaacgatgcgggtaataaggttgttgcgacatatgatggggctaaggctggttaccacgttcatgactatttccccgcacaacaatactatgggtttaaccagtacaaggcatcagaaaaagatgttgtcttgaattcggatgttgcggcgtattccttctcagtgaatggggatgattatgtttcaaaattagatcaatttgggacgaatcgtcagcaggaagtaaaggccggagatattattaagattcaacacgaagaaccaaataatcggcatacattctgggaaaacgagaccgaaattaaaggatctgcagggtttaaagacacttattaccaggtattggacgataagttagaaattgtgccaattaaccgcattacggttacgaaacaaaccatcgaattaggtaattcaaaaggtcaaattgatgctaaactctctagctatctgaagaacgatactggttttgaacatcttgagattgaaaaattcgtgagttacccagatactagtaagctcggtgatactgaggcaacgattcgtgtccgtcatcaaaccaaggcaaagcactatgtctactatgattacaaggtgccgtttgaagtcgtgccaagaatatcgaagattgagccaaaaaatcaaacgttggattatgccaatctgcaagcggacgttacggataacgaacttagaaactttgtgcgggtatacaaccaagctggacaagtgacgaatgatttcgatatcaaattgttaaactacccagatatgattacgtcaacgtcagatatcaaagttgaggtaacggcatggtattcaaatacggttgagaagtatgaggtagtcattccgacgactgtcaagcgaggcagtcagattacattgcgcggtattggtgataaagaggttgcacgttttacgttgaattcgaagttaaacaagatcgttgccacttatagcgatagttctgacagcattcatagttattttggcggggatgattactatacattcaatcagtacacgtcttccgctaaggatgtcgttttacaaactgatgcaccaaactatgtattccatggtattggaactgcaccaatctcatcattgaagaattttggtaatcaacgtcagcagccagtaagcgttggtgatttgatcagtatttatcacgctgaacctgggcaacgccataccttctgggaagacgaaaaagagagtcagccacacgatggtaatcaaactatgtactatcaggtattgagtgataaattacaaccgctaccaatcaatcaaatctcactatcaaagcatgaaattccgtacggcatgtccactgcggatttggatgcaacgattgcgcaatatctggtcaatgataccgggtataaagatatttcagtagataagtttattgcctatcctgacacgagtaaggcgggtgatgcgacaggtactattcgagtaaaatcgcaattgcagtcaggaaaatttgtatactttgattatgtggtgccattcgaagtaggtaagcgtccggagctgaatgtcacgattccagttgacacaaaatttgaggtgtcagataagacaagattggttcgttcaccgaagtactcattcactaacaattcaacgtattctggcgtgaaagctaatgttgagaagttagtgatccacgaagattcaggcattaatctgattagcacgacggctgtgccaccagcaaatcaagaatctctcatccttcgtttgaacatgaaaaataaaactgaggaacaagctgttagtatgaccgccggatctattaatgacaagggactattgattagccctaatgaacagatgacggttttctatgacggacagttttttggagaactcacaaccatcaagaaaaaggtgagtgcaacaacacaacttaagtttaccgtgacgaatccctgattataattgcatgacgaaaaacgacgtataaggttgatttttcgtcatcgggtttgctgttagtcaggtattgtaattgtgtggtagatagctttgttgaacggtgaacaaagcggcttagtctgctacttgataggtgtacgctatagcttctccttggctatttggtatttagtctaactctaggtacacttgcattctccattttagactgacgattatgcttcatgcataattgtcagtttttgtttaaatccctgattttaaaaaatggacgacaagtggtcataaaatatagcggcgtgattgtatgataaacgtggttaatcatctttgtcgtaaatctttctctttgtcgttcgcttaaggtgattagctgttgtgtggttattactgaagaagctgggttatcgttgatgcccagcttcttttttgaacaattaggcattgaaacggaaaatagtggtcacatatttcagagacaatgcttcaaaattaatttagtaaagtaatgttgaatagggagacctggaaaatgaaaacacaaattatgaaattcctgataatgatcaccattagtgtcattgcggctttagctacattttctactagtggacatgcgcaaattttgaaaggtcgcgtggtcgcttattcggccggagagccaacactggtattaaaagaatgggaggttactgtagatacaacagcgacgtatgtcccttatacattgcctagttttctttcagtggttatccccgggcattttgggaactatgaattgtatacacatcgtgtatcgcaagaattagggttggaacaccaagattcgtataactttagtgttaaggtcgatcctaatatgcaagacggagatatcgttcgtaaagaatactattactataatttagctagtacgaaacctattttggcgccgtcgactcctgatacacagccaatcacagtgacacaaactcctgacacacaaccaataccagcaccaaataatccaactgttccgagcgttcccgatgtacccagctcaccaagtgatccagtggtaccaaactcaccgatgacacccgatgcacctgcaacagtgacagaagaggaccaagaccccacggaaaatctgccggagtctaataatcaaattgatagcaatggtaatttgagagatactacccaacttggggtagtatcaaataacgttttagtgggaactaataatcaaattcaacaagaaggtgttgaattacccgaaactgcagcagagtcaaagttttcatacggtattttatttgtactgacgactgcgatttcgctgataggtatatgtttgaaggcaagaaattaatttttgtgatttacgaaaaagtacgagtgattaatgctcgtacttttttcaataacgttgaaaaagtcgaaatcttggtggcctgccaaatgaaaggctgtcattgtattcaaacgtaaatccgtgctccatatgatgagtagtagtaccataaaacatggcattgacttttatgagaaaagttctaatattacttattaataataacaactgactagtcgttagaggagagttaacatgacagcgaagaatgagcatttttacgaaactttccaaccttcacattatgatttgtacattgatgtgaaccgcggtacaaaagtaattagtggacgcacgacgatttctggtgaaaccaaggcaaccgaaatttcagttcaccaaaagtatttgacgattacgtcagttaccgatgaagccggccaagacctggtttactcggttgataacgaacatgaggcgattcgtgttacgttacgcgaagttggtccaactgctttgacgattgcgtacacggcaccgttgactgatacgatgatggggatttatccgtcatactatgaggtggccggtgagaagaagcagattatcggcacgcaatttgaaacgacttttgcgcgccaagccttcccatcaattgatgaacctgaagccaaggcaacgtttgatttggcgctcaagtttgatgaacaaccaggtgaaactgtgttggcaaatatgccggaactacgtgaagaagatggcgtacactactttgcgacgactgtccgcatgtcaacgtacttggtagcctttgcattcggtgatttgcaaagcaagacaacccgtacgaagagcggagttgaagttggtgtctttgccacgaaggcacacaaggcaaatgaattggactttgcacttgatattgctaagcgttcgattgaattctacgaggacttctaccaaacaccatatccattgccacactcatggcaattggcgttgcctgatttttcagctggtgccatggaaaattggggcttggtcacatatcgtgaggcttatctaacacttgatccagataatacgccattgcgtcggaagcaagtagtggcgactgtgattgcgcacgaattggcccaccaatggttcggcgatttggtcacgatgaagtggtgggacgacttgtggcttaacgaaagttttgccaacatgatggagtatgtcgccatcgatgcgattgagccagattggcacatttgggaattgttccagacggatgatgtgtcggcagcattgaatcgtgatgcgactgacggtgtccaatccgttcacgtgcaagtggaagatccagcagaaattgatgcgctctttgatggtgcgattgtctatgcgaagggtgcgcgtatgttggtcatggtccgtgcgttgcttggggatgatgccttgcgtaagggtttgaaggcctactttgatgcgcaccaatatggcaatgcaactggtgctgacttatggcaagcattgggtgatgcctcaggcttggatgtcggtgctatcatgacgtcgtggttggagcaaccgggttatccagtggtcacagcagcggttgtggatggtcaattgaccttgtcacaacaacaattcttcattggtgaaggcgaagaaaaggggcgtcagtggcaaatcccattgaacagtaactatgaagccgtgccgcaattgctgactgaacatgaaatcgtagttggtgattatcaacaattgcgtgcggagagtggtcaaccattccaattgaacgttggtaataattcgcacttcattgtgaaatatgatgagacgttgttggctgatttggcacaagatgcgacgaaattgtctgccatttcacagttacaattgttgcaagatcaacgtttgttggctgaaggtcgtttgacatcatacgccaccgttgtgccattgctacaaacgtttgcgaatagtaaacatgtagttgttacgacaacactttatgatgttgcgaataacttgaagaagtttgtgacgcctgattctgaagaagagcatcaactaaaaatgttctttgatagcttgagtcgtcaacaagttgcacgtttaggttggcacgcccaagccggtgagagtagtgacgatgcgattacgcgtccgttggtcttgcgtgcagcgttgtatgcccaaaatgcagaagctattgcggctgcccacgacttgtttgtggcgcaacaagctgatttgttggctttgccagctgaagttcgtggcttggttttgcgtaatgaggtcgaaaactatggtagcgaggctttgtttgatcaactgatccaagcttacgttgcgtcatcagatgcgacgttcaagcgtgatattcaaggtgcactgacgcaaacaccagattcagatttgattgcaacattgatcagcaagtttgaggatgctaacaccatcaagccacaagatttgcgcgcttggtaccgtggtgttttggcaaataagcatgggcaacaagcagcttgggattgggttcgtgcagactggcaatggttggaagatacggttggtggcgacatggagttcacgacgtacatcacggtgacggctggtattttccaaacggccgagcgcttggcagagttcaaggccttctttgaaccaaagttgccaacgcctggattgacacgtgaaatcacgatggatatcaaggttgtagaaacccgcgttgcgctggttgaagcggaacaagaagcagttaatgcagcggttcgcgcagcaaataacaagtaatagacaaaataaagaggtagaaaatctgtggattttctacctctttttgtttacatcaaaatattctcaacgatcttaacgaacatcgcagacccaacgggcatgcagtcttcgtcgacgatgaacttagggtggtggttgacgaattcgtaaccatcctcagccaagccggaacccaatccgaagtaagcgccaggcttaatctccgtgtaggctgagaagtcttcaccagccatcaattgtggcattgggtacgtgttttcttcaccaagtaactccttggccgtgtccaacaccaaatccatttcttccttagcattcatcactgagccgtagcccttttggaagtccaaatcgtattcagcgccgtacattgccgtcacgtgctcgataatgtcgcgaatcatacgttccatgtcggcacgcacttgtgggttacgtgaacgaactgacgccttgatgtgcgccgtgtgaggaatgatgttgttaacagtgccggccgtgaattgtccccatgaaaccaaagcggcttcagtaggggcaacacggcgggcaatcatgttattgattgattgaataatctctgtcccaatcgtaattggatcaattgattgttcaggtgccatggcgtgggcaccgcgtcccttgattgttaggtcaaacaaatcagatgaagctgtcatggcgccgtaagaaaagccaacagtaccggtcttggtcattgggaaaacgtgcaatccaaagatttgatcaacgtcatccaatacaccggcttcaaccaaggcgattgcgccaccaggtggcatttcctcggcggcttggaagataaacttcacatcaccgtgaatgtcatcacgcatctcagctaaggcgaaaactgcaccaagcaaaatcgcagcgtgcacatcgtgaccgcaagagtgcatcacaccagggttaattgacttataaggcacatcagccaattcgtccattggcaaggcatcgatatcggcacgcaaggcaatggtcttaccagggtgcgcaccgtgcaacgtcgcaaccaaaccggttggggctggacgttcaatcgttaggttcggcacatcacgcaacaagttctcgatgtaagccgttgtttcaaactcttcgaatgacaattcggcgtgttggtgcaaccaacggcgccaggttacttgatcagcaacccgaatcttttcaagcaatgcttccataattaggcgttctccttagattgttttggaataaagcgtgaccacaagaacatcaaggctcccaagattaggaagtagacgaataccatgaagtaagcgccgttagccatgtcgaccaacaacccaatcaacgttggtgaaacaataccacccaagataccaccagtcgcaacgatggcgtatgatggaccgaacttgtgtggcgcaaaacgcttaactggcaatgacatcaatgtcacgaacgtcatggcactgaagaattcaccagaagccaaggcaattgtaatcatgccactgtcagctgatagtgacgccaagaataggctcacagcagccatgatggccgcaaagccgataaccgtcttttccttaccgaagaagaacttgccgacgatgtatgaaccaccgattgatccgaccaagaaggccaaaccgccaatcgccgtgatatgaccttgcagaatcgttgaaagcttcactgattgaatcaagtaagacggcatccagttgatcatgccgtacatcatcgcgttaatcgtaaagtttgataggaatagcaaccaaacaaaacgttcacgaatgacgtcagacatcttggcagcgggtgcttgttctgtgacggctgcgtcagtctcttctgcaaacttcttttcgcttggcaaaacgaaacgtaagacgattccaacgacaacagaagcaatggcaatcatccagaaggcacgttgccaaccgtaatcttgcaaaacaggtgacacgaccaatgggacgatgattcctgaaatacctgatgcggaaatcaaaataccttgcgccaaagtacgttgatccaacggcaacttggtcgcaacttccttggccgcactaggcgcatacccagagtgggcgatggcaccggccaagaaacgaatgataatgatgaacagcacagccttggcgaatccagccatagcggcgaagatggcgattgcggccattgagaagaccaacaaacgctttgaaccaagcttcgtgttcaacaaaccagcgggcacttgcattgaagcatatccaatgaagaaagccgacataaccattcctttttgcacgttactgaaaccaaaatcttgttgcatgctaaccaagatgatgccaatcgcgtttttatcgaagtaaatcataatgaagccgaggaatagggcggctaccaatgtgattgtgcgggcagtaaccttggcttttgccggggctgccgttttagtggacggctttgccacaattgtttcgtcatccataagaaaaattctccttctaagactaaatagttgttatagatgaaattagtctaccggttgagtatggtaattttgtgaatttcaactaagaagatttctcatggtatagaccacgtataccagccgtataatattcataatttatgcatgctaattcaaaaatccgaaccatctttttcgattttgtccgtcatgattagattaatgacaaaaatgatatgaggggacgttagtatggttgcaaatattcgcaatatggaaattgataacgatacgcaaaatggcatcacggcgatgcgagtatatggggaatctttgaagggctacatgatgcaagaagcgatggcctcattgcactgccagaatggggatgtcatcttggatgaaattctatggcgtttgtatgccggataccgcgaaacgcctgaagccgtagtggaacgggttaaggacaagattgaaagtatgggccaacaggtcgaggatatgaaaattctggcagcgggtgtggagttgctagataaggatcaattcttccgtaatcgctttgttggcgaagttgctgatacgtttgttgaaaagggttatgacattaagttagcacgcccagaaggttacgtattggtcaacccgcgtcgataattttatgaatcaaaaattatttgattgggcaaccgggtaaagtggctgtagtctataataagaaaggagtttccgcatgaatagttcagttatcgcgacggcattttggtcaaatggaattgagttaacagtactgggatggttagttggttgtttagttttattcggtgttgtatcagcactcggtgaactaagttggcgtaaaactgctaagcgggagcctgctgtcttcgtacgtgccggtatgattttcggtatgacggtcattggattggtgatgttgtcatcagtgtcagctttcttatttgccttgggacaataaataataaaaagggcggccagcgatggccaccctttttatttttacgactagttgaatatttgtttggtgggtataaggtcggtttagatacactaggacatgtttaataaagcacatgtaaggagaatgatatgagagagtacaaatttgcacatctaacattagaggtggaagacacaatgcgcgtggcaatttctgaagaagaagattttgcgacggtgctccacaaaacagagagtaatgagggggtgacattatcattgttcattgaggatggcgctgttaaatttggggatatacctttttacctttttgcgatttcctttgaagctggtgatcgaatggtgattaagactcggtctgaactgtagaatttgcacacggtataagacaggtttagatacacttgagcatgtttaatgacccacatgcaaggagaatgatatgaaagaatacaaattttcgcatctaacgttagaagtggaagacgcaatgcgcgtggcaatttctgaagaagaagattttgcgacgctgttccacaaaacagagaataatgaagggatgacattctcattgttcgttgaagatggcgctgttaaattgggggagctacatttttacctgtttgaaatttcctttaaagctggtgatcgaatggtaattaagccccggcctgaacagtagaatttgcacacagtattcactgttagttaggggtcgatcagcgatggtcggcttttttagcttgctctggtaaaataagtagattgtggaaagaggtttaggttgatgagtgacattaatgaacaatataatcatgcgcgctctttgattaaggccaagcagtttgctgaagcgcaggaagttttgcagcaggtgatggcaagcaagtcgggttacaagtcggcacgctattatgctgggcgcgctgcgtttgcgttgaaaggttatgaaaaagcgggacaattattcgccggttttgtccgccagaagccaacacctaaagcgaatatagcgaatacttattcttatttagcacggttggcgattcttgatgaggacagcgatagtgcacgcaaactcttgcagcgcgcggcctcacacggattagtgaatgaccgtttagaaaagattcaagcccaaatctggcagttagaaaacgaatttggtgatgatgagccagttttgaattcacggatgaatgttcgactagaccgcttggcatcgaacggtacaccgattgtcacgacgacggaaaagggctatcaaagtgcctcgattttcgtcgataagctgtcgtatgatcaaatacaaatgctgactgacaaggaatggcatcaactacgtttgacgaccccgcgttggacaaatattcctgggtatatgagtgcgtcggctttggagtcacggatgctgtacgaaaagttcttgccacggatgacggatattcggtatatgtcagcgttcaacgattacttagaagagaatgcgtacttccaacaaaaatgggaactatcgaaggtttttgcgttactgcaagtaccggaattcaataaagcgattgttgcgcaactactagatgaaagtcgtttgactgacggtcaggtattaaagcacttggcagccgttgatgacctggtgatgctaaaagcgagtggggaagtgctaccagtttcagaacggcaacgtttccgttcgctagaattgatgcagtcacctgaattcggctttattaatgaagaagatcaatcaggtttgttgtatttgaagtcaaagctggctgatgaacggttagtgcgtaaagcactggctagtacaacggatgcgcaattaccgtttcgtgataaagtgactgattttgagccgattggtgagcaaactgactttattaattggattaagcaggagaaacgacgcctggttgcgctactcggtgttggtggtagtggtaagacatttgtgttgggtaagattttgaatgccgatgccgtcgttgccttagcaccaacgcacaaagcgaaattgaacttggttgataatggttttaaaaccgttgggacggtccaatctgtcgccgcggacacggataccgctcaggctttcaaacaatttgatacggtcattattgacgaaatttcgatgatgtcgatggaaatgatggcaaaggtattggccttctttggaccagcaacgcggtttattctgattggggatgacgcgcagttgccaccagttagtttggatgaggatgccttgtcggtgacaggtgatttgattgggttgattcgccagttcgggactgggtttgtcttccaaaataatcaccgtgctaaggtgccagcgttacgcgaattcattgcgcatgtgcgtgcccaggatgatcactttattcagaccacagggcagtatcaaacggctaagtacggtgagatgttacaagataagcgtcaccacttagagctggatgacgtgatgattctggcgtacaccaatcagcgtgtcgctcaggtgaatgagtatttcttcaaggcattggccgccgatgaagaagtggtggtgccgtttaccaagcgcggtaagtatggtcgcggtggcttctttattggggcgaaagtcatgttctacaacaatgacgacacgcatcaatatgggtatgcaactagtgaatatggtgaaatcaccaatctgcgtgtatcagacatgaatggcgattacggtgaagttgaagttacggtaccagccactgggcaaacgtataagctgccagtgtggcaagctaaacgaggcctactgctggcctatgcgattacgattcacaaatcgcaaggtagtggtgcgcgtaaggtttatgtgatggaagctgccgattacggcttagcctatacggcggtttcgcgtgccaaggaagaattagttttcgtagactacagtcgcgaacaactcattcaagctttgcatacaccatcacctaagaaattgaatttgtataattgaaatgtagaattcattgtggacattggagcggggattatgaaaatatttatatcatctagaagagaaaaagaagggtggattgattggcaacttgtcagaagcaaaatatcgaattttataaaaatgcaaaacatgcaatcattcatgtttgaggccttcccacacgatgatgcgcctgaggaagtcttcttagaagctgttgaaaatgcagatgcgttaattgtccttattaaccaaaatgttcgaaacggcacgattcgtgagatgaatcatgcgttggaaaatggaaaaataatttggatttttaagttagatgcggataatccaattgacgaaaaaattaattatctagaggtattggagccatataaaattaaaaaatcttgggcgaacataacagtacgtgaggaagattatacggaggtgattttgaactcaatcatctcgacgatactgaattactatcagtttaataaaaacgctgatggcggaagtgacatttctaatgttaacgataatttggatctaactcttttaaatactaatggaaatccgtttgacccattttttgaagaagtcgaagaagaagcctttaaaaaaatacaaaggtatgtggcaggtcacgaagtttgggatgtggcaagccacagagaattattgagaaatctaattggcgaggatcattggctttttcctgtttctgaaaaaagatgggtagctaatgctttggtgaataaagggaattttgaaggggctaagattttggcagaacaaattttagaagaaaacccccagatgcctaaatggcttcgttttgatttgttaatacaattaagaaacatcgagaatgatatacatggcggagtgcagaatgaaaatcaatttcagcagcaactatccgacatgaaatacacacagaacatcccagtattcgataagtatgtcagcaacgctgagtcagagcgtctcactgaacttagggagatgaagtatttattgaaagagacaagaagatactccaacgtcttatattcaattttaaaaaactattttaatgcgtttgcatatgcagtgattattgctagtcctcatttcatggctggaattgtcaaacagatatccattacttatgtagaaatcggcgtagcatatcaaaatggcgaaatggtgaaacgtggtctagagctactgtttgtgcatggcgaatggaatgaactggaacgcctaataaagcaagattcaactatcattgaagaagtaattgaaaacaatattgatgaaatgtatgtcatggcgaatgagagtacggcttcaaacgataagttctattcatttgcgcggaaattttaccatttattgaacgatgataacaaactcaatgtaaggaatcgtgcattaaataagcttatgcagactagcgataaagtaataatatctacgcaactacgtgggtttatttctgaagtgtttaatgattataggactttggatagaattcaaattgcagatgttttctttcaaaatttctatttctcgatggatgatgcgttgcttcgcgtgtttttagcatattcattttcaagtgatgtattgaatgatacggagtttgaaaatgtacaacgcaattttatagacaagctcgagagctgggaattatcctatttgtttaggaataaaaaattcattgaaagatccaaaaaagtcggggttttcgatgggctagttgggaatctcacagaagaagataaggtgtttgcaaagttttattacgaacgtacttttgattcatatattgaagctgttaaactaattttcaaccaaacaaatatcaagattaagcatcttccatctctgaaacagaaaatgaaatggatgcgatctttcctacctgagaaattagaaaagtggcaggctaaagttctagcggaagaggtagaaacttttttgaatttttactcttctaaatataagacaaataatcgtgattattatggtgatgatgtttcagtcttagagatgattttttcagtatggggagttttggaagaacggaaaccttcatcatttgtgcctatgcaacatcgagcggataatgccttggaatttttttcatcagaggtgttaaacaaacaagttcttgacatactgttgaatcttagtgggttatctcaaaatcaaacatcaattcttcaatctattatctttactgggaatatgagttatgtagatgaaagagaagttgcagtaggtgtgaatttgctactgcaattcgaggaaaaatccggagattttgtgtatgaccaagatagacttctgttattgagtcggttatccaaaactgacgatattatcacacaaacatatatgtatgattctctgtcaagattgtctaatgatgcttcataccatacatttgccattcttacgttgaaacaaatgcaggcagatgctggtgtaagaatgaaaaaatttatcaacaattatcatcaatcatctcagaagaagtaggcgcaaagctggacagaaaatcaaacattgaatcaaaaaagtgctgcaactcagttgtgattggatatggtggtatcggcagaaattgatgttagatacaatacgatttagcgcaacggatgtaaaaatccgttgcgttttttaatgcaaaaatatccgataaattggtagtgtcggaagtaatactgggataaccgggatactagttaagaatttcacgaaacttgaaatatcataaaagaagttcggtttaaggcgtgataaattgggaataatggtaaggagagaatcatgacgaagtcgaaattatggcgattgattaccttgtttttggtgattgaaattgtgagtcaaagtgcacacatttttggaacgaactttcatcttgccgcgcgatacacgatgttagcatttatcgtggtggaagcagcactagccgggcttaccttgttgttgaataagcttttaactcaggtacaagtgccgtttgaccggcatatgactgtcccacagtcatcgtatttattgtttccagggttcttattcttaatgatgacgctgggcacgttggttagcgctgactacacattcaaaggatttatcatggcggttgttttgacgctattagtggcattctttgaggagtacttatggcgcggtattattttgtcggtggtgaagcaatacgttaggagtgaactagtgctggtagtcggtctgggggcactgtttggattgtggcacattaccaacgctatttcacagccttggcatgagaatgttgtgcaaatgattgaaattgctggtttgggtatgctgcagacggcactgatgttgcgaactaagaacttgctatatccgatgattatgcatgggttactggacttcagtggcattttgcgaaacatggcggagccgcatggtattccttatcacgtcgctgcgattgtgttcgctagttatgccgtaccggcactattgtttgtctatttgggcagcaaaaaacatgagggaacgagtgatgaataaacaattaacgggttttaaagagctgttgtatatattggtgctagtgagtgtgtggccgattattttagacgtgattcgtggcgataatatttggcaagggtatccttggggtgttgttgcgatggtagcagcgtctttcttatacttaacgaagctgaatgaggtcttgctgacgttgttaatttatcttgcgtggttggttgctattattgtatttaaaaatgatcttattttttcaaaatttattattcttgccgttctggcagggtttatgacgggcttttccgtaatgctgggtatttacgctaagaatcatgggtaagagagtagtactttaagtttcttttattagagaaggcgtaattgttttgtaggagggaacgatatgcggaattttttaagtggattgtggccgattgttgtaggattaacgattggacttatcggggttaattttgtagctagtccggtgactatttcaggcgattccatgcagccaaacctgcagaacaatcaaatagtgatggtgaataaacaaggcgagataaagcggggcgaagtcgttgtatttaatgcgtatggtgtcgaccctaatgcgactacgcctgatgaaaaatatattaaacgtgtcattggtgtgcctggtgatacggtgtcggatgtgaatggcgtgttacgagtgaatggtaaggttgttgatcaatctttcattagcgaaaacgaacaggtcgccacgaataatcgtgttggtgattggacatcactagcagaattgggtcaatcacaaaactggcaaggaccaattagtggtaaggttccagccggatactattttgtgctgggcgaccatcgtagtatttcaaacgattcaaggtattggggatttgtgcctaagaacaagatttctggcacagtatgggcgccgccatttgataatgacgcgactgaagtgaataaggtgtctttctaatatagacttgatggtgcgcaatgagctgaaaactcgttgcgctttttttatcgctgattatgctacgattaacaaaaatacgcgagaggtgacctgacatggtgttgattattattatcctagtccttgtcgtaatcgttagcgtggcagcgttttctgacgactcggatcggacgattgactgggaagatatcgaacgttgggaacaagaacgacgtgaccacaaacggcgtaatcgttaactcctctttaatttgttatttgtgttacaaaatgtaataataatgacatattaaaactgttgggggattgtgacatgaagatgtggcaacgtggattggttgtaacgatggcttttgctggacttgtaacgccaggtgcagtggtatttgcggatgaagcagtgtcagcgacaagttcgtcggctgcgccaattcaagcggatactgatttgacgttggctggggatgctatcgccgtgcagaagttgaaggttggcaagaccatggctgccggcacgacgttggtgaagatttactacatgaagcctggtgctgtgttgcaactatcaggtccatatacggactttggtggttacacggtaacgtcaaatgaattgccaaagattaatactgacaagtatgtgtacgttgtgaatgatgagggcttgtcacaagacgggacgacgttgaaccataaggatccggagacgaagatgtcaaaggacgagccaaagttcagcaactatagcaagaagtgggccaagaagctgtcaaccaaggaagttaaagcaatcaacgagtacagcaagaactatggcgatatgaacaattggttgcgtggtttggacaagaaggcttctgcgaagacgaagaatgagattaagttgattgattcatcattcaagaagttcaagaatcctaagacaactactgtttggcgtggtctttcaacggacggctttgatgctggcttgaagggcaagttgaaggttggtgcaacgtatattgataagggttacatgagtgctaccttcgaccaagaaattgctaagaagtatgcaacgggtatcgtactccaaattacgttgccaaagggcaagagtacgggtgcttacatcggtaacttgtctgactggaagattgaaaaggaataccttattaagcacggcagccaattcaaggtgacggcagtggatgatttgggtgataacaagctggtgagcttgaagtatgtgaagtaatggaattgaggtcgttggtgtgattgccaacggcctttttgttgtcgctttttcagttggactaacaaatttagcgtacccaaaacgcactcacagccatggtttgagcagttttagcgatttatggccataatatcagggttgcttacttttttgaaagcggttacaattagtgcgtacaaaaaaaggaaccggttccaaaattaatattgaggggaaatattatgaaccacgaagaggtagcaaagcgggttgcgaaggctttgggtgatgataatgtcattacggcagcgcactgtgccacgcggttgcgtttgattgttaaggatcgcgacagcattgatcaacaagcgttggataacgatccagatttgaaggggacattcgattcgaacggtcagtttcaaatcattgttggaccaggggatgtcaacaaagtttatgatcattatgtgagtcaaacgggtgttaaaacagcgacaccggaggagcttaaagagcttgccgcccaacaaggtaagaaaaagaatccggttatggcaatggtccaagtgttatcggatattttcgtaccattgattccagcgatgacggctggtggtttgttgatggcgctgaataatattttgacgggaaaggacttatttggaccacaatcgttggtccagatgttcccgcaaattaaagatgcggctgacatgattaacttaatgtcttcagcaccatttgcatttttgccaattttgattggttacacagccaccaagcgatttggtggtagtgaaatcttgggagccgttgcggggatgattttagttatgccagccttggtaaacggtaatgatgttgcgtccgtcgtggcggctggaaagatgccggcatgggatatatttggcttgcatattgcacaagctgggtatcaaggccaagtgttgccagttatcggtgtggcgtttatcttggcgaatattgaaaagtttttccataagcatttgaagggggcaattgatttcaccttcacgccaatgtttgccattattattacgggatttttgaccttcaccgtggttggtcccgtcctacgaacattgtcaaatggacttactgatggcttggtgacgctttatcaaacactcgggttcattggcatgggtatttttggttccgtttattcagcaattgtcgtgacggggttgcaccaaagtttcccagcaatcgagacgacattgctcgccgatattaccaagaccggtggcgatttcatcttcccaattgcagcggtttcaaacgttgcccaaggagctgcggcatttgcggtgttcttcttggctaaaaaagacgagaagttgcgggcactatcgtcatctgccggcgcttccgccatgcttggtatcacggaaccggccatgtttggggttaatttgaaatacaagttcccattctttattgcccttggttcagctggaattgccggtttggtgattgggttgttccacgtgctgtcatcatcattgggaccagctggggtgattgggttcattgccattccggcggccaagtgggttggcttctttatcagtattgcattggcgttcgttctggccttctcaatcacatatctttacggtaagcgtcatcgtttcggcaacgatgccactacaaacgaagcaccggtccgttacgaaccaaaggcaggcgatgttgttgttgcagcgccagttgatggtcgggttgaccgactaagttcagttgatgatcctgtcttctcaagtggtgcgatgggtaaaggtgttgcgattatgccagaggctggacaagtatttgcaccgattaatggtacggtaacagttgtttatccaacaggtcatgcgtacggcttgctgggtgatgacggtgttgaaattctgattcacatcggagtggatacagtctcgatgaatggcgacggttttgaaacggtcgtaacgcaaaatcaacacgttcgagcaggtgaagtactgggaacgtttgatacagcgaaaattaaagcggctggtttggatgaacatgtcatggtaattgtgacgaatgcacctcaataccacgacgtacagcagattgcgaaccaatcggtaacggcaggtgatccgttattggcagcccagaaggagagtatcgcttgattattggagatatagaaaaatttgaacagtatcacatttatgcagaacatggcttaattaatgacccgaatggtttgatttattttaacgggcaataccatgttttctatcagtggaatcctaacgcattggaccacacttataaagtttgggcgcacgttgtcagtgatgatttggtcaattggcgacgtttgccgattgcaattgcgcctagcttacctgaagatcgttcaggaatttattctggcacaaccatagaaaaggatggtcgactttacgcgttttataccgggaacgtgcgtaatgatgctggtgaaagcgtggcatcattccaaatggcagcggtatctgatgacggggtacactttgaaaaaataggcaagttatttgatcagccaagcgggtatacgcgtcacgttcgcgatccgaaggtcttcgagcgaaacggccgttattacatgttacttggtgcgcaaaagcttgatttaacgggtgatatcattgcctacgaatcaagagacttgcatcattggtcatttatgggctcaatcctgggtgaccaaattttggcttatcgtggttacatgatggagtgtccagaccttgttacaattgatggtcgggatgtgttgatgttttcgccacaaggacttactgcagctggtgaccgcttgcaaaatattcataacacgggttatgttttaggtgaattcgacgaagttaatggcgctttccaagtgacaacggaattcaaagagcttgaccaaggatttgaattttacgcttcacaaactttgacgcatggtgatcgtcacctgttatgggggtggtcggggatgatgccatccgctagagaaaagcaattgccgacgattcaggctggatgggcgcacgttttgtcgttgccacgtgacatggcaatcgttgacggtgaattacgtcagtatccgatttctgaattgggtgacttccaacttgtacaaccagaagcaattaccgggctagggttgtggcgtttggatggcgataactggcaggtggcattgacgtcaaagctatctatccagcgcaatggcgataccgtaacgtttacgcgcgttgcttgggagtctggtgagacggaagagcgccgggcgaaagtcactggggatgtgctcctagttattgataacgatgttgttgaactgtacaccacatcaggcgacacggttatgacggcgagatatttcgattaaggtaaatagtattaaatagcgacgttgcggatgacgtcgctatttcttttgcgctcattcttgataaaatgaatacgaaagatacggaggggcgcgagatgagtgaaaaagaaagagtgaccattagtgatattgcccgactagctggtgttgggaaaagcacggtctcacgctatttgaataatggctcagttagtcccaaaacgcgggctaagttggatgccgttgttaaagaatatgactatgaaccaaatcgttttgcgcaaagtttgaaaaagacatccagcgggatgattggtgtcgttgtgcccacgtttgcgtcatttgccttaactgaaatgatgcgtggcatggactatgtgaaccaggatgatttttttctaacgattaatacttatcacgatgcgaagcgccaagttgaagcggttaagcaactggcccagcaaaacgttgatggcattattgtcatgactgggcaagttacggatgaaatgaccgctgcgctagaacaggtttctgtgccggtcattgtgcaaggacagccgtcaacgcaatttgagacggttaatgttgataaccagcatgccggcgaactactggtgccattaatcgccgacgccgaaccaagcgatgtgttgctactaggtgttgatccatcagttgactacaacgtcggacaagtgcgtttcgacgctgtcatcaaagcattaaacggccaaatgaaacgggtctatacatcatttgatcgtactgaaacaatcaccgtgatgcgtgattatcttgcaacacacgagttgcctaagtacattattgcggcaacggacatcattgcattgggggctctggctgcagtgcaagagcaaggcttcaatgttcctgatgatgttaaaatcgtggcctttgataattcgccggcagctgaaattgtgacaccagcgttgacgacggttgggtttgattattttgtgctgggtcagtggttgtatcgtcgcctaaaagacctctctcaaccagaaccggttttgcatgacccaatgttggcaggaaccttggtacgtcgtacgagttggtaatggcaaggatggcgctaccgtaagacttgtggcacgtaatttcaggtcgcatgctctaaaattaggttacaaacatctatacagagaggatgcgagctatgaaaaaatggtttttatttttagtactaatcgccgcgtttgtgctgggcgcagtggcgtttttactaggtcgagattacaaccaaacattggtgaaggataagccgactagctcatcagtagctagttcgaagtcatctagtcataagtcgtcaaagtcgtcgtcagcaacatcagaaacggtggcaattcccaaggcgttgaccttgtcaggcgcccaaacggatgagttcgcaaagtgggtcggtgatcaagctgagaaaatgcgacttgctggttcagcactgaatctgcaggttgatttgcctgatgctaatgatacggattctgtgtattaccagactgtaaacgggccgttgtatatcaatggaacaaacgctggtcgtggattgcaagctgagggaatctttgggttctatgtctgggatgcttatcctgttcaagattcaagcggcaagcagaattatgacggcaccgttggctaccaacctgcgcaaaccgtgaaatttacccttggtgcaaattatggtcatgttgctgatacaacgaatcattcaatggatatgtacatcgtggctaacgatggcaatatttatgagttcaagctggctcaaggtgcaagtagtttggcgccgttgtatggggatgaacatgcttcagaaaatgatgtcgtgggacaagtgacgcaggatgaagcagcaaaggctgagttgaatcgtgtcgtgggttatcaagcggacaaggtgagtgagtcgtttaattattaaatattgatttagtaagctaccaagtttatgctgggtggcttttttattaacaactatattcttatttagaatatatagtaaaatagaataaaagagagctttgagtagacacacggacaggggaacgacggaaatggaaaatcaactgaataaggcagaattaattgagcgcttaaagcaaattgaacacgttcaaaagacagcgaatccgcaatcagacgaggctaaacaggcatatgaagaaattgacgttctataccacgggataacggtgcacgacttgatgtttatttaccatcaattgggtcgagatttgactttcgaagaagaagcagacttaattatgggcgtttcaaacggcatgcatccggtagatgttttgtccttacctaaagcagcgacggttccgtataagataaagaattctcgcgtccgtcaaaatatgacacaaacagagttgggagataaggtgggcctgaaccaagcgcaaattgcgaagattgaaaatggccaaacaaagttgaacgttgagatgttgttttcgattattgatgcgctacatggttcagtgcaaattgattttggaaacgaaacagaatctacttcgctagaagcggatgttgatctgcagtcaaacaagttaaaaatgtagaaacgaatgtacaagggtcgccaagttttttcttggcgatttttttatttatatgaaatcagcgattcctgaaaaatattgatttgcgtcacgtatttaatgggcatacaattaaactaataattggtcagtgacaggtatgaggggatatgaatatgactgtagtttatatatttatcggtattgtggcagttgcactatttgtgggaaactacattatttatcgaaagcatgccacaaaatctctgaataagacgcaatcgttctttggcgcgatagccatgacttttgcagatttgtttttctagtagctagttagatataaaaaaacgacgatgtcaccatcgccgtcattacttatgctgaatcgtcgagatatcctcggcgattttttcttttagtgtttgtagctgcaactttgaaaggtttgccgactcaattagtaacacaatcgcttctaaatcagtatccaaatccacaaaagctagtggtagcgtttcaacactgttgtctgggttatcagtattacctagtaggtagttaactgaaacgccgagaacgttagcaactgcttcaacgtgattgacggtcggctccttgaacttccagccgtagatagtattgtgaccgagcattgcagcgttgttaatcgtgcgcaacgaataaccttgcttgtctgcaatctccttaattcggtcaaatgtgattgatgaaaagtttgccatggtaacaacttcctccgttgatctaattatgcaacaaatatcgctccggtgctagtcagggcacgtttatacgctacttatccgaaatagtgttaggtttgacgtaaataagaaaagaaggcaagaaaaatgaaggcagttgttctaaagaagcttggtgattttgcatcactaacagatgaaacggttcctgatttgaaggtgacgtcagatgccatcttggttaagactcacgcggtggcagttgatcctattgatatcaagattggcagtggaagccgtggtggcagtgcgccaatgattcttgggtcatcagttgcaggtgaagtcattgcagttagtcgcaacgtgcaagacttcaaagttggtgatcgtattgcagctaatgttcgtggtggtgaaacgtatgctgaagaagtcctagttcctactcgcttggcagcccacattacagatggtgtgtcttatgccagtgcagtttctgttgtgcttggtggtcaaactggttacagcggtatcgtccgtggtttgcaagttaaggctgggcaaaacgttcttgtgcaaggcggtgctggttccgttgggctgatggctgtgcagacagcattggatgctggtgcgaaggtcagtgcgacagctcacggctggggattggatttcttgcatgagaagttcccgcaagtgacggcgtttgattacaagacagatgacataactgcgaacggtgcagtttatgatgctgtgtatgatacggtcggttcagaaaaggtgctagcagattcatttgcagcaattaaggctgatggtcatgtgctatcaatcgttgcacgttcacaccgtgatccacgctttgtacacttcttcaatcaaccaatcggtgacacggtacaaacgttgttggatggtttgagtagtggtcgctttgtggcggttgtggatagtgagttgccattgagcgctgataatgttcgtttggattatgaacgtctacaaaacggtggcgtgcatggtaagctagttttaacgatgtgaggtaactaaggttatacacagaagatgtcttttaaaggaggtggtgtcatgaaacgactcattttaacggctgggttgctgaattctgagatgaccacgtttgttgaacaactacaacgtgacaattcaactatttacgtatttgatgcttttcaggagcgactcaaccagtatgggacgcttgatacaacgcactcccaggatgttacggtgtataatcgtatctacaatttattggacacggcaattctgcaaaatgaagatggcatgtttgtgttgttggacagcaacttaacgcgatcacgccggcgtggcctgtataaccgctatagagaaccgaagtatggtgtggcacaagttacgacgcatttctttattcgatcatattctgaggtgattgatgacgaaaccggtttgtcgccaaagtctgttaaagcgcagtacatcagttttcaaccatctcgaattggtgtagatactgatgaagtgaatgttcagtctgatattttcaacaaagtagcccatgacaaggtgactgccagtcaatccgtagatgaactgttcgctcaactgttggtgacgccactagcagaagaggttaagcttgattaccaaggtcatgataatccacatcatctggaatcgataaaagagcacatcgatatgacaattaaggcatcgccaactgatgaactgcgccagattgcgatgttccacgatttaggtaagggcataactaaatcagtagatgaaactactgggattgcgcatatgcctggccatccgtctgttggagcaataatcgcgttggcgttctatggtgagtctaacaacattaccgaaacagtgttgtggcatatggaagcgcataaggggatttctacgaaggttatgaatcgggaaaagttgaggcaacctgtcatggaattgctacaagaatttgcggtgattgacagtgaatctcgttttgataccaagaaataaataagttgcgaacagttcactagaattgtgtggtgtgcaacgaatttagttgttagaaatgttacgcttacattggatatgagtgtgacgatcaccccgaacaatactgttcggtagactaaaatatttgctcaacgggtgaaaaatcggatgctattttgaattcgctttagtgttttggagttttcatttgttttacattctttaaggaggattatatattttttaattgttaattgatataaaatcctaatgatggctaggtgtttatgtattaaacgattgcgattaaggaatacgaaatgatgatagcctgtactgttatatataaagcgacaaaatgtcgagaatgattaaggagcattttaatgtcaatgcaaatacctgttaatttagttgagctgtggtctatttttgaagcggaaaatgaagtgatggaaagttggctgaaaattcatgatttcggatataattttgagcgggatcgacttaaaattgatacgcgtgaactcttaagttataaaggccttatttcacaactttcaggtcttaaatgggaccaagccgcgggcttttatcttggagttcagttaaataacaacgcagatacacaatttgacttattaaagcctttagatgacgaaattataaatattgagtttaaggagcaggagcctgaaaaagatactctgagccaagctgttgaccactatagatttttaaaaatgcaatactcaaaagtttgggtgtactcatataggaacgatttgaatgtactttatcgtttcgaaccaggcactaaaacgctcgttgcggttacaaatgatgatttggtgactaacattccaaagggaacagatactgttgcgcctttgttggaaatggaaccgtcagattttttggtttcaccatatactcaaccagaaaaatttatgaactcgttttacgagttgagcggaaaacaagaaagagtcaaggctactattctaagcaatctcaagggtattcatgttatcaaggggggacctggtgctggaaaatctcttgtgattatcgacattataaaggagttggtaaacagcgggcttaaggttgctttgattatgggggctaaacctggcaacgggcaaaagcgtcttgccgaactattgggatttgaacttttttggtactacaatataggtgacttaagccaacttggcgagtttgatgcatttgtatttgatgaaagtcagagaattacacaaggcgtaatagacgctgcgttagcaatgccagctgacacactacgtattttcagcatagatcaaaatcaggtagttcaccctgatgaagcgaacaggaatgttgaatcgcagttggatgaagttaagaccgctagtgtaacaaagttgcctaattctgttcgttctaaaccggaatttatcagtttcataaaaaagatgttcaacttacacgctaaacatgccgcactgcttgactacccctctgttaagctaacctattttagacctgaacagaactataagggctatcttaaaatgcaaaaagagttattcggggttacagtattggaaccggatgttttccgtagccatttctttaacaggacgacaggtaacaaaaagatagctgagtcgacagatgtaaaagatgttatcggacaagagtttgaaaatgtgttgattgtattggacgacaaagtcaactacgatgacaatggtattttacaatataacattgaggggtatccgtatgatgctataaaaatgctttatcaagctattacacgagctacaaaaacgattgagattgtggttacagcaaataaagaattgtacatcacgcttcaacagctactaacatctaatagagataggtataaagaaaaagaagataaaatggcggccctagtgttagaaaataaacagctagctaaagaaaatttggatatgaaggaacagctagcaaagcaaatagattagatttagagtaagcaataatttggcagagagtttaaataactttctgcctttttgctataatattgtatgacaaattgaacttgggaagtatgtatgatggaaaagcctgtcattaaatctataaattatagcgaacaaggaatccgtaatcttcgaaaagatcttgatgcaactgaacgcgatgtaattttgaatcagccaacggtttatgtaattaatcaagattataagaaaaagtcaagctatcgcgtgtacgtcggagaaacgaatgacgttatccaacgaactgagcaacatttacaaaaatcaaccgataaggtaaatgagatggatgatgccgacatgtatatcattggtaatctgttgtttcaaaaatcaatgacattagacattgaaaataggatgattgaatatctaattggggcacctgatgtgttcgacatagaactattaaacgcccgaggaaatgatcagtctcttaattacagtggtaaggataagacagacgaggtttttcgattaacaatcgatgaactgaataagcgagatcccaagctctttccaaaattttcagatgtggcaactcgtgcaatttttaagtcctctccgtttaagagcctaaatgaggagcaagaaaagacgaaagacctaattttaagtacggttgctggacaagttacaaataaagcaacaggtcagcttattcttgtggagggtgcagctggaactgggaaaacggtgttgcttagcaggttgttttatgatttggcttcgcgagagtttgctgaaagagcacagttgagtcagaaattgaaggttgctctagtggtgaaccataaggaacaagtaaaggtgtacagcaacttagttgacaaattaaaaacgaattttggtacacctgatttcattgtcggtacgcctactcagcttttgaatcgagtaatgaaccatggtgatgagtttgatgttgtgttgattgacgaagcgcaccttgttatgacgcaaccaaacaaaggtgcttggacacacaaactacaaaatttctttaatgctacagagcaaatctcagcaattcaaagcgttgcgaaaacgacaattgcaatatttgacccaaatcaaattttgagagctgatcagtcatgggatgaagaggcagtcaaaaaattacgtcagcaagctactacgcgtcatgaactgacaactcagatgcgaatggaaatagatgctgaagataaaaaatggattgatgaatttgtgaatggcgaactgcgtgaaattcctgggtcaacgaattatgaaattaaggcattttcaaatgtagtggacatgtttgatgagattaaatctaaaaatgataaattcggattatcacgaatgttagctacctacgactgggaatgggacaaggatggcgaatggtttgtagaggtcgatggtttgtcaattccatggaactataccgccgtcaaggaaaagaaaaaaataacatgggctgaagacccggaaacaattgttgaagttggatcgacatttacaatacaaggattcgatttaaattatgcaggcgtaattctgggaccctcaataaagtatcgagatgggcatattgtaatcgacgatgatgagaacaaatctttctgggctgcgtttaatagaaagattggttctgcaggtactgaaaaacatttacgcgatgctctaaatgtattgatgacacgcgctgttcgtggattgtatatatatgctgttgatgatgagttacggtctcgtttgctggggaagtagaaccttggattagcagtggaagtgtgaagctttatgcagcttttcaaaattaaaaggtaaagattgaccatgctccatgtttcgtatgtgtatatgacaaatggagtctggtcattttttatgctttttatcttagaaaacaatgacaggcgtgggtcatgtcagatggtgaaaagcgttttacatgttaaaatatataagggagtatgcaaaaaagaataaaaatttgactttatggagaaaagtaaggatgattaagcacagcacagcacagcacagcacagcacagcacagcacagcacagcacagcacagcgcctagataaggcttttttaactgtatattcagaaatgagcggcattaacctaaatgtcgctttttttagtgtcatcgttcgtaaggcggtggcgtaatgttgcgagataactttaaacaaaatgaatctgtgcaagccaatactgcgttcttgaatgagttgttggaaaagcttccagagtattttacttctatggggacgtttgacctggaaaaattcagagataatttaaaagaacataatattgatgaattaacttcaggttaccaactgggatggatcggaaaagattacgctaaaaagcaatccggagagcgcgctacaacggtcattgttcctgatttattgcacaatcaaaaaaatgagaatagagatagtcagaatctattctttacaggcgataacatagaagtgttgaggcatctacaaaatatatacgcgaattcgattgattttatttatatcgaccctccttataacacgggttcggatggatttgtttatccagataattttgaatactctgacgaccaaatgaaagaaatgttcggtatcaatgaggagcagttaattaggctgaaatctattcaaggcagagcgagccacagtgcgtggttgacttttatgtacccaagattgtatctagcgaaaaaattgttgaaagatagtggtgtcatgttcgtttccattgatgacaatgaacaagcgaacctgaacgagctgttgaatgaaatctttggagaatcgaattttgttaataagtttacatgggtaagtaagcctgaaggtcgatcgttgcagagcgtgggagccaatggcacatccgaagtaatatttgcgtatgccaaaaatattaatgaagttagtgagtttaaaagctcggcatcaaaactacgaagcctgatgccacaaaattatagtggttatgagcgtgaagttagcgttgatgagaagggggaatatatagcaactcatgagttatacaatggtaactcgatatttaatgaggaaacccgacctaatctagtgtttgatatttggtatcgcgagtcagatggggatattaaatttgaggagcctttggaatcgggttatgtactaatcgaaccgcaccgaaacactgatggagttcataaatataatgcttatcgttggagcaaagaaaagattgcaaaagaatctgatgatttgttgttcgtaaagaaaggtgacacatacaaaatattcactaagcgtcgagattttgatactgtcgtcgcaaaggacttgattacccaaataacaactgcctcaggcggtcaagatttacgaaagttaggcattgttggttttgattttcctaagccggtgaaattaattaagtttttaattgagattgccgcgcctaaagacgctgtagtactagatttctttgcagggtcaggaactacggctcaagcggttatggagctcaataacgaagatggcggacagcgaaaattcgtgttagctactttgccagaactaacctactcattgaattcggatggggaaaaagtagcgcgaaaaggggcgacgactgccttttcagctggatatgcaagcattgacgaaatatcacgaaatcgtatagaaaaagccgcaaccatgattaaagaaaataatcagggtacggattctgtaaacgactatggatttaagcattttaggattgtaaccccgattcaagcagcgttagacgaaattgaaaattttgccgatgttgagatgcaaagcgatttgtttgacaatatggtcacccgattttctgccgaatctattggtttagaaggtggtgcaacaggtgaaaatacgttgcttacgacaagtatggttgaagacggttacgactttgacacccgcgtaactaggaaggaatttgccggctacaaggctagttacgttgatgaaacgagaatctatttgtttgaaccgggatgggggggctgaacaaactagatcattagtaaatgaaatcggcacacatcaattgaatgtacaaacattagttgcgtatggctattggttcagtatggaagctatccgagaattagaaattgctcttaatcagttggatggtaaggtaaatctacaagtgcgatattaatgccttggttgttcaaattgaagaaaggaaatgaaatgaaaattcaattagaagaactgcgtcatcaaagtgatgcgttacaggctattgatagtgccttttttggtttagatattaatggcgatgatcctgatgcaaattacgtttatgctaatccgcttattaaaggccgatatacagatgctgcaaatatagacgtcaagatggagactggaactggtaaaacttacgtcggggttcgaacgatgtttgaacttcaccggaaatacgggttgtttaagtttattgtggtagtacctacacctgcgattaaagagggatggaaaaatttcattcaagctgattacgtaaaacagcacttttcacagttttacgagaatactaaagtaaatctaaatgtgattaattcgggtgactttaacagtaaaaaagatttaatgcctgcaaatttagtagatttcattgaaagtgaccgcttaaatagcaataccattcaaatactattgattaatgctgatatgctcaggtctactaacatgcaaggcatcaaaaaagttaaaggtgttgttcgagacaggttcaaccagactttgttgtctggtttcactaagccattggaagggttacaagctaataggccggtggtcctcgttgacgagccacatcgctttcccaagacgggtaaatattatgaggctattcaaagtgtaaaacctcaaataattatccgatttggagccacctttaacaaagagacgaagggtagaggcactaataaagtagaggtatatgattactacagaaataagccgcagttcaatctcaatgcggtggacagttttaatcaagggcttgttaaaggaattgatgtttattaccctgaactgaccgccgagcaggcaaacaatcgatataaggtagcgaaagtaacggcaaaagagcttgttttgaaacaaggttcgacagagtatgctctgagtttggatgataatttagctaacgttgacccggcgtttcaaggggatgttacttttgtgggaacaagtgataagttgttgtcgaatgatcttgagttggcggttggtatggaattagttcccggaacgttcgaagcgtcatatcaagaaatgttgattcaaagtgctattgataagcattttgaagctgaaatccgtaattttatgcgtgaaaacttggttgaacataacgctccgcgtatcaaaacaattagcctgtttttcattgatagcattcgatcataccgtgatgatgatggctggctaaaggaaacgtttgagcgcctgttgaaagataaactaaacaaattaattcgtgaatatcaacgcaaaacattagaacgagagacccaatatcttgattatttgcaagctacacttcaaagtttggtgagcgacacccaatatgttcatgcaggatactttggtgaagaccgtggttccggtgatgaagcaattcaagctgagattgaagatattttgagtaataaagaaaaaatgcttagttttaagtctgaagatggtagttggaatacacgtagattcttgttttcaaagtggacgttacgagaaggatgggataatcctaatgtttttgttattgcgaagttacgtacttctggtagcgaaactagtaagattcaagaagttggtcgcggactccgtctgccagtcgatgaaacgggtcatcgtgtgcagcaagacgagtttgagtctcgtttggcatatctaattggatatgatgaaaaggactttgctgacctgctaattggtgaagtgaacggtgatgctgacgttaaacttgatgagaaaaaattgactgataacatgatttctttaatagtcgaggatagaaaacgaacagatgaaacgtttgaccggaagaagttactgaatgaattagatgctaaagggattatcgatcgtgataacgaatttgaaccaaaggttgaaattgacggtgatgtcaagtctgggtttgaatggatgatggttctttatccagcgttgtcgcaacaaaaggtccgccccggaaaaattaggaatcgacctaaaaatagtgcaactgctaaggtgaaactccgtaaggagaactgggaacagttaaagagtgtttggcgaaaattctctcagagatacatgctggaatttgaacgacgacctggtgcaatttcaatgattgtcgatgatgtatttggtaacgttgacctttatcaacgtgaaaaaccagaaatgacacatatccgaattgaaggcaatgaagattcaagtgaagtgttagcgcgttctaatacagctgaaatgaaggttagttatcgcgatggtatgccttatggaaaatttttgaagcagctggctcttagaacaaggttgccaatccaagaattacacaaggccgtagctttgacgttatcaaataagctcggcagcgatcaacgctatctgacggaaaccacgctagtaaatttgaatcgtgagtttaaggcacgttttgagaatgcatatgcacaatcatataaatatgagccactggactttcaagcaactacgtccgtatttgatccaaatacagacgaatttgttgatgaaatttccgctgatgctattggtcgagagatcgatgattctgttctgacggataaagattcatttttgtatgacacgccaccaatgcgttatgattcagttacaccggagcgtgatttacttaagcgcgattatgatgatgaagtaactgtgtttggtaagatacctaaacgagcaatccaagtacctaaatatactggcggaactactactcctgattttgtatatatggttgaacgtgaagataaatcacatgtttacttgttggtagaaactaaagctgataataagcgcatatcggatcaacaaattgttgatattcaaacggagttctttagacagttagagcaacaaaatgtggtttatacagaagctactgatgcgcaaacagttatttcaaaattacgtacattagaaaatgagaaagggggtaactgatgaaaaaagatttacttcaattggcagacagtggcgatatttctaagactggtgcgaaacccaaattgcctacaacaatccctaatttaacggataatatgctggatgtgtacagaattccgttgaattacttgtactacaacgatgaaaacggacgtgtttcaacacaggttcgacgtgttgttggggaacttacaccatcaaccgatgaagagaacccgctgtataatgaaaagtttgctggattcatagcagatgataacttaggtgccttgaagaagactaagaagtcaattttagataaaggacagcaagtctatgggtatgtcctttcagatggtcgaatcatcgatggtaatcgtcgttatacagccctgcgccaaatctccgaagaaactggtacaacgcaatttttcgaggccgtcattctgccgtttacctatgatgctaaagcaaatcgttcacagattaaacgccttgagttggccattcagctaggtgttgaagaaaagcttagctatgatcccgttgatttggccgtggacgcatatcaaacaatcgttgtcgacgagctaatgactgcgcaggattatgcgaacgaatcaaatactcgaattaaggatgttgaatcgaagctagctactgtggaattgatgcaatcatttttcgaattcaacaatatgccagcggatgcattttacatcattaaagatttgaaactatacagtccgcttgaaacgcttgcagataagctgaacaaacagtatccaaatcgtggaccaaaatttgaggcgacaaaggattcggcgtttactttgcttgcgaaagtaatcatctcgggggacgattcacgtactgagatgcgaaactacactcgaaatattatgagtagcgctgtgaatgacgactataacgaacaactggaggaagtggttgataattttcgcgacaagatggactcagaaccaatagcgacggcagctgaatatcgggcacgattggagacagcggttccggagttgcgacaagtcaatgaaaagtacgccacaacgactaacagacaaaaccgcggtaaaaacgtagacaactttgtgggagacgtgacagaaacgttgaatacattgaaggatatgcaacaaggcaacggactaacgggaaacttacaattcacgaacttcagtcgagaccaaatttctgaaatccgcgatatgttggtcaaaatcaacttaatcagtaatgatttgattgaggtgtatgaggatgaactctaaaccagtactgaaaaaaactaaagtcggctttcaatttattgatagttcggatggcgaattacaatcttcacgggttcaacgaacactgaaacggtaccgtgactattttgtggattttgaagatttaattcttccgaaagatattaattatgttgacttaaacacgttaattgaaaagcttaacaaccgattaaatgatgagatttatttggaagatgatgttaaacagtatattgaacaaaatgcatatgcaattgatgaacaacgcattgcggggttgaccattaaagactatgatttgcgttggaatgatgaagtcactgaattttcaagaatcctgaatcaggaaatttcacgtccgttgaagccgcaacagctacaggctagcttttatttggctactatgaaaaaagcagcaaactttagtgtcccgggtgccggtaagacggcaatgatgtatggtgcatttgcttatctaagttcgcccgaagtcgatgagataaatcgattagtcgttgtatcgccaattaatgcgtttgaagcgtggagaacagaatttgctgaggtttttgggtcgaagcgagatttgcactttatgaacctaaaacagtatggagctgttggtgatgtgcgccgcgactggggtgttgcaaatataatcgttatcaattatgaagcattatccggttggaaattgagtgctttgaatggccttatcgatgagaaaacaatgattgtattcgatgaggttcatcgaattaaaaatccggaaggtaagcgagcggctaatgctctgactttgggacctaatgctcgttatcattacgtattgacgggaactccaattcctaattcgtataaggatgtctacaattttttacatttactctatcaaaacgagtatgatgcattctttggttgggaaatcaatgagcttgatgccaatatttcaggcgatattaatgataaattgcaaccgtttttttggcggactaacaagactgacttggaagtacccccagccgaagctgacaagcttatcaaggttaagccagatactcaacaagctgacctggcagcggttatccatgatgttgaatctaatgtattagcaaagtatattcgtctcatgcaggcatcaacaaatccggaactattaactgcaaacatcgattttaacgatttgggatttttgtttggagaacttgactatactgttgattcagcatttgacagtgccgaagaacgagcagctaagcagagactttatttggattttggtgttgataaaatgcggacgcctaaatttgatgcaggtatggatttaattaaatcactggtacgcgaagggaagaaagtgcttgtttggggaatgtttgttggtacgatgcataaaattcaagatgagttaaccgaagaggggattagctccagtttgatttacggagctacaccaaaagatgctcgggtcgatttgataaatcaatttcgtgacggtgatgtgtcggtcttaatttcaaacccggctacgcttggtgagtcgatttcgttgcatcaaaccgtgcacgatgcggtgtactttgaatacaattttaatttgacattcatgcttcagtcacgtgaccgaattcatcgattaggattgcctgctgatcagtacacaaggtactattatttgatgacagagggtgacagtgcacacggcggatttattgatcaacaagtctatgaccgtttaaaagagaaagagcaagtgatgatgaatgctatcgatgggaagttattggtgccgatgattgaagatgactatcttgatgatgttaaatcaattttgatcaaatgatttatgcgtaatgatgatttcgaacaaatttaaaacatgtaattaaatcagccttaatatgaatcctttcatcttagggttgtactgtataagctaacttcaatttcttgaggttagcttttttagtgtcgttatcgatttataaaaattcatagtgtacggctaagtatgctatataataattttatatattaaccgggtgagtggtgaaaatgacagtggaatcagataaacttgtaattcaaaatattccctattccgaaaaagggttaaaaagcttagcgcgcatctcacctgccgaccggcaggtgattttagatcgtaatactgtttatattgttaatgaacaatcgggtaaacaatataaggtctatgtgggtgaaacaaacaacattcaaaagagaactttgcagcatttgaaggataaagatgatgttctgcaacaaattaaagacggttatctgtatgtgattggtgatagtgagtttcaaaagtcaatgactttggatatagagaatgaactgattaattacttcttggcattgcctggggatgtacaagttctaaatggacgtggtaatcctcaaggctcatatgctggctcagaattaaaagatcaaattttcaaagagacactgaaagaactgaacagtcgcgagccagaattgttccctgaatatgggcgagtgcttaattctacgttgtttaaagcgtcgccatttaaaacgttgtcgggccaacagaagaaggttaagtcagatatattagctctggtgtctaataccattaagaatgatggtgatactaagttaatcactgttgctggggctgcgggaacgggaaagactgtgctattgagcagtttattctatgaacttgcaactgctgagtttggtaagcaagttgccgggcgaaaattaaaggttgcgatgatcgtcaatcatgacgaacaacgcactgtttactcagcgattacgaagcgtttaaaggcagcctttggagaagaaccagtcgtctttaagccaaccgaatatttaaatgcttacatgaaacaacaggaacaatttgatgttgttttggttgatgaagcacatttagtttggactcaaggtcacatggctgcttggactaagaaacatttcaagatgtttgggactgaaaatcaattgaaggcattagccaagacggctaaagttacgattgccatctttgatccaaagcagatattacgagcagatcaatcttgggatgaggatgcaattgcagatttgattcgtgggtcagatgtgacgtactcattgacgcagcaatatcgtattcaagcaaatgagcaaactagagactggattgatagttttgtagctggtgatttaaagcccattccacatgattttaagtatgatttacgcatgtttgatgatgctaaagagatgtttgaggctattcaaatgcgcgataatgaagtcggactgtcgcgtttgttagctacttttgattgggaatacaaattgaagcgacgtgttgatggggaaccttggatggtaacggcaggaaacttggttaagccgtggaatttacaaacgtcaggtagaaacaaatctttggcatggtcagaagatccggtgacgattgatgaggttggtagtacctttactatccaaggattagacttgaattatgccggtgtcatccttggaccttctatcaagtatcgcgatgggaagattgtgattgatgctagtgagagtcatgacaagaatgccactaagacgcgcctggatgatggattaacggctgaggatcatctgcgaaatgcattgaacgttttgatgaagcgtggcgttcatgggttgtacttatatgctgctgatgataagttgcgtgagaaattgatgggaatttagtcttataatttggtaatagcgattactctactgctatcgaaaaagtctattcttaacgctaaacttttaaatattatcgaataattcgattatggaatgaatattacgcaaataatgctaagaagattctgctatcttatatgctatatgaattgttaagggggacaataatagtggcaacttgggcagaagacgtaagagatgcattaagaaggttaggtggagatgctgtatacgaggatatatatactgaaatagacatgaatggagagcatcacttatctgattatcctaaatcgtttacagcgtcaattaggaatgccgttgagacacactcgtcggaatctaaaaacttcaaaaataggaaatctgaagatgattggttcgtccccttggctggcattggagcaggttattggggtctgagagaaacgcagtacgttacgaatatgcctattgatttaacagaaaatgattctgaatttccggaaggtaagttagttatgcgtgctcacttgcgaagagaaagaaatctcgcgttggtaaagaaagcaaaacaaagatttctggatgatcatggaagtttatattgtgaagcgtgcggatttagttacgtatctaagtataagcaagcgatagctgcagactttattgaggctcatcatatggtgccagtttcaaccttgaacgatgaatcggtaacaaaaatcgaagatatggcgatgctctgcgccgattgtcatcggatggttcatagatttgggactgaaaaaattaccagcaggccagacttaaaattgatttttaaataacctatcacatcgtgctgacttttatgcatatatcgtgctgaactttttggactgtcatacgattaatgtatttatgattaacccgactgagaaagctacaatcaagtgtttcgctctcagtttaaaacatcccgaaatatcattcgattgaatgatgaatttgtgacatatttgattttttaaaatgattttggtgttcatattactgaataagtagtattatattgaggtgtatagctcaaagttttggaggaggtatcgagaagatggaaagtagtttcaaaacatatagagacgtctttgaagatgattttgctacccaattcggtgagtataaagaagcttttttgaatattaagtttactgattctctagaaattaatgtagaagatgttgcttcggtattagacatagacgttgaatcttcagatatggaacaatctggtttaattgaatcttcgggtaataaagcggtcataaaagttaatcaatctgaagtaagctataggcaaagatttacaatagcccacgaaattggtcataaaatccttcgacacttggatcaagatgcgattctatatcgggctgttcagacttttgatcctgctattgaaaacaaattgcaagagagacaagcaaatgatttcgcggctaatttgttaatgccgggtaagttggttagctattacattgatgaattaaatataaaagatattaatatactggcgcaaaagtttgatgtctcatcactttctatggaatatagactcattaatttaggatacatttagtgattatgctagaaatatatagagaagtattgggtagactgaacgaagttgagttatttgacacgttggacgttaaattagttattcgagaacgcaatgaagatgatccagaaaagaatgatagacgttactttgtagaccattttgaaattaatactgacgtggattattctgaagttttaaagaatgcaaaacgtcagatagatcagctaaacgaaaaattggaaaaagatgactggaacatattttatgtttttaaagaattgtttcaaatattaggtaatcgaaagaataacggtcttggttttaactatttcagaggccaaagggataattggaaattgaaacctggtattgctcgagatactgtagattccgatttgatagattattatgactatcattattcagaaatggcagaaaaatttccacatgatattaaatatgttgggtatagcaaagaaaatagtaaagatagaacggaacagttagcaattttacagcattatggatttcagacgagtctactagatataacctctaatccttacatagcattggagtttatgatttcaggacgaggttcaggagaaaaggtttttgagaatagcacgtttaatttttttctgatagataagaataaacataatactgaaaatatttttacaacagtaaagcgaaatgatattaatgttaggttaactgcacaagaaggtgcttttttaattttgattttctttacgacattaagaaaagcaaaattgaaaaaattccaagagtagcagttgaattggtttttgatgagcaacggaatgacgattcgaacattttattagaagggcttcagaaggttaacaaagaagttgagtctaagattaataaagttttgtcaaaaaagctacatttaaaaaacgaaaaagagacagctgacaatgaggcggactcttttgttgataatgttttgactaaacgagtgctggatgcaacgataaaaaacgttaaaaacgatattgactcaaacgaaaaaagaattaacttttgttttcttgatattcagggtgacatacgaagaaaattatcggaatattattacttagaagaaaagttatatccggattttccaacttatatttcatatcagaaaaacaaatttattcgaaccaataattctcaaaacggaaaaatcgtctaagttcaatagaatctttttaaaagttggcaattttatgattgctactttttattttatgctatcccactgttagacttaaaaatgattaacatatttgtggttatatcgtatgcatgctatgtacttaagaaaacacctgcaaacgctttcgtgataaaatataagtgtcaattaaagaattaatggacaatggggaggtttatcatgaaagatattttgccggggatgacggtgcatttgactgttggtaattataccgacacgacaatcacggtcaatgggcacaagatgacgtttacgagcatttacgaaattggtttgggcgacactgtatgcatgtttgatgcagatactgagaacgaaacggttcgcttgttaaaggtgccagttcaccaatattaatttgatagtaaaaaacgggccaagggaagtcggctgactctccttggtccgtttctgttagtgattaactttatcagaagttaaaaatgcgtcatcgctgcagttttcttgattggtagtgagtactgatcgatcacttggtcaacatcttcaactggtacgtgaagccaaagggctacgcgtccagagtttgaacggttacttgccgtggtaatcttacttgctgcatacgcaatacgcacatcttcttctgttaatgccatatcattctccttaagaatcgagttgaaacgttgctaaattgtggtgcttatttacattattcatctcttttctttgctgagcacactatctccaatatctagtgtactcggaatagtgcaacactgtatataaaagggaacattaagaaaaagacgccctaaaattaggacgtccccgaagtgcacattaagctgtaacatccaacatcaacaaacgaatctgcttaagccaacgcgcgtaggttgcgcgatggatacttagacgtgcgcatcggttagtgatggtatcggtcggatacttaatcaaatcgatgatcacgcgctctaagtcagatttgttcttttcccgggtgaccaacttggccagtacttgatgtagttcaaactggtctaaagcgtttgaactgcgtaaatcttcgacattctcatcagccggctcaaaacaggtatgctcatcataccgtttggcttgccgttgaaagtcacgtagtcgccaaagcaacaaccgataaagtgagttattcttgcaaggggagggaacgtatccacccatcagttgtaataggataattaaccgcagttcctgatagtaatcatcgtagtcaggtgacgtgcggaaaacatgcccggctttgagtacgcttcgaatcatcatatcgtactgcgggagttgagttgcataatctacttgttggaccataaagtcctcctttcgttttaccgcttttggcggaaccagattcttatttctggccgtttactattaaagcacatctgttttgtcggcaaactgtgcctaaacccgcgaaaatcgggtgaaggttgtctgatttgtataaattagacttgaaagcacagttttttggttaaaacagatggcgttaaaaaagacgtgggggaatatgttttatgaccaggatcgaaatcgatcaaaaggggtatgtcattggattgtgtgggcttgaattagagaagggcgaccgcttgtgtgaaatgtcagctgaccgaacgttgtgcttgctgcctgagaagtgcgaaaagggctttgcgacgcgtattgtgacgatggacggggatgttcgtttagtggggaaaacgccacgcacattgattgctgaaatgaaggaacgtaactattggccaactctgtgggaaatgagtgcttattatgcgttgtatgcaataaagcataggcgtctaaacaaagctgaaattgggccaggggttgcgtttttaccaattacggattcgcaacgaaacacgacttggattaatgtagcagcgattaccggcgtaactagcactgcacgtggtgcaatcattgaaacatcagctggcgtgaattttaaagtgatgaagactgcagataacgttcgcgccgagttagccgctattaaggtgattagccgatggatgttgcagacatataccgctaatcagttcgtgaataagcgcaatttgttagcatggctaccgtggccactttctacgccgtatgacgtgaatgtgcagaagcttgaaatgcttaaagttttgctgatactggggcatttatccggcgttgtcttttttggaacaaaactgcaaacagccctcgaggaagtagcaagttcattgaaagagagtgactgttataaattcggttggctgaaagtcaagtggctggaagatatattgaatatgaaatagcgataacgaccgggggctaaatggcttccggttttttgagtggttataattggggtaaaatttaaccatataagactacagatgcaaaaggaaatggggcattatgaaacattcatactttaacaaagccaaggcagatgcagatcatcaaacagatagtgcaccgtttttcattgaaaagggtgttttatcagccggatggtcatttaaagacactcccgagatgagggttgaggcagttgaaaaaatccacaccttttctgattaccgcaaattctttgatgagacttccaacaagtttggttggaacaagaaatggaataagcaaagtgttcactatttatttgataatctacaggccggtgattttgtctggctaaaaaataaaggaacgtactgggtgacacaagtaccgcaagaaccgaaaagtatgtttaagttcgatatgtcagaacagtttatggcagcagattcagttgcacatattggtcccctggaatgggttgaagttgggggagaagacacggtcccgggtagcgtcacgacggcaaaaggtcgtctgcaagcggcgatgcaacgaattgataatagggatgaagcaattgatcttggtgatgatgtctacacaacgacaagcttgattgcaaagtcagcgatagacaaacataacgacatttcgccgatcagatttgagataccaaaaacacaaatatttaacttgatgggtgctattggtcttgaagacttggtggcattttggttatacagtgagtatggttatgtggttatcccgtcaacaaataaaatttcgacagagttatatgagtttgtgatggtagatgcccgtggtcgaacagacaaaaagatttatcttcaaacgaaaaatggcaaggttgatttgtattcaggcgattacaagcatttgcttcgggagggactgaatgatgaagtctggctcgtaacgagagaaggttctatagatggggacgtatccttgaaatttgccaggcaaacacgtgatggagttgaacggcacgactttaacgaattgacggactatatttttgataaacaaatcgaagcaattctaccaccccttgtacaggtttggttagacaaattcgattggaaatagacgggtttgttagagaaaagtggcgttaaatagctattaaggtctatttatttcgtatcctatgtttagggcaatacaagcatgttcaaggatgcacatgtaagatataattggtttacatagtagaatggtggggtattattttggctgataaggtgaataagattaaaggatctgtgggcaacggattgaaggctgcgcaggttggcgcgggtaaagttgctgaggtggtctcagcaaagacggctgaggcgcgtctgaatatggcggttaatggtaaacttcgtcgtccgtttaagagtatgaacacaacacgtcgcgcgacaattaacagcttggcaaaactatacgagcaagagttgttaaatgacgagacatttgaagatgtgcgtacgcgttttgagcaacaacttattcaaaatttgaatgaagcgttgcaggggatggttgttgattttgcaacggatgatgctactaaacaatttgtctttgataacacagcgattaagcaagtggccttgccatctggtatggcgccatctttgacaaccgtgcagttaaacgacagtaagttgatcaacaattcggcaaagtcgttagcaattaacggtgctacgaaaacgctagatgctgcctcaaagttgaagccagtttcaaaggtcgtgggtaatgctggtgtggcgggtgctgcaattagcatcgtaactggcggagttgaaatggctgctgaaaagattcgtttccaaatgttagcacgtaagcagtttgagatgtcaggcttgaagatggagttcgatgatgtcatgaaaatcgtggctgatcaaatcgaaacgtttaagtctagcttgacgaaggctcagcctagcttgttacttttgccagtagctgatttggcagcagatgatacggaagaatagctcgtctatttctgaactgttagaggccaaggtgcaaacgtagtactgccgcttataatttgataatctagaagagcggaaacgttataacgttggttaataacgctgagatgtgttaaaaatgattgggctgttgggtaagtttacctgatggcctttttcgtagttcaaaacacgaaacttcaaatttacactgtaatcttcagggtaaaaatgaggtgaggaatatggcgaatatattaatcagtgacttgtttggcttcaacaagttgcgtgaatcttatcctgatagacggatcaaattacgttttaacacatcgtggaatacgaatgaccggcaaggacatcggatgcgtcgtgacttctatcagatgtatgcgaatcatgaggcgatttttgaaccctggattctgtcacaagcgaagtcgcgaaatcgagatgatgacattgcgtttcaatttattgaagtgcagccacatcgatggttatttgttggtgcttacctcattctggcaaaggatgctttagtggcccgtgatccaattgcagattacgatgagattccatatgcccgggctgaaaaattaccacagtatgaagcgtttgaaggcagggcaatttttgattggaaaaataaaaatcaagtgtggcggtatgttaatccagacattgttgataatgtttcacttttcgaaattttgtcagaaccgatattgaatcgaacgaatcaatttccaggttttgaaaatgtgaatgtagattaccaaacgttgcagagtgaattgactagcgtggcatggcaaactgcgttatcgagtgtttacggtgtgtatttaataaccgacaatcgtattgggcggcattatgttggatcggcgactggagctggtggcatattgtcacgctggcaaacatatcttgcgaaagggtatgacccggaagaagagaacagcaaagactatccaaatcgcggactgaatgagttggttcagaatcaggggttggattacatccgtcgccacttctcttatagcattttggagattttcagcaagaacgaacaaggccgcaaacaagcgttagaccgtgaaggctactggaaggatgttatgcaaacacggcgcttcgggtacaaccgcaattaatcaaaacgcaaacggtatcaacctcctttgtaggtgtacactggaataagtggatttttataagggagaatttgaaatgggtagcacattaacgaatgttggaacattctttgtcatagtgggtatgttattgagtggcctattaatggtgacatctttttccgaatcacgagcaaacggtggttggaagactgtgggcggtgctcgtcgacgcgtactatcgcaactaccactgtttttgattttcattgcggagttcttgaaattaacagttggtcctggactttttgcagttatcgcagatgttgcgataatcatttttggcttaattgagattggtgctttgttaactcagaaagttgaacgcgattatcaaaatgatgtgcaggttgttcggacgttagagaagctcaaggctggctatatcatttttacatttacggtggtaatggtatttctgaccatatcgatgtcgtaaaagctaacaatgttttaaatagaatcgcggggttagttcctgtaaaaagtgatatcaacgagggagaagttgaaatggttgttaattttgccaatgcgactcattttttcgcgatgttaagtggtgtcatcgctgtcgtgttgcttttgcgatacagagctgctatgaaaaagagtggtagcgtaaaggtcgtatgtggtctcaagagaaaatacaaggtcgcgtttttgccgatggtattaatgttcgtcatctatttttctaccgaaattattaaggcgacgtattatccggtgattgccgacgttgtgattattgttttcgcgtttgttggtatcattggtttggcaacgctaaaaatggatgcctcgaaaagtgatgccgcgatggcacgtacgtttggcttgttccgaagtacattcatcatgctgacgttcacagttgcagttgcgcttcttaatatgcagtaattaacgttgaacagtgttctgattaatttcaggacgctgttttttatttgaaatcgaccattttttgactaatcttaatagattgctcgaattcaattgtaaccgcttacaactgttggtatgctatatgcgtaacagacagaataagatgtatgggggatacaatatgtacaagtcaacgattccaaccggttttccagaggggttcttgtggggtggtgctacggctgccaaccaatacgagggcgcttggaatgaagatggcaagggattaagcacggctgaagtggtgaagaaggctgagaagcgtaccgatatgaatttgggggatatcacgcttgaggacatcgaaatcgcgattgcagacaagacggatgagaactatccaaagcgtcgcggggttgatttctaccaccgttttgaagaagatttggctttgatgggcgaaatgggtgcgaaggcattccgtatttcattggcctggacgcgtattttcccgaatggtgacgagacggagccgaacgaagctggcttggcgttttacgacaaggttttcgaaacgatggccaagtatgatattgagccagtggttacgttgtcacactatgagagcccaattcatttgacgatgacgcgcaatggttgggctgatcgtgcgacgattgcggactttaaccgctttacggaaacggtcttccgtcgttacaagggcaaggtgaagtactggttgacgtttaacgaaatcaacacggggtcatttggcttccacgagacaggtgcggttgatactggcttgccttatgatgagcaactgcaaattcgttaccaagcgttgcaccaccaatttgtggccagtgcgattgcaacgaagcaagtgcatgagattgatccggaagcgaagattggtgcaatgttggcgcgtatgcaaacgtacccagctacaccaaatccggccgatgtgcaagctgcccaagtgcaagatgagttgaacttattcttcacggatgtccaagtccgtggtgaatatcctgagttcatgaaccgctactttgcggagcataacgtgacgattgccatggctgacgatgacgaggcaattttgaaggcgcacccagtcgacttcttaagcttcagttactacatgtcaacggtgacttccgccggtgatagcgaagcggatgcgttgggtaacatggctgttggtggtcgaaacccatacttggaagcttctgattggggttggcaaatcgacccaatcggtttgcgcattgccttgaatgagatgtgggatcgttaccgcgtgccattgttcatcgttgaaaatggtttgggtgcgcttgatgaaattgcagacgatggtggcattcatgacacgtaccgtatcgattacctccgtaagcacatcgagcaaatgcgcgaggcgattatcgacggtgttgatttgatgggttacaccatgtggggaatcattgacttggtgtcattctctacatcagaaatgtcaaagcgttacggtgtggtttacgtcgatcaagatgatgccggtaacggaacgctagaacgtaagaagaaggattcattcgagtggtacaagaaggtcatcgcgacgaatggtgatgatatgaattaatgatggaacgtgtctgccggatggcgggcacgtttttttggtagaatttagttaaagggttttgggggaggtaaaacatgagtaagacttatcaagaatttgtagaggcgaataagcgtaatgaacgcaaaatgccgtttgcaccggtgataaccgggccacttttgtttccgtttttcaaagacggccttgagccggtaccggaagtgatgatcaacgatgacggtttgcctgtcgttgtgactaaagatgatttgttgtactttttgaagcacaatatttcgccttttgtgaccgtggggatggcaaacaagacgatgtgggaagtagtgaatgccattaaagcagcgtcacattcggattgggcaaagagtggacctggcttatttacattgccaactcgtttcatcgaaaaacgaattaaacagtcagtaatgctgaggtttgctcgtgataaagagtttgtcacgcaggtcggcaagcttgagaagattacggctgagtttttggaaggtgaaccggataagcaacctgaactaacgacttggtatttaggctaattgcgtgagtgatttaggtgcatttttaagcttcatcacgtaagctatacctatacaccattgagggggactatgataatggcgaaaatgagtgatgggtttcaatctttgaagcaaagtgcgggccgtatgggtgagtcagtgaaggcgaagacggttgaaacgcgagtgaacatgattgtgaatcgcaagttgcaacaaccgttcaaggcgttgaagcaaacgcgacgggtggcaattcaacagttggcggagttgtataagaacaacaaaatcagcactagtgcattcgatgcagtggctttgcaatatgaaacgcagttggtggcaggtgcgaatgaagcattacgcaacatggttgtgtcatttatgacggatgaagcaacgaagcaattcgactttgactcagatttgattcacgatgtgcaactgacaccgatgacaccggccaagtacgtgaagattacaccgaatgcgaccgcgaacgccctgagcaagcaatcaaagcgtgcgatggttttgcaagctggtacgatggctgctcgacaagctgccaagttgcgcaagacagctgctgcaacaccaaagaagggcaacgcaatcgtgaagaatgtggccgttgatctggcagtcgctggggttggttttgccattgatttggtagagagccaagtgatggcacgcaaacagttcaaggtatctggtctattgacagagtacgaacaagttttgcaacaggttgctgagcaagtcgaagtcttcaaggctagcctgcaggtggttgatggtcaattgaagttgttgccattggcgcaactgattgacgatgataatgaggaaatttaacgatgttttaggagttgctacggcagctccttttttcgtcactgacagaaggtgtgttctggagggaaatcaatctctgagtgtgattccaatttttttcactagtgcctggtatgctagttgaaaaatggaggtttagcaatatgtcatgggtagtctatctcattgcgttaattggttttattcggagctgtacatcatctgatcagctgccaccgattatcgtcgtcttttttgtcctgctgattatcaagatatttaccggtagcttcctagccggcttgctttactggggttttgttatcgtgaccgcttttgtgttagggatagttggtcaaatcattggcgttatcacccttgaaggggatgcattaaatgtgcagatgtatggacttctgatactgtcgatgattattgtggggtggtatggcctgaaacttatgctgactggcaaaattggtaaataaaaaggaagcaccgattcggcacttcctaataattgcaatttacttggctgcgttgtaaccatcaatgatggcattcacgttagcgacgttttcagcgacccagtcagccaatgttgatgtggtgtacaagcggttttcagtgtgatcaccgtgtagggaatcaagcaccaacgtttcagaatcagtgacaaagcgtccgttgaacactgcttcgtccgtgtgggcaattgcaccaatttcagacaaagcaacgaacttgtcagtaccgttaaattggttcagtggcgttagacccatgaacaacaagccgttttcttcaaaactaatcacaaaattcttacccgtgaaagcgttgaaggcaccgattacatcttcaagcttgtggttggcttcgatgtaagcaacgttggttgtgtcagcggggtaacccaattcttgtttctttgcggcgatatccgcagcgttaaaagcacttgccatgacgatctcctaaaattttgatgcaattagtttagcataatgcccggtatgactgggttgaaaagggaacttgctgttttggttcgccgatatgtaaaaaatagtgattgtatttgctggcaactctgttacactaatcatgaattaaatattcaccactgggggagccatttggctgagacggtatgaccggaccctttgaacctgttgagttaagacttgcgtagggaagtgatggtagaccgaccagataagactatccaatcgatcaatccgtttctttatacgcgggttggtcgatttttttgtctattctggaggaattatgaacactttactgaccaacatccgtgaacaacaaccgctggtgctaaatgttgcaaattttgtgacgatgcaacacgtcgcggatgcgattaacgtcgtgggcgcttcgcctttgatgaccaacgaaccacaagaagccgctgaattagttggcatttcgtcggcggttgttttaaacattggcacgctatctgaagcgcaatggccactatttttggcagttgggcaagcggctaatcgacaaaataagccagtcattttagatccggttgcggtggggatgccataccgcgcacaatttgtgcgtcgcttgctggcaaatgtgcacgtcgatattatccgaggtaacgctagtgaaattgcgtggttcgcccaggtggaggttgcggggcgcgggattgatacccttgaccagacaacgcaccaacaagaagctgagttagctgctaaaaataccggtgccgtaattgtacaaactggcgtggttgacgtgattaccgatggtgtgaaaacgcagacggtgcataccaactcacctttgttggcaatcaacgttggcgctggcgatatgttgagcggtttgattggtgcgtttgctgccgtgacagatgactactttgcagccggggtcgcagcgactgaattgtttggtcaagctggtgaacgtgcgtctgcacaagtgaatcagttaccgggccacttcatcggggcattgttcaatgaactgtatgcgatgactcaagtggaggtgaccgcacgatgattgatgtgacacaagtactgactgtagcgggtattgattcaagcggtggtgctggcgctaatgctgatttgaaaacattccataatcaaggtgtgtatggcgcctctgtcattaccggtttgacggcgcaaaatacattgggcgtacaaaacatcttgccaacaccgactaattttattagtgatcaattcaaaagtgtcttgagcgacctggatattcgagcattaaaaacaggtgcgttgtttgatgccgaccgggtacatgtcgttgcggacgaaattgcgaggtccgatgtgacagatgtggttgttgatcccgtgatggttgcgaaaggcggcgccaagttgctgactgatgatgccatcgaagcggtaaaaaacgagttgtttccgctagcaacggttgtgacaccgaacttggctgaagcatctgtcttgttgaatcgtgcgattgaaacgatggatgacatgatggttgccgcgtatgacctgcaacaattgggtcctaaaaatgtggtgttaaagggtggtcatttgaaagacagtcactctgatgatgtagcggattacgtggcgtttgccgatggcacaggtcgttggtatcacgcgccacgcatcgagacgcaccgcacgcatggtactggcgatacgttgtcggctttcatcacggcacatcttgcgcaaggtgaaacgttagtcgacatcatgccgcgtgccaaggcgtttatgaacgctgcgattgctgaaaccattgccgttggtcatggccacggtccactgaatcattgggtgacaggatgaataaagaatttttacaacgatattttgttgctggctcacagaactttcctgatttaacattgcctgaatacgaagaacgcattgcactgattatgcaatctggcattacggcttatcagttccgtgaaaagaaccccgcactgtcggctgatgaaaaacaagctttggcgatgcggttgcgggaaaaggcacgtgaattagctgtgccgtttatcgttgatgatgatgtggcattggcaatagcggttgaagcggatggtattcacgttggccaggatgatatgccaattatggatgtcgtggcgcaagttaccgggcagatgattgtggggctatcggttcgcaataaggctgaaatagtcgctgcccagtcggtgatgggaattgattatttgggcgttggaccggtttttgcgaccacaacgaaggctgatgcagccacgccacttggtttagaaggtctcatgacgaccttgaacgctaatgcaaaacagctgccaaccgttgccatcggtggcattacacttgaagacttacccgcattacatcagtcgggtgtcgatggtgttgcggtgatcagtctattgagcgaagcagcagatgttcgtacggtgattgatgagatgaaagaacagtggaggacgctatgacacgtgaagagttgatgccaattcgcgacagtatgatggccacaattatggcagaaccatttgtccaaggtatccggaccggtgtgttatcacaaacgagtcgggattattatgttgcgcaggatcatcattatgtcgatgtgtttatgatgctgttaaatcaaacgaatgcacaattgccattagaactaagacgaaatgttatgcctgagtcagatgagagtgatgcacatttgggtcttgcgccaagtgagcgctaccaccaaattgcagtaggtacgcataatgcgaactatctcaatcatttgcgagagacagtcgcccaaggtgatccactggccagcatgttagcgctattgccgtgcacagaatcatatggtttgattgcacagcgtttgcaacagcaaggtgtcgcatcaaatgggtttaacgactgggtggattactatgcggacgcaacctatcaggcaatcatcgactggagttggcgaacggttgaccaactgtttgcacaaacacaatcggcaacggctgactacgccggcatttacgaaacgtcgtatcagcatgaattggcgttttggcaggcagctaatcagtgacggggactgcctgaagcaagtcatcccacaaaacggtctacagaattcggcggtgggtcaagaattacagatgaacattttggccgggtcaactatgatagtacttgtgagagagtttagttgatgtttgcattctcctaaactgtgatattgtgagtgatgtgagttactcataaaggcgcgcttccattagcgtgccttttttgcatatgcaggtataatgaaggaaagcaaacaaatggaggggaatatgaagacaattgtgattactggtgccagtgatggtatcggggccgctgccgctaaggaattggttagccttgggcatcaagtggtgattgttggacgcaacccagaaaaaaccgcgaaagtcgcgactgaacttggcatgccatatcatttggccgactttacgaagttagcggacgttaagcgtttggcggatgaactacgtcagtatgaccacatcgacgtgctggcaaacaacgccggtggcatcatgggtgaccgcacgttgaccgccgatggatttgaaaagacgttccaagtgaatcatttggcaggtttccttttaacaaatctactattagataagttgctagctgatcatgcgacagttattcaaacatcaagtattgcagcaaacttgtttgtgaagacatttgatgttgctgatgtgaatgttgcccatgactatacgtcagaaaaagcatatggttatgcgaagtacgaaaacatcctattcactcgtgagctacaacgccgctatggtgatcagttaactgccgtcgcattccaccctggtgtagtgcgaactagtttttcttctgaatcaaatacatttatgcgttggctataccgcacgccattgaagtacctaggcacgattagtccagaacgcagtgccaagcgtttggtgaacttggctcttggcgtacctggcactgattttattgctggtgaagtatacgatgggaagaagttgctaccagtcaaagtggcagatgacggtaatgcgaatgcacgtcagttgtgggaagagtctgccaagatggtcgcacggtttacttctatatagaagaaacgaggttatgatgagtaacaagcaaatgattttctggggaccagaactactaaaagtgacggcgctcggtgtgttagatatggcggatggacagttataccgtatggctgagcgccgtttggcatttcgttctacgccaaatgctgtcgtggcgactgctgaaggtgtgacggcagacaacccacaaccattaatcgtcaaagagtttacagtaactgaggaacaagttcatgaaatcaaggcgctactaccagagtttgatgtgattgatgtgatggggatgctagaactacaagcgcatgttacggaagagcatcatgagatgaagcagagctatattgccgattttaaagaaacgtttgaatcagagattggtcaccgtgacttcgcggcttatttacgtgatgccacgtatcgctatgccgattaattgagagatgaggaagagaatggaaaagaagaaccttaaactggggatgacaatactagcagtgttgttatttctagtcgcaattgtcgtgatgtttgtgacgcatagtaaagaagtcacatctggactcgtttttatcggtctcgtaattggctactatgcagcaaaggttaaataaggagagatcggtaagatgtatttcgactttaagatggtagatcttgcggacggcatgcaagaattgcgtattgcgcgtcgtgagggcgtaccaatgacgcagcatacccgcattgcgttatcgcaaaaattagcaaagacattagggtttgactatcgttcactaccgatgttagctgcacctgatgtttcagcctattacgcggtaacatcggaaaaagcatccggtgacttggaagtcattatgcgtaatgcaatggataatgaaccagaagcattcgtcgttgctgattgggaatcatatctagagaatggcgaaggtgagttcggaccgttcttgtttgccatgtttgatgaatggcttcatgtaccagaggcacgtgacttatatcaaatctcaccattagaattcgagaatcagtctagtgggccatgggcattctaccaagcgccgcgcgaagtgacgaagcagatggtggcagataaccgtgacttcgatagtgagctacgccgtcgaatcaaggaaactgtgaacaaagatttgtattacgataagtaagattacggttgtccccgattagggataaccgtttttctgttttatggggcgaatgtgttgacgttttagggtaaataagagtagtatatctaagttgtcttttgggtgtttcgcccacgtccttatcggttaagaaaaagggtgttgacaatatcaaatctcttctgtaatatatattaagttgtttcggatgtatgaagaattcatgaacaagcaatgaaaaagaattgaaattgattgttgacaatcgcatttctcttctgtattatagattaagtcgtcaaggcgacgacgtaggtcattgaaaactgaatatcgtttcgatgaaacaaatgtgtagggtcatcaagctaagctctttccgaccagttagccgcttaaacgtcactccaattttcggggttcagttcatggcaccaaatacggcgccaatggctttttttgagtcgttacttaatccaacggttatccgtagtgaatgccttttgaatgtcttttggcgtttctgcccaagtctttaccccttgtagctcaccacgcatcataatacggccacgttcggccgtgtaatcacacgtgatcaacgtgaccagcttcttaccttcaactgggtaaacccaatcgacatcggttggctgaatcaccttgaagtccactgctttgtagcgataaaccttgttcatatcagtcagataaatgtcttggcccacttttcctttgtagtaaagtggcgagaacagcaaatcacggcctgagtcacctggaataaagtgagaagctaaggcataattgccttcccccatcacttcatcaggaaacatcgtcccagcacctagcgacaagtttaaatcagtcgtaccgtttgaaattggtaccgaaataccaacttccggcacagcgacaaagccaataaaattaatcttgtctgaattcaagcgcgcttgtagcacctgctgcgctgttaaagcgcccactttctgccaatcgtagttcgcctgtttcttttctttctgcccggccttgatcgattgctttgtaacttgtggttcgaatgactttaacgtaaagttggcaatctcgttatgaaaaatcaagcccaacgaaattatcaaaatcagtagtacacccagccatttcagccatgcgaatttcttcttctttttcttttcactcatatcaacgtcacccctcgttaatttactgatatcgtaccaccaaattaataaaaaaatgggcctccgatatgaatatatcggggcccattttacaaacagtcgtgatggttaggcacgcttatttgaggcgttatcattttagaggtcttagacaataataacgtctgtaacatatgagaaatgctaagtatgaactacttaacatatatcattctaccaaaacgactttcacaaagtaagcgttgtcatgtttcaaaatgaaataaaaagccacccaggaatgggtgacttctcgtgtcattattcagcctctgaagcgccaaagttattgatgaagtacaacaacgtttgcaattcgttcgtcaaatcaacgttttgtacgcggacatcactaggcacatccaaacgcaatggcgtgaagttcaaaattccgtgtaccccggccttagccaaacggttagccaattcttgggcaactggtgctgggaccgtcaaaattgccacatcaatgcgttgatcagaaatttgcttctccaaatcgtccatgctgtatacagggacaccagcttgaatcgtgttcacgatatcttcgttaatatcaaaagctgcagaaatgcgggcgtttgagctttggtggaagttaaagttcaacaaagcttgtcccaaattaccgactccgacaagggcaactgatgccaaagtgtcttggttcaaaatttcaccgaagaacgtcatcaatgccttaacgtcgtacccgtaaccacgctttcccaatgcaccaaagtatgagaaatcacgacgaatcgtcgcagcgtcaaacttaacagcatcagacaattcgtttgatgaaacgcgagtcgtccccgcatccaacaaaagcttcaagtaacggtaataaattggcaaacgcttagcggtcgcgcgggggatgtcatgttctgccatgtcaacctacctcattttctaaaaaaattttattttcatgctatttcacaaacaaaaaaacgtttgtgaactctctatccttatttatagtaacacattccctgctctatgtgaactaaataacaatacattttcacaaactaagagcaaaaagaaagaccgctatttccgaaatagcggtctaaatgcctagttttcgccgtttttacgctttggcttacccttatttttactgtgcttacgcttagcttttttctcttttgcgaagcgatctgtacgcgccacaacttcttcagccttcttcttttgggccttacgcacctttgcaaccggacgtggcttatcagccgtttccttgtttgcacctggctctaccgtatgaccagctgaccctgagaatgacgttggcttcgttgcttgactagcaccgttaaccaattgaatatcaacagccaccaaacgacgcaaatcacgcaaatcgtgatcatttccaaatgaaataaccaaaccatgcttgcccatacgacccgtacggccggcacggtgtgtataagtttcaccgttacgtggcaaatcaaagttgataaccgctggcaagtcaggaatatccaaaccacgcgcagccacatcagtcgtcaacaagaactttgccgtgcccttacggaagttttccaatgacttggcgcgcgttgaacttgaatcaccacggaccaatgtcgccattgccacgtgttcgtgcgccaagaaactagccgtcaccttcaattgcttggtcgtgttaaagaacacaatcgcttggaagttcttgcgcgctgccaattggcgcaagcgcttgttgcgttgctcgcgggcagttggccagaattcgtgggcaattgccgttggaattgggacattacgttggtcaatacgcgtaaagtcgcgatcgaacaaaccagccgcgattgtcgtatctacttctgtcgccccaaataaagcaacttgtacatcagggtcgtcaatagcgtcccacacgccgtcaatttgcttagcagtatcttcagtcaacaattcgtctgcttcgtccaaaagtaacgtacgcaaacgcttcaacttcaacttaccgttgtcgaccaattcagcaacacgacctggtgttccaacaatcacttctgggtgcttcttcaaggcatctagttgacgcttcacgttcgcgccaccagtcaaagccaacaccttcaagtccaccaaagttgcccattcacgtacaacacgggtcgtttgcatggccaattcttgtgatggtgccaagattagcaattgttcaccatcccccggtaccaacgttggcaacaatggccacgtaaaggccaaagtctttccagttccagttggtgccaaggcattgattgattcaccagcagccaatggttcagctacggcttcttgaattggcgttagcgtggtaaacccaacactagccaatcgctcttcaaaacgagtatccattttctatcctcattcaatttctttcattgtctttctaattgtaacagaaaagcgccccacaaaacgtgcgacgcttatcattcgttcattttacttatcagctgggaaaacaattcctgcgtcttgacgcaagtttgtcatcacaatgttaacgcgttggctcaatgtcaacaattgacggtattcttcatcgttagcaactggatcattgataatcttcgcgaagacgctcatttcagccaccattgggttaccaaggaattcttcgctcaagactgtgtcgttgccttgaccatccttgtacgtgacttcatgcaactctgcaatgttgtcgatgacaatagtgtcacgcaacccaagaatttcagacgtcaaatagctgttagcacccttaccgaactgcactgtcacatcaaagtcagcataacgcaaaatagcgataccacgaccatcagccccattacgcaatggcgttgcgaagtagtggctttccttcggcataccgaacaaggcaatcgctgcataaagtggataaacacccaagtcggtcaacgcaccggcactaaactcacgcgtcaacacgtttggctcctcacccgccaagtacgcatcaaagcgtgaagagtacttctcatagaccagtgtcgcaccagaaatgtggtccatttcaccaatcttcttcgcaattgccttaaagtttggttggtgaatgtggcgtgcagcctcaaacaaacgcacatttgggtgctcacgaagcaatgaatacaccgcttcgtactccttcgtgtttgaaaaggctgacttttcaacaatcacgtgtaactcgtgttcgatagcttgtacaacttggtcatagtgtaggctgtttggtgaagcgatgtaaaccacttcgataccactgttgtagaaatctgccaaatcagtaaacacagggacatccccgaaatcagcggcaaaggctgccccagtttcagcacggcgtgagtatacggctgctagttcatagtcattagattcatgtgcggcctcaaccagcatcttggtaatccagtttgtaccaattacacctaactttagtgtcatttccatatccctcgtttcctaaaagcgctttcaataatacttttattataccttgcaccaccaaaaaagcccaccaaacagttaaacagtcggcgagcttcttcgggttatcgatttaattttttagtgattagtccttaacgaacacagtgattgattcaatgtgcgtcgtttgtgggaattggtcgattggttgaacaggtccctcaatgtggtaaccgttctccaaaatttgaaccgtgtcacgtgccaaagttgcagggttgcagctaatgtacacgaacttttctggttccataccagttgcggcgtcgatcaattctggcgtcaatcccttacgaggaggatcaacgaagatgacgtctggtcgcataccagcatcgtgccactcaaccatcttctcttcggccttacccaattcgaacttggcattcgtcacaccgttgatgtcggcgttacgcttggcgtcgtcaacggcaccaggtacgatttcgacacccaagacagacttaacgcggtcagcaatcgtcaatgaaatcgttccgatacctgagtaggcgtcgataacttcttcatcaccattcaagccagccttgtcagcagccaattggtacaacgtttccgtcgtttgtgggttaacttggtagaatgagtttggtccgatggcaaacttcttaccgaacaacgtgtccgtgatgacattctttccccaaagggtgttgttcttctcgcccaagataacgtttgtcttttcttggttaacgttttgaatgattgacttaacttcaggcaaagcttcgcgaatttcttcaacaatcatctctgcgcctggcaacttctttgaacgtgttaccaaaacaaccatcatttcgtggctgtagtaaccgcggcgcaccataatgttacggataacaccagtgtgctcaaattcgttgtaggctggaatgtggtacttacgcaaaatatcacggataaccacgatagccttgtcaatttcaggatcttgaatgtagaaatcctcaattggcatcaagttgtgtgaaccacgacggaagaatccagtcgtcaattcaccacgcaattcacgcgtaggaatttgcgccttgttacggtacccagttgggttctccataccaagtgtctcagaaacttcaacatcaacgtgttgcttcttgaacaattcctggatttggttttgcttgaaacgcaattgtgcatcgtacttcaagtgagccaaaggtgcaattcctgtcgtcaacgttgcgacgtcaacatccttgttgcggtcctctgattccttcaacgtcttcacaacacgtccgaatgcgtacgttccagcaaccttcgtaatgccgacacggatttcttcacccggaacagcatttgggacgaaaattgggaaatcatcaaccttaacgactccgttaccttcgtacgttaaatcgatgaccgttgcgtcaaattcttggttcttcaccactggcgctttctttttcatcttaatctccttttgttggccttttcgacgaccatgttacctgtccattgtaacacagttaaattgtaagtttcatgagatgcccgtgagagttttgacaaaaacacccgcgtcatgcagttttgcacgacgcgggtgttgtgttttacatattgcgtaaagcttcgatacgcttttccattggtgggtgcgtggcaaacaagttcgccatcttatccccctttaatgggttcgcgatatacaatgctgaactttctggtgaaacgttggcttctgacatcggctcactttgcgaaatcttcgtaagggcattaatcaacccttgtggattacgcgtcaattcaaccgccccagcgtcagccaaatactcacggttacgtgaaatcgccaattgcaccaacgtggcagccaatggtgccaacatcaggacaagcaatgacacaatcatgccgattgcgttaccgccaccttcacgatcacgactacggttaccaccaaagtaccagaagtgcgttcctaggttggctagcaacgcaattgcagacgtcatcgccacagcaatcgtttgcaaacggatgtcgtagttacgaacgtgggtcatctcgtgagccatgacaccctcaagttcttcacggttcaaacgttgcaagatacccgtagtggctgcaaccgctgcgtgttctggattgtttcctgtcgcaaacgcattcggactcggatcattgatgataaagacacgtggcatcggcacttgcgccaccatcgccatgtcttcaacgatgtgccacaaatcaggtgcctcatcagcgctcttgatttcacgggcatggttcattgacatgacaacgtcagtcgattgcccaaccatgtaaaccgtataaaccaagccgaccacgaaggcaatcacgattccctgttgccagtgcccattcatcaggaaagttcccaatgcagctccgacaacccccataaataggaagaatccaaagaaaagcatcactgttttacgcttgtttttggcaatttggtcaaataacatctgcgtttaaacctcgattacattccttgatcgtcaaatgaaaccttaacaacctgcttctcttcttcaggcgtctccaagaattcgcttggttggaagtggtgaatcccagcgatgatgttcgttgggaaagtttgcaacttggcgttgtagttcgctgtcgttgtgttgaacaattgacgtgagtatgcaatcttgttttccgtgttcgtcaactcatccatcaacttgttgtattgggctgatgccttcaagtctgggtaagcttcggcaaccgcaaagactgacttcaagctcgtcgtcaattggtcagaaatttccatggcttgttggtggtcgccagatggcacttgcgtcaaagcgttacgcaatgacacaaccttctccagcgtaccttgttcgaacttggcataacccttaaccgtttccaacaagttcggaatcaaatcgttacgacgcttcaattgcacatcgatttggctccaagcctcttgtgtgtgcatacgcgccttaaccaagccgttgtagatgctgatccaaatcaaaccaatcacgactacaaccgcgataataatgataattgtcatgtatgttgccccctattaaattgtttttatgacatattttaatgctaatttcattttaccagaaataagttggtatatcaggtaaatcaaatttgggcaaagaaagcttgcgtaaattcatagcggtcttttagccagctcgtgttattacgcgttgggtgtactcggttcgtcaaaacgaccatcccctgcattgtacggtaattcactgccataatcgtgcccgtgaagcccgtttggtacaaccaatccgtgaccacaaccgggttatcttccccaccatacgtccagtagtgccaaccaaacgtgcgaatcccggcctggttgtccttaagataagcgtgcatatcagctggcaaatcttcatccggcatcaaccattcatgcacgaatgacaaagcatcttcagctgtcgcaaacatgccagcgtgtccaccagcaccaccaagcaagtgtgccttaaaatcatcaacctcaccttgcaagacgccaccacggaatggtacgtcttcagttggcacgaaacggtcaagtggcgcatcaaaacggcccttatcagcaacgcgataccctgagttagttaagttcttggatgccaacacattcgccgtcacatcaagtgctagtggcatatcatcaagcgcttcaagtactttacccaacaccatgaagccgacatcagaatacttcgtcactgtaccaggttcgttgattgtgtcgccaatcatcaaatcttcttcgagcatctcacgcgtcaattcaggcaccttacgcacgctacttggcaaaccagaattgtgccaaagcaattgaccaagcgtaatgtcagcgttgccaaaagttggcaaaatatcgtctgcaaattcacccgtgccgacttgtccaactgaggcgatttccttttggttcttgaaattcaccacgccaactgtcgccccgaacaaacggccgtcatcgaccatcttttgggcgatattttctaggcgttcaattaattcttccattttcaatatctcctcaagacgtcattgacttcatgtagtggtagcgaagttgggcaatcgtcacatccccattactttcagggaaataaatcatgcggttcgcgctatcaatgcgtcgtgaccaaccaccatcaaggcctgcttgcagttcaggcttacctgtcccttcaaacggcgtgcggaagacttccttcagaagcttgtttatctttttcgttgtctttggatcttgcgtcaaaaaatattgatagtcatcgaatgcttgttcagtaaaaatcagctttttacccccgcgcataccgtcggctaacttcttagctgctttcatcgtcatcagccgtcacctcatctcttatatataccgttatcatatcatgatgaaatcacgcccactatgaaaaagaccgccacaacccgatgagttgtagcggtcaatcattattattagtctacataagttgcaatcgttgcttggatagcagccaactcttcatcagcagcttgtgccgtagcaccctttgttccaacgtagaacttaatctttggctcagttcctgaaggacgaacggctacccatgaaccgtcagccaaccagtacttcaccacgtttgcctttggcaacgtcattggcgttacggcacccgtagctgtgtccgtctccgtttgcaatgagaagtcttcaaccttggcaaccttaacaccaccaaattcagccggcgtctcagcgcggaacttgttcatcaatgatgcaatcttgtcagcaccgtcgataccagcaaacgtcaatgacttcgtgttttcaacaaagtaaccgtattgctcgaacaattcttgcaaaccgtcgtacaacgtcttacccaatgacttgtagtaagctgctacttcggccaacaaaaccgttgcttgaactgagtccttgtcgcgggcaaatgactttaccaagtaaccgtatgactcttcaaatccgaacaagaatgtgtgctcgttcgtgtcttcgaagtgttggatttgctccgcaatgtacttaaatccagtcaaaacgttaatcgtctcaacaccaaagctcttagcaatatctgctgcgaattctgatgacacgattgacttaaccaacgcaccgtttgctggcaaagtgccggcagccttcttagccgtcaacaagtagttcaacaaaacggcaccgatttggttacccgtcaacaattggtactcacctgatggttggcgaaccgccgttcccatacggtcagcatctgggtcaaccgcaataacaacgtcagccccttgctccttggccaaagcaattcccattgccaaagcttctggatcttcagggtttggcaacttaaccgttgggaagtcgccatttggctcagcttgctcaggcacaatcgtcacgttttcaaaaccagcgttcttcaatgcttgaccagcaatcaaggcacccgttccgtgcaatggtgagtacaccaacttcatgtccttaccaacagtgtcgatcaattcttggttaaccgtaaccgtcttcacttcagccaagtaagcgtcgtcgacatccttgccaatcttaaccaacaagccagcttcgaccaactcagcttcgtccttaactggcacttcgaacatgtcagcttcgcgaattgaggctgtgatgatgtctgattccttaggtggcatttgaccaccatcttcaccgtaaatcttgtaaccgttgtattccttagggttgtgtgatgccgtaatcatgatacctgcgtaggcgttcaagtggcgaaccgtgaatgacaactcaggcgttggacgcaacgtctcaaagacataagccttgatgccgtgcgctcccaaaaccttagcagattcgattgcaaattctggtgagaagtgacgtgaatcgtaagagattgcaacaccacgtcccttaacagcgtcgtccaatgaatccatcaaacgcgccaaaccttcagttgcttggcgaaccgtaaagatgttcatacggttgattccagcacccaaaaggccacgcataccagccgttccgaatgaaagtggttggtaaaatgcgtcttcagcagccttttcgtcagctgccaacttcttcatatcgtcttgcaagttttgtggcaaatcagtacgatctgcccaaatttggtaattttcttgccaagtcataagtctttattctccttttaataagtccccgaacttactactaatgctcattattataccatacgctattttgtgaatttgaaaattatgtgtaaaatcagtgattttcaacattttcacgttcgatgatgactaacttttcaccaccgataatgacggcatccgcaacgttcaaaaacaagccgtgttctacgacgccgatggtttgctccaaataataagctaatgcctgtggatgttcgatgacttcaagatgcaaatcgatgatgtagttgcccgcgtccgttgtcaaacggcgaaatgttggcgccatatcagcggcctcaaaccgcttcaagagttggtgactaccatacggcaccacttcaaccggcaatggaaattggcctaattggtcgtgatacttactttgatcaacaatccagatattacgcttggaatttagcgcgacaatcttttcgaagagcaatgcggcaccaccacctttgataccatccaaattggcatctacttcatcagctccgtcgatggtcaaatcgattgcgggcacttcgtcaactgacttaagtttgattccccaaccctttgctagtgatgatgtttggcgtgatgtggttaccccaacaatatccaatccttcgcggttaattcgctccgctaatttttcaatgaagaacttaacggttgagccagtccccagaccaactatcatgccatctgtgattagcgaagctgcatactcaccagcttggcgtttttgttctgtaattcgatccatgattcatcccccgtctattcaacttcattttacttaaccccacaaaaaaacgccagatagtaactatctggcgcggcagccattaataggctgattttcgttaaaatggcgcttcgtcttgacttaacacatcccagtaatcaaaactggtctctttagttgaaaataccccattttttatatattcaaccgcttgcacaacaatcggtgacgaatttaagtttgaaacagcgtctacgctaataagttcagcaccaaatgaatcttgaccgaaaaattggggaacttcttcagacaattcaccttcaaacgcagtgacctcataaagaacgacgatatgctgattccagtcaaaatcctcaaatatccaaggatacgtaaagctggtaactccaacctgcgaggcatcgcgcacatgcagtccagtttcctccgctacttctcgtataagcgcattctgaagaaactctccaggttctaagcttcccccaggtaaatcatagcgatatttgtatggtccgtctttcttttttacgacaaccagttgttgttgcttaatcaatattccatatacaccaaaagcccgatgaaattttgccattcgcgccccctttttgtcattctggcgttataattattctctaattaaatcgtcatttaattctaactctaaaaaggagaataccagatgaatatttcaattatgcttacctttcatgacgaccaatctctgaatcaactgaggaagcaattcgatcctctatatagcaaagttccaccgcacgtgacactggtttttccacaacatattacgttcgaatctatcgatacgattatttctgaaatcaacaaatatggaactcacctagaaaatttcacaccgattgtttctcattttgaaggtgatttagagtatcacaacatactcgccattttaaaaagagataactccgccattaaggtcttacatgacaagttatacgaaatacctgaatttgccgataaacaacgtctagatatcccttacacaccacatgtgactatcggtagagacctaagcgctgatgaaataagacgaattgtctttaatttatcagatacttggcatccggttgctttaagattcaaaagcattgtttttgaagaaatattacccgacgacagttcaaaaattatttaccaatacactttttaagacatatcaaaaaacgccagatagtaactatctggcgttcgatattgaataattgcaattgtttaaaatgctcggaaacgtgcgcgacgttgcttaacgagttcgtcaggtgcaagtgtttgcaactttgaaatctcatcttgcaacttggcacgaaccaaattgaagacacgtgcatgtgagcgactctctgggacgatgtagtcaataatctcgttcgctaagagatcatttggcgtcaagcccatcaattcggctgcttcagcactgcgcttggcatctttccacaaaatagctgcaaatccttccggagagagaatggaatacgttgcattttggaacatccaaacttggtcagatgtcgctagggccaacgcgccccctgacccaccttcaccgtacacaatggcaatcattggtaccgggtacgtcatactttgcagaatactttgggcgattgcctcaccttgtccttggtcttcagctgacttaccaggaaaagcacctggcgtgttgataaaggtgatgataggacgaccaaacttagccgcttggtccatcaaacgggtagccttacgataaccgtatggctcaggagacccgttgcgctttgccaacttatctttgatgtcggttcccttgtcgatggcaatcaccgtcactggcttaccatcaaggttcgctaggccaccgataacactcgcgtcatcaccagcaaaacgatcaccgtgtagttcaaagaaatcagtgaagataccgtcaataatttcgcgtgctgagaatcgatcctcacgcgactttttcaccacctgcacaggggttaattcacgacgaaatagggctgccatttacttaacctccgctgtttggtgaaaacgcacaagttgtgcgagaattgctgccatttgtggacgttgcacaatcgcatcgataaagccattttccatgactgtctcggcacgttggaactccttcggcaacttttcgtgaatcgtttgctcgatgacacgcttaccagcaaaaccaatcaacgcgtgtggctctgccaatgtaatgtcaccttgcatggcgaatgatgcggttaccccacccattgtagggtccgttagaaccacaatgtatggtaaaccagcatcttggtgcgccgcaactgcgcctgacacctttgccatttgcatcaatgagtgaataccctcttgcatacgcgcaccacctgatgcggtaaacaagatgactggcaacttagctgccgtcgcgtgctcaaacaagcgcgtaattttttcacccgtgattgaacccaatgaccccatgatgaagtaagaatccatgataccaatagcgacgcgttggtcttcaagggtcgctactcccgtcaagactgagtcgcccaattccgtttgttgttgcgcacgttccaacttcgccgcataccctgggaagtctgaatcggccaacttcaaatcagcatctagttcttcaaaatcattcgtcatcaaggccatgcgttcgcgtgcttgcaaacggaaaccataaccacaatttgggcagacacggtggtcacccaattgctttgaatagagttgtgcgccacagtatgggcacgccaagaacaagccatctggaatgcgatcgtttaggttcgcatctcgcttaatcttgggagttgaaaccgtggtgttattaaataaatccatgcctctcctccttaatccgccttaggcagactggcttgccatcgtggcaagaactccttctccaagtaacgtgtgtcgaacatcccacgggcaaccgttggatcgtgcaacaacgccttttggaattcagcgttcgtgctgaccccgtgaacaaccaattcgtccaagatgcgatccatctttgtaactgcatcggcacggttattggcgtgaaccaacaacttaccaatcattgagtcgtagaatggttgaatcttatcaccagcataaatggcagaatcgatacgaataccaggtccacctgttggcaaaaaggcaaaatcaattgtgccggcacttggtgcaaagttctttgctggttgttccgcattcaaacgaacttccaaagcatgtcccttcaaggcaatgtctgcttgtgacacagacaatggctcaccagctgccacttcaatttgcatacgaatcaagtcaacaccggttaccatttcagtaactgggtgctcaacctgaatacgtgtgttcatttccataaagtagaaattgccatcgtggtcttgcaagaattccaacgtcccagtgttctcgtactgcaaagcgttaaccgccttcgttgcgatttcaccaaggttgtcacgcatttcttgcgtgacaccaagcgctggactttcttccattaccttttgattattacgttgcaatgagcagttacgctcagggaagtacaatacattgccgaaacgatcacgcatcacttgcatctcaatgtgacgcacgttctccataaccttttcaacgtacatgtgttgatccccaaacgcagccttcgcttcacgttgggcatcatcgaacttgtctgccaactcatcagctgagtaaacaaaacgcattcccttaccaccgccaccagccgcagcctttagcaatagtggatagcccacgcgatcagccaccgccttggcttctgtagcatcacgaatgaagccttcagaaccaggaataactggtacgccagcagctcgcattgattcacgggcgttggccttgttacccatcagctcaatcaccttagggctcggaccaatccacttcaaaccaaccgcttccgccatttcaacgaacaactcattttcagataagaaaccataacctggatgaattgcttcagcacccgtcaacaacgcggcgctcaagatattcttcatgtttaggtaactatcttttgactttggtcctccaactgaaattgcttcatcggccaacttcacatggaggctatccgcatcagctgaagagtaaattgcgacagatttaatgcccatttccttcagtgtacggatgacacgaacggcgatttcaccgcggttcgcgactaacactttcttgaacattttagtctccaataataaacgtcaaatcagctgttgtagccttcttaccgttaacgtaagcaatacccttaccctcaccgattggtccgcgcaaacgatcaagcgtcacttcaagacgcatttgatcaccaggctttaccatcttacggaaacgggccttcttgataccaccaaagtaagctgtcttacccttgaactcaggcattgacaacaacgccactgcaccagcttgggcaagggcctcaaccgtcaaagcgcctgggaacgttgggttaccagggaagtggccttggaagacctcttcgttgattgtgatgttcttaatcgcaaccgtcttctcaccgggtaccaattcctcaaccgtatccaacatcaacattgggtaacggtgtggcaagatctcttgaatttcttgtgtgtttaatactgacatgtctagacctccttaggcatccaattcgacacggaatagtgcgtgaccgtagtcaacaacatcttcttcctcaaccaaaatttcagtaatgataccagcgacttcactctttaccggtgtcatcaacttcattgcttcaacaatcgcaacttgctcaccaacggcaacgtggtcacccacttgcttaaatggtgctgcatctggatttggcttcaagtaaaccgtaccaaccaacggtgcgtcgattgttacgccttgcttttcttccttatccaatggatgatgctcagcagctgctacaggcgcctctgctgtcgcgacactcgcaacagctggctgtgcaggcgtcgtgacaacaggttgcgcgatttcgttcttgctcaagtgcaagctgaaatcatctgattgcaatgaaaactcacgcaatgaactgttttccaaatcttgcattaaagctcgaatgtcatctaattgcaaacccattaattctcactccacttcttgaaaatgatagcggcgttgtggccaccaaatccgtagttagctgacaaaacgtagttaggggcaacaaacttgttgtcgtcattaaccaacgttacaccagcagtttcaggatcttgttccgtcacaccaacattaactggcaattgctcacgaaccaaagcaccgattgcagcgattgcttcaatggcaccagcggctcccaacaagtgccctgtcatacccttagttgatgaaacaagcacaccgttctttccgaataccaactccattgcctttgattcggcagcatcgttagcaccagtagctgttccgtgcgcgttgacatagtcaatgtcgctagcttcaataccagcgtcttgcaaagccaacttcactgaaccagcaggtcctgatccgtcaggtgttggactcgtcaagtggtaggcatctgagttagccccataaccaaccacttcggcgataatcttggcaccgcgagcttgcgcatgttccaaagattccaaaaccaaaattcctgaaccttcacccatgacgaaaccgtgacggttaacatcaaatggctttgaagcttcaagtgggttgggctcagttgacaaagcagtcaacgcagcaaatcctgagattcccatttcgttaaccgttgcttctgaaccacccgtaaccatcacatcgtacttgcctgattggatacgccagaaggcttcaccaatcgcgttcgtcgcactggcgcacgccgttgacaatgtgtagttaattcccttggcaccgtaacgcattgacacgttacctgacaccatgtttgggatagcgtttggcacgaacattgggctcacacgttgtggtcccttgtcgtgcatcttgataacttgttcttcgatcgtcgtcaaaccaccgattccgttacccatgataacgccgaaacgatccgggttatcaacaccatctgccaaaccagcgttttccaaagcttcaccagctgcgtgaacggcatattgtgagaacaaatccatcttgcgagcttcgcgctttccaacgcgttctgcaggatcgaatcccttcacttcaccggcaactgtgacacccgtctctgtggcgtcaaactttgtaattggggcaataccaacttgactgttaaagattccatccaaaaagtcatttgctgtattaccgacgggtgtaactgcacccaaacctgttacgacaactcgtgtcatgttgttctcctctactttcctaaagcgttagatacgacttatttaaataagttacgaaagaataagtgcatcaagtcgtatctggtttccttagatgtacaatccaccatcgaccgtaattgtttggccagtgatgtaatcgttttgagccaagaacaaggcagtttgtgcgatttcagccgcgtttccaaaacgcttcaaaggcacagcctctaggacttgttccttaaccttgtcagacaaagcatccgtcatgtcagaaacgatcatgccgggcgcgattgcgttaacacgaatgccacgcattgcgccttcctttgccaacgtcttcgtcaagccgacgataccagcctttgacgcagcgtagttagcttgtccaacgttacccatcaatcccaccactgatgcgatgttaatgatgtttcctgaacgggcgcgcaacatcttcttgaagagtggttgcgtcacgttaaacgtaccgttcaagtttgtgttcaccacattggcaaattcgctaggcttcatccccatagccaacttgtcgtcaacgataccagcgttgttaaccaagatgtcgatgccgtctacttcttcaagcaaacctgccaacgcatcgttaacactgttttcatcagcgatatcagccgtaattgccaatgtgtcttcactgaattcagccattacttcaggcttcacggctgaacgtccgtgcaaaataacacgtgcaccagcttcatcgaaagccttggcaattgccaacccaataccacgtgttgatcccgtgatcaacacattctttcctgcaagatccattattgtactgtctcctgttctgcaatcaacatgtcgcgaacttcattaaatgaagcaaggtccttcacgcagtagcgcttaacgtccttaccaacaatcttcttggcaaacttcatcaaggtgtcgcttggaccaaactcaatcaacgtatcaacaccatcatcaaccatcgcttgcaacgcttgggcaaagtaggttggtgacgtgatttgttgcaacaaggttgccttcacgtcgtcaaacttttgacccgtcgtgtttgaataaacagcaaattcaggcgtgttaaacgtttcgtcagttaagcgaactgccaattgatcagcagccgtttgcaacaatggtgtgtggaaagcccctgaaactggcaattcaaccatacgtgagacaccagcttcagttagcgctgccatggcatcattaacatctgcttcaataccaccaatgaccaattggttaaatgtgttgaagttagctggataaacgcgcttgccatctgcttgtagcttttcaagcgttgcaactaccatatcttgttcatccgtcataacggcaaccatcttacctgggttggcatcaccggccgcttgcatgtaagcaccacgatccttgataatgcacatcgcttgttcaaacgtcattgcacctgcagcagtcaatgcactgtattcgcccaaacttaggcccaatgcagcggctggctttggcataacgtctgacaaagcattgtaaatacccatactcattgccaaaatagcaggttgtgtgtacttcgtttgcttgatgttgtcttcactatttacaatagtggccatgacatcatagccaagcaactcactcgcacggtcaattgtttcttgatattcaggtaagtttgcgtacaagtcagctcccatgccaacttgttgggcaccttgaccactcatcaatagtcctagtttcatgttctctcccctgttgtttggttagttcaacaagtcttcggcttgtgaccaaacatcttctagaatttgtgccactggcttaatctcagtaatcattcctgaaatttgaccagccatgaaggcaccgttttccttatcaccatcaagcacagctcggcgaagtgaaccattttcaagttcttcaatcgcatctgcatctggcttaggctttgtgatttcaatacgttcttgtttaacaaagttctttgacatcttcgtcttcaaaacacgagcgcggttacccatcaattcaccggtaaccaacgtatcaatgtcctttgccttgacaacggcattcttgaagttgtcgtgaacttcagattcttccgaagccaagaaacgcgttcccatttgtacacctgaggcacctagcatgaaggccgcagcaacgccgcgaccatctgcaataccaccagctgcgataactggaatcttcaatgcgtcaaccacttgcggtaccaacgtcatcgtcgtcaacataccaatgtgaccacctgactccataccttcagcaacaaccgcatcgacacccttcttttccatcatcttagcaagtccaactgatggaacaactggaattaccaaaatgtcgtggctgtgcaattcttcgataaatggtgatggatcaccagcaccggttgcgacaaccttaacaccttcttcgatgatgacgtcgaagacttcgcgaatgtgacgtgacaacaacatcacgttgacaccgaacggcttatcagtaacttcacgggcacggcgaatttcttcacgtaccttatcagccttccaatatcccgttccgatgatacccaaaccacctgcctcagagacagcacctgcaagatgaccagtccctgcccaggccataccaccttggatgatagggtacttcatgcctaacttttcaaataatggattatttagcttgacgctcattttgcggttccctttctctttgggtctgtgtgattaggcgtttacttgctcagaaaccttgtttaccaagtcttgaacagtttgaatttcttcagcaacagccaacttgatgtcgaagtcgtcttcgatacggttcaacacttcaaacaaatccaatgaatctgcgtcgatgtcttcagtcaagttcgtttcaggcttaacttcgccctcttccaaatcaaattggtctaccaagatttcagttaccttgttcaaaatttctgcttcagtcatgttaatatcctctgttttctttaaaatttaaaagtagtttgaaaattaaaatgtatacgtcatatacaattttagaaaaataaattacaccttgataatcaaggcgccaaccgtcaatccaccaccaaatccggcaattgcgattgtttgtcctgcgtgtaccgtgcctgcttcacgaagttcgtcaagcaagataccgatacttgcagcacttgtgtttccatatgaagccatgttcattgggaacttttcaattggttggccaaaacgcttcgcaatactgctgataatgcgtccgtttgcttggtgcaataggtaaacatcaatatcatcaggtgttaaatcagctttagccaacgcttcatttaagacatttggtacttcgcgggttgcaaagctgtaaacctcacgtccgtccattttgaaatatggatcagccgtcttcaacgtaccggcaaaatgatttgcgttttgctgttgaccagccgttaggaactgtgaacgttcaccaaacgttttcaatgattcagctagcaaaccagttgctgctgttgtgcgttctagtaagacacccgctgcgccatctccgaagagtacggccgttgaacggtcttcccagtccacgagtttgctcaacacttccgccccgataactaagcctcgttcatagcgcgttgagagcaatgaacttgccatactcaacgtataaacgaaacctgaacaagcagcgcttaggtcccaagcgaaagcattgtgcgcaccgattttcccctgcacaatttgtgcaacactcggtgacaatgtatccggtgacatcgtgccaactaagatgaaatctagttgatccgctgtcaaaccagcttgatggaggagtttttctgctaccgtcacagccaaatcactggtatcttcagtgtcgacgatgtgacgttgccgaattccagtacgtgaactaatccattcatcagacgtgtccatgaatgatgctaaatcatcatttgtcacgactcgtgacgggattgctcgcgctgactggacgatggtaaatttttccatgtcgccctctcttagaactggatcaactcgtgaagatattcttgcaaattaatcactgctttacgtacggcagccgcttcatcgtcggatagagagtcaaacaatgagtgggccataccgcggtggaaagcctcgtgtgcacggaaaaccgtacgtcccgagtgcgttagtacaagatggacaacacgtcgatcttcgtcatcacgacgacgctcaacatatcccttcttcactagcttatcgattacgctcgtcatcgcactaggcgtcaagtgcaccatttcggcgacttgtgacgctgtacgtgtctcatacatcgagatggctgcaatcgtatgcatatccttaatcgtgatgtcattaaactttgattcacgcaatgaggcttcctcaatccagacaacgttgttgaaaacgttaactagggcctcattaatctgttcgaacgatgcttcttcactagctgccatacttacttctccgtctcactcttggcgtcagccgcctttttctcgtcaggtgaaacaacaaacatcaattcggcgctagttgctaacttgccatcaaccatagctttgacgtttactgttcccatgttctctctcagattaccgaattctacgtgtaacttcaagacgtcgcctggttttaccatgcgcttgaacttggcattatcaatacccgtcatataagccgtcttaccaacaaattgtggtgatgacaaaatcaagattgatgccgcttgtgcaagtgattcaataatcaacacaccaggcataactgggttccctggaaagtgaccttggaagaattgttcattgattgttacgttcttcgttgcgatcaatgattctcctggtgtcatctcgtccacgtaatccatataaagaattggataacggttgggaatcaaatccatgatttcagtcgtcgttaaaactgccatagtctcactccttccaaaaagtatttcgaacatcaaactattcgatattcaaatcatattttgttttacgcaaaatgtcaacacaatttggaaataaatatacgtataccccgttgactatatgagttacaaatagctaaaacgccttaaaataggcatttaaactagttatatcttattcacgaaattcataaaaacagtaaatttatgcaataacttactttttgtacacaaaaacagggatgatgttcgctgccatcatccctgtttgatctattctactattctgaatccttatgcatcttttccttcaagtcttcaaccgcatcggcagccttttccttgatatcccccattgcatcccgggccttaccagcaaggttttgtgtcttaccttcagcttcgacgcgctcgtttccagtcgctgatccaacaacttcctttgtctttccagctgcttcgtcgtactttcccttaacgtgatctgacattgccatataaatcatccccctttgtttgattgctttaatcataacaaggaagtgtccgcatgccatctgccaaacgggtaagcctagtcagatagacccacgcgcttgaagatatcgtcaacatgcttcaagtgccagttgtagtcaaatgcatcgtcaatctcagccttcgttagtttctcagtgattgttgcgtcagcatccaccaaatcacggaattgaagttgctcatcccatgaacgggccgtcaatggttgcaccgtatcgtaagccgcttcacgagacattccggcatccaccaacttcaacagcaatcgttgtgagtaaatcaaaccgtacgtgcgcttcatattagccaacatcgtctctgggaagacttgcaagttctccaaaatcgctgtcaaacggtgcaacatgtaatccaatactgtcgttgcatcaggcaaaataatacgctcagcacttgagtgtgagatatcacgttcatgccacaacgcaacatcttccatagaagtaactgcataaccacgcaaaacacgtgacaacccgacgatgttctctgaaccaattgggttacgcttgtgtggcattgctgatgatcccttttgaccgcccttaaagccctcttcaacctcatgaatttctgaacgttgcaaaccacgaatctcagtggcaacttcttccaacgtcgtgccgataacggcaatcgtcgtcacgtagtcagcatgcaagtcacgtggcaaaacttgtgagccaattgcttgtggcgttaggccaagttcagccatggctgcctcttcaacagttggtggcacattggcgaatgtaccaactgcacctgacaactttcccgtttcaacagccgctgcgacgcgttcaaaacgctccaaatcgcggacagctgcttggtaaaagcgcgccatcttcaagccaaacgtcgttggttccgcatgaacaccgtgggtacggcccatcattaccgtgtgcttgtacttacgcgccaatgtcgccaaaacgtccttgtaggccgccaagtctgccttaatgacgttgtttgcttggcgtagacgcaatgcttgggcggtgtccacgacgtcagttgacgtcaaaccatagtgaatccacttacgctcatcccccaatgactctgacacattgcgcgtaaaggcaaccatgtcgtgacgcgtcgtttcttcaatctccgcaatgcgatcaacatcgaattttgcatttgcacggattgctgccaaatcttcagccggtacgtgcccctcagctacccagccagccgttacagcaatttctacatctaaccaagattggtattggttctccaatgaccaaatgtggcgcatttcaggtcgtgcatagcgatcaatcatgtttatcccctcgatttaacagtcgtaaaatacgaacaaaacttttataacacatattattgtacattatttccgaattattttacaccatttttccagaaataactaaaaaacacgtaatccaggattacgtgtttcgtgtaatatcttattcagctgaagagctttcttctgatgatgaactagcctcagatgaacttgatgcctctgatgagctagcttctgaagaagaagactttgatgatgccttgtcagacttgtttgtctttgacattgcagcagcttgtgtatacgttgacaaaacgttcttcaagtctgaatccttgatgtttacgtcagccttagccaattcgtttccgattacagcttggaccttcgttgagtctgacatttcttgttcaaccaagatatcagtcatctttgacttcatgtccttgaatggcttcttttcatcacgtgaatccatcttgatgacgaagtaacctgagtaagttgatgacttaactggtgtcttcgtgtactcacccttcttcaaagcaaacgcagctgtcttgaagtcatcttcaagcgttgtgtttgttgagtcgaaggcttccatcttaccgcccttgtccttagtagaagagtcagttgacttctccttggccaagtcagcaaacttcttaccatcatccaattgcttgatgatgtccttggcttcatcttctgaagaaaccaagataactgacacgttcacatcaggtgtgtagctgtcgtaagctgacttcaattccttgttagagaactttgagtttgccttaactgcttccttttccaacgcttgcaagcgcaatgaatcacggaatgtatcttccgtcataccattgttagccaaagctgaggcgaattgtgcaccgtattgcttcttaactgagttgaattgtgagttaactgacttctcagaaaccttatcaccgtagttcttttccaaaaccttctcgatgatcatgttggccaattgttgttgaccagcactcgtgttcttcaacttcttgtaataatcagcttgtgagatgttaccgtcattagttgtggcgattgacttaggaccaacgccccaggctgccaatcccaaagctgccgcaacgacaaccaaaatagctactactttcttccacatggaaaaatgccctctttcaatatttatatatgtgttttagtttaccataccaagctttaagttgcttaaagcacttggtaggtcgcacccatcgcaaagcgcccgttatccaacgtttgctgaatattcatatgttcagcaaagtctgcatcacgataacgaagacgtgctgtcttaatacgccatgataagtccttcagattatcaaccatttcttcgtcggccgtcgtttgtttattcaacatataacgaacgattagtcgaagccacgatacaccggttaccttatcaaggaaggcaatatgcgtaaatggcattggtcgaatatcatccgccgtcacctcatggtccaatggcaaacgatccgtcaccaattgatataagccggccgtatcaagcgtcatctcagggcgtggcaatgattgccacaatgagtccgtcatcgccgattgatcgaagaagataccaccgttatcttgatgaccgaccccaatcacatgcaattcgagcccgtcatagaagtaattcacaatagtttgttgaccatcacttagcatactacttgggaggtacttttctttggcgattacttgaacatttacacccatcttacgcaaactcgtaatcaacttaatgcgattacccggcacaaatacgcgcgttggttgctcaatttcaatgacgttcatcacatcagaaatttccaatggctcataatactgcttgtgcgctagttgcggaatgaacgttaagtcagttggattgttattcatcaagaccgtcttaatcccttggcgagacaattcatcagccaccattgccatggtgtatgacgctgctgccccatccccaagacgaaaggctccggttccaatcaccaacgctgaatcatccccaagccgttcactctcattctccgtttcaaacgttgaatagaattgtgagactgactcttcgaattctccagctgacggttcaaacgccttgtaggttggcaaaataccattatcccaacgataacgacgcactgcctcatacttttcgtcccacaatttggctaccaagccatcagacaacccataatacttggcttgttgcaatgtgtcggtatcccatggatgatccttcacggcattttcaagattattaatgcgctctaacttatagaagtaaaacgcattaatctttgttagctcagctaattcatcaacagtataaccgcgacgaatagcttccagcaaaaccaaaatacggttatcgcgtgggtgaatcaattgctcaataatttcattatcggtcaacgcattcataacagtcggtgagaagttacggttgttaaagtgcgcggcacgaatggccttttccaacgcttcttcaacacttcggcccacaccaatcgtcgctccaaccgatttttgcacagtatccaaacggttctccgtttgaataccagctgactccagttcaccaaaggcaaacactgggaaacgaatgacaatgtggtccattgttggttccaacaaagccgtgtgttccgcataaattgacggtacgcgcaccttatccagcgtctcgcccatcatcaagccagcaataacgggtaccaatggataacccgtggctgccaccagcatagctgaggtacggtcaaagtaaggcgtcaaacgcgtgataacgtactcttcggtcgttgggttaacagcgaaacgcacctccaacaagccgacgacattaaagccacgtgcgacggtaaaggctgcgttacgtagttgttggaatactggatccggcaacgtttgcactggcgtaatcgcaatcgaatcagctgagtgaatccccaccggatccatatcctcgacaccaccaattaacagcgtcgtatcgcgcttatcacgcacaacgaccatggcaatttcctggtaaccacgaatactcttatccacgttaacttggtgggtcaatgaacggttcaacgccgtctcggctgccccttccagttcttccacatcctcaacttgaagacgaatcgtttgcccaactggtgccactgaacggaccaccactggtaaatcaaattcacgtgctgcatcgaatacttcactcacattgcttgccaaacgcgtttgaatggctggcaatttcaacttcgtgaggcgttcttgcaggtacttggtgttttgcgtcgcctgcataacaggcaacgtcattcccaaaacttttggcgcactatcaccaagcaattcaacgatttcagctgacaaacggaccgccgttgagccaccgacactggcaaccatcgcggtaatgccttgttcgacaattaccttaaccagattgggcgccgttagctcagtttcaattactgccacgtcgtcgcgttccgttgtgaagccaaatgggttatcatcgacaattacaatttcatgacctcgtcgacgaagccccttaaccacttgatagcttgctgcatcactttcagtttcacgaccaaaatcattagcagagccaccgataattaagattcgttcactcatgatagccaccctcctcgacgtgcagtcaccatttccataaattcatcaaaagcttgcgttgcttcaatcggtcctggtgctgtatctgggaaaaattgcacactaaatgccggatagtcacggtggcgcaatccttgaataatcccatcggtcatatcaatatgcgtgacaaacatatccgtttcacgcacagagtctggatcaacactgaagccttgcccctgcgtcgcaaacataatgcgatttgtaatctgctcacgaattgggtgattcatgccatggtgttcaactggcatttgttgtagtttggcaccattggcgagcgcaaacaattcgtgccccagaccaataccaaacattggcacacgttgctcaaattggcgaataatatcaaacgtttcatccggaatttgacgtgggtcacccggtcctgatgacaacacgatgccatcgggatctaagttagcaacttcatctgacgtcgcattgtatggcaacaccgtgacgttcgcatcaaagtcactcagcatgcgcaaaataccattcttcaagccgaagtccagcaccaccacattagcgccgcgccccgggttggcataagccttgggtgttgaaacttgtggcacctgacgcgtcgtcaaaaccatcgcccgcaattgatcaaaggcgtggtcatctggcgcatcgacaattgaggctttttgcgtgcctgtcttacgcaaatgacgagccaaagcgcgtgtatcgatttgcgaaataccaggtacgttgtgacgcttcaaataatcgtgcaaactcattgattgcagacgattggttgagatatcagcaacctcgcgcacaaccacacctttaaccgttggcacaattgattcatccgcacggtggttaatgccggccgcgccaatcgttggtgatgtaaacatcacaatctgattatgataaatcgggttagtaataacttcctggtaaccggtcatccccgtgtgaaaaacaatttccccaaaattcgtcgcaggtgatccaaacgcttcgccggcaaaaatcgtgccatcttgcaaaattaaataacgttttgtcatgacgtcgtgcttaccatgtcgttaacatggcaagtcctcctttccgtcctgcgagttaattaacgaatttcaaccgaatcaacaccgtcaacttcttcaacattgacgttgatacgctcagcagccgccgttggaatgttcttaccgacgaaatcggcacgaattggcaactcacggtgaccacggtcaaccaaaacagccaagttaaccactgctggacggccgttatccatcaaagcatccaaagcggcacgaattgtacgacccgtgtacaaaacatcgtcgaccaagataacacgcttgccatcgatattcgtatccaacaccgcctttgtgctacggtccgttgcatcgtcacgataagttgaaatgtctagttcagcaactgggatttctgcattttccaattgttgcaaacgttctgcaatacgttgggcaatataaacaccacgcgtcttaattcccacaatcacgaggttattaatacccttgttcttttcgataatttcgtacgtaatacgtgtcaaagcacgttgcattgccattgcatctacaatttctttagccataatcgaatcccttatctgtttatgtatacaaaaaggcgtcacctaaaaaattaggtaacgccaagtttaaaatcaacatgtctcgttacctcttgcatctctctggatagcattaagaagtaacttcattttagcacgaaaaccgcgtcgtttgggacttagtttgcgtcaatttctgcatatgggtctaattgatccaacatttctgtaaagtacgctggtaatggcgcctcaaacgtcatttcttcacccgtcgttggttgtgtcaaaccaagcgttgccgcgtgcaagtattgaccgttacctggcaacgtcttctttggtccgtacaatggatcaccagccactgggtgaccaatataagccatgtgcacacgaatttggtgcgtacgacccgtttcaagcgttacttgcaatagcgtgtaacccacaaaacgcttcacgaccttaaagtgggtcacggcatcacgaccaccagccacaaccgcttgcttcttacggtcagctgatgagcgacccaatggcgccttgatggttccttcgttttcaatgaattcaccgtgaacaagggcgtagtattggcgcaagttcttcttgtccttcaattgcgctgacaaagcttcgtgtgccttgtcgttcttagcaaccatcaacaaacctgacgtgtccttgtcaatgcggtgcacgataccaggacgaaccaccccgttaatcgttgaaagtggcgtgtggaacatcaacgcgttaaccaatgtacctgattcgtggcccaaagctgggtgcacaaccatcccttgtggcttgttcacaaccaataggtcatcatcttcataaacgatgtccaatgggatgtcttctggcttcaggtcaatctcaactggctcaggaaccgtaaaggtaatctcgtcgccaggctttacgctgtacttggccttcttctcggcaccattcaccttcaatacgccgtcgttaatccagccagtcacttgggtacgtgtataatcttcaaacgcgtcagcaacgaccttatcaagacggccagtctggtctgtgattaccaatgtctcttctgtcataaaaattctctatccttcaatcttctcttgtagagcatgcaacatacgctgccccatcaaaaagctgtattgctcaccgtcatggctaaacataaccgtgtgcttgttaaactgtacaaattccatatccttaaagtggattttctcggtgtgcatcccaataatatgtgggaaacgcaacgcatcatcttccaatgtcacacgtcgacgcagaatggttgcagctgcaacgacgacaaacacgaagaatgaaacatatgtccaaacgttaagggttgtcacctcaagccacattatcatgccgaacaaggcaatcatcaaaatccacgtccacgatacccagcctactaaaccggcgggttggtaaaaacctttcatgtctacgctcctttcgggagttcatgctattttctagtataatgaaattagaggtttttgtcatgttaatcaagttatatgctgatgccgcaacccaaggaaatcctggtccaagcggtgccggcgttgttatctccgccgacggtaagcaaacacagcttcatcacgcactgggtgagatgagtaatcacgaagctgaatttcgagccgctatttttgcctttgagcaattactacccattgcctcgcctgatgacacggtgatgttttacatcgattcaaaattagtagctgacagtattggtaaatcgtatgccaaacattatccggaattaatcgacaccctaatggcgctgattgatcggtacaagattgtattaacaacgtggattcccgatcgtgaaaatcaaggcgcccacaagctggccttgcaagccattcattaataacaaacgcgcgcacccactcggatgcgcgcgttttactttatgatgctttcttaataccgatgcctgtccaggctgacaacaatgagaacactggtgacaacaaggcaaagaagacaaatggtgcgaagttgtgaaccggcacacccagcgtttgtgcagcaaaactacccgccacaccccaaggtaccaagtagtttacaaccgttcctgagtcttccaatgaacgtcccaaggccaaacgtgacaagccaacacgatcaaaagctgacttccaaagttgccctggcaaaatcgttgctaagtattgctcaccaatcataaagttggctgcaattccggtaaagacggtaccagtaatgacaccagccccactcttaatgcgatcagcaatcggtgccataacggcctgcaaaatgcgttgttccgttagcaaaccaccaagagccaaggccaacataataatgatgacagttggcatcatcgctaacatgccaccacgattcaaaagcgcttgtagcatctcattcttagccgtcgtcttgaaaccgttcaacaagatatcacccagcactgctggcgtgtgattaagcaagaagaatgcgcccgtcacggccacgttgattagcaatgttggaatagctggcacctttgcccaggccatccccaccaacaaaaccagcggtacaatcgtccaccaggttggtgacaacaagttagctaagctcgccaactttgcggttgaagcaccggcatgaccgccaccaatcacaaagaaaataatgaatgacacaaccaacgctggaactgtcgtccacatcaaattcttgatatgcgcaaacaaatcagtttctgaaattgatgatgccaaattcgttgagtctgacaatggtgaactcttatcaccaaaaattgcacctgacaacacagcaccggcaaccaacgctggctcaaatcccatcgccgtaccaacacccatcaaggccaccccaaccgttgcaagtgtcgtgaacgctgatccaatcattgaacccacaatcgcggttaccaagactgcacttggcaagaaccaagcggcgttcgcaattttaaagccaatccacagcatcgttggaatgacgtttgtgcccatccacaatgcaatcagcatcccaatcaataggaacaaaaacaatggtgccaaggcagtttgcaaaccactcaacatgtcacgttgaatgtcttcccacgtcgcgcggtgcaactttgcaaagaccatcgtgaccaacaagcttaacgtcaatgggacgtatggtgataacccaagaccaataatgctaccagcaaaaataataatcaaaataacaataagtgctaacgcttgtccaaagcgtggtgttgttcgcttttccatatgtatactcctcgttcgttacaatctagtcagttcaactttcagttatagctgcgataacgaacaagtccgccaacgccacgtgttacatcaaataccccatggtgcaatcctccaaacaaaataaaaaagtcccagtaacctgcaaaaacagattactgggacgaattagcaaaaatccgcggtaccacccaaattagtcgcatacaatcgcatgccactctctttcagactattccgttgtaaatagttcagtcataacacctgcgccactcacagcaaccgtggcttctcttacgtacaatgttatgtcctactgatgtgtctcagtttacggaatagatgagtgcttgtcaacactaaaatgagatttttttaatattcatcggcgataagattatattgcatcgcaatcccaaggttaccattcgctgtacgcaaggcatcaataaaggctttatcgtccatgccttgcttcatgcttagcaaatattgtaactcgaacagtgaccccaattcagtcgttttaatacgcttcagaataaacttttcggtgtattcggtcaaaattgcttccacctcttgcttatcatacaaatcttcaggcaccgttagcttgagcaattgatcagtcgttgcgtgaccaccaaagtccaccatattcattagtagcatggccaatagcaataatgttgcggcaatcacagcatatgcaatgtatcccaaccctgacgccaaaccaatggccatcgtcagtaggacatacgtaatctcagctggatcaccaggcgctgaacggaaacggataattgagaacgcaccggccaatgaaaaggcacgggcaacgttattccccaccagcataataatgaccgcaatcacgactggcaataagaccaatgtgaacgaaaatttttgcggtgacactcgtgaattataagttttcaagtaaaccaaggctgtcacgagtcctaatatcatggccgtcaccatcgcaatgataaacgttggtaatgtgatggcagttccagaactgctcgttgtaaaaattgaattaagcatgtgcaatttccttttgtaaaatatctgtgtaagtctcgtcgctctcttggaagctacgttttagaccacgttcaaatttcgaaaaactcgtgggacgcaactgataatcagctactattcggcgcagaaacgtcggcattcctaactcggttttaatttccatcagcaccattcctgctggtaacaaattctcaccaatcgtttggtttgaaatatttaaatccaatgttgatgtcctgatgtccgtgtcaaacgatattcgtaagtcgctatcgcatgacgtcgcatggagcgcaactcgttcgtaggccaccttaatcactggttgcaattgtttgcgggctaacgctagcacttcacgaccgatttgattgtccggtaattcacctgcaatcaaaaatcgattcgccgtttcataatcgaccgtgatgcgacgcttataggttttcttcaaaaacttctttttaatctccaggaaaactggcttagtcgtagttgctggcccataagatcgcacacgtagtcgttgtttaaattcattgggttctaatcgcaacgcttgctgcgagacggcatctgtcactgatgcataatagagcgattgaatcggatacgattctcccgtttggttataccgatctagtcgcatatcctcagttgcaagtaacgcctgcaaaatagcctcgtactcggcttgagtaatgatatatttcacttcatatcgattgaaaacttgcatattatcaccaatcagccttaacgcatgccaccggctggcccaccaccagccatgccttcagtcaaaccagtaccggccgtcacttcagtcgtcgtaccattcacagtaaccttataagtagcccctgacttgatgtcagttgacgcaacggccaccgtgtcaccatcagcgttaactgtgtagcttgcaatcgtcttgtttgcatcatcgaccactgttaccttatcaccctgcttaacgccacttggcaacttcacataagcattatcaaaagttgcaccagtgcccgttccaccgtagagcatcgtaccgccggtaaaggtcaacgtgccatccaaatcgaccgcctcgttgtctggggatgagttaatcatcgcttctaccgtaccacctgacatcgtgatgtccccgttcgagtcaaggccgtcaccgccagctaggaagaccagcttaccagccgtgatattcaagattggtgtcttgtaactacctgatgcattcaccgcatcatccgtactactaatcgtggtttcaccaccatcgatatcgatttcattggcttgcataccttcatatgaacttgtgaccgcaatcttaccgcctgaaatcactaacttacgttcggctgaaataccgtgattaccatcttctgtacccgtggcgactgtaacgtctccaccggtgatttcaaccaagcccttattttcgtcattgtcttggtttgattcgatcgcatcatccccagccgacacattaaccgtaccgtcagtaatgtgcaccgaatcatgaccaactaaaccgtctttaattgccttggcaaacactgttcctgacttaattttcaaatcgtccttggtatacaccgcatcctttgaatcaccattaatcgcgaccacaccgtcacccttaaaggttaagtcgtgcgttgcataaatggcggctttctcctcgtcggtatcagcaatcgtgccgccgtcaatcaagttaattgaattgttcgctgatgaaataatggtcttatccgcgttcttctcatagatagctgggccagtcgttgatgttagattcacaccgttcataatgatggtgacttcatccttatcaccagcatcaacgacaatttgtgcatcgctcgctgaacctgtcatgtaatacgtaccacccttagaaatcgtgatggtcttatcagacaccttaacgcctgaaccagttaccttcatcttagataagtccaccgtaccatcggccgtcaccttgcttgatgcatcaccggtttgcgctgtggttggataagtcgttacggcaatctttttcgcgctacttgttgatgagcttttagcactagccgtttttgtgacttcgttattagcatcgtcattatctgattgcaacgctgcataacttgcaccacctagcgccagtacaccaaatacaccaatcgtcgcaactacttttttatttttcgtcatagtctttcacctcgataatttgtactattactatgcccggcaaaccttaaacgatcactcaagggagctgatgtcaaacttaaattttgtgaattaaaaaagaccagccattgggctgatccatccaaattaagccgatttaattgtttgaaatacgccaccaattaatagcaaggctgaaataacatagtacccaacaataaaggtcgagcccgtccctgcaatttctaagataccagcgacgatcaaggcaacgatgaccgaccaagtggccaaattcccccacgcccagaacgttttatattttggggtttgggcaatttttggcgtaatggttaccaccaatacttgccaaatcaacaccgctgccggtactaaccatgcccaattcatttttggcgactgtaccccgtgaccaaaatggttgtaaatcaggtggaaaataaagataaatcctgtcacaccgaaccacttaatcgccgtttgatattttgccatgtttcctccttactcactgtagccaaagtacaacatatccgacaccgcacgttcgctagactgaccagacccgcctactggattgttaatcactttgccgttaagcaccatcgttgatgatccgccaccatccaaattgtaggcgtaggttgccccgtgctttttcatcacattcgccaattggtacaaagacaggcctgttgattctgaggttcggccatcagaaaccacaactacgtaatgatttttaccaacctgtccaattgcggtacgtggattagaagcctgtgattgaccaacttcagcgtcctcagagaccgttactttaccgttttcaaccagagttggtccaaaactcagtacctgctgagcaccatttttaagcagttcactcgctgtttcatcgctctgattaactgacttcatattgccatcgctatcaataactaatgcatccgtatcggttgccacagtatcacgatacaatgtgccattacgcacaacatagccagtatcgcggaaaccataataatcaccattaatcgcaaaaatcgcattatgctcgcttgccatcgatgacgttttttcagtgtagtttcggccatatgtattattagccaaggccgtttgcaacaggctcggatcatcaacggttatatcagccacgtataccgtcgtgtcatcaacacgctcagttgtgacgttaatactcatgtgactatcctcataggacgtggccgtctttttgaccgtgcttgaatctttcttcgccgttttcttgacggtttgtgtgctcgtcgcaattgctgtaccactgtgctgtagcataaacgtatcgaccagtgtaaaactcgtataaaccgtcaaaattgcggatgtcactaacgttaacttacgcttcatgcgttctctccattcgtgatttgaaaaccaacttcttttgtactaaatagctgccaacaaatattaaggtgtctaccattattttcaccggcactggatgtggaataaacgtatccactaactgcaataagcccgccgataagaccatttgaaagctgaataatgcgacatagcggcgacgatcaccagtcgtattttgtgacttaaacacccatcgttgattaaggatgaagttaaaaataccagagatgaatcgggccagcactgacgcccctaataaactcattgtggaagcccctttaaacaaggtcagcagcaaaactgcaaacaacgcaatatcaaccatcgccgaactcaatgatgagaaggcaaatttcaaaaagcgtttgtagactaatagggaatcacgaattgggtgaaaatgggtgccttcattgttaccttcgtaaatggtttgaattggcaccaacgttagaccgatgccccgttcttgcaactccagcaacatattcatttcatattcaaatcggtcaccactaatctcgctcatcgctgataatgtgttgcgaggcaaaccacgtaagccggtttgcgtatctggtatgactagccccgttgcaaattgcgtcatcttactggttaatttgttaccccagtaggatttaggcggtacggcacccttttcaaaattgcggacacccaggatcaaatcttcggtaccagcctccagcttttctgcgattcgaatgatgtcagcgatagcgtgctggccgtcagaatcggccgtcacaatgccagctgtgttaggaaatgctgtttggacatacttaatccctgtttttagcgccacacctttaccacgattctggacatgtactagtaccgtggcacctagctcttcgatttgcgcaaagattgtttggtaatggatgcctgatccatcatccaccaccacaactggacgattagtcgctgcctgcagattaatcatcacggtaataaaattttctgttggttcataggccggaatcaaaatcacggctgccgaattattagtttttgtcataaaaattgcctctctttcgattgttggcaatcataatgaaccgacccaaaaccaaactttagcgaagcacaaactaaacataaaggccgtgaatttcttgaatctgcttcaagaaattcacggccttaaaatatcgccttcagttgtttacttaacgttgtaagcttgcaaataacgacgtgtttgcaagtccaaccagtattgtggattcaaatcttcaccggtagcatcacgcaatacttgtgatggcgtctttgatgccccgtattgccatacgtgttccttacgccagtcgaacaatggttgaatatcaccagcttctagcaagccatcgatatccaacgtcttcgccatctcgtgacggaattgagccgcgtacaagtgacccaatgcatatgatgggaagtacccaaagtcgcccccagcccagtgaatatcttgcaggattcctgtcaaatctgacggtggacgaatacccaaatactcttgatacttggcattccacaactcaggtaatgtttcgacatcgatgtcatcattgaagattgccttctcgatttcatagcggatgatgatgtgcaatggatatgtcaatggatcagcttccgtacgaatcaagctggcttgcgtcttcatccagcccttgtagaatgtttcaaaatctacatcatctaggacaccgtggaatgctgcttgcataattgggtaatcatgacgcaaaaaggcttccgaacggccaataaccacttcattgaagagtgactgtgactcgtgaatgctcatcgcaatcgctttgttaaatggggtgtaatcccactttggcgccacgttttgcgcaaacaacccgtgccccgcttcgtgcagaatgcccaacacggccatttggaaatcgtcggttgcccaacgcgtcgtaatacgagcatcattgcggttcaagtcttgcataaatgggtgaatcgtatcgtccaaacgtcccttgtttggatcgtagcccaagcgaactgcggcatcccaaacgtacccacgttgatcagcaatcgccacatcacggtgaaggaaactgtcatctggttcagttccttcatttgccaaacgattacgcaaagccactacacccgccttcacttcattaaagactgcgtccaacttttcaaccgtcaagccaggctcaaattggttcaacaacacatcatatggtgtggcctcatccttgcgccagtacgtaataaacttgcgcttcaacgcaatcaattgttggaggtatggtgcgtaaatgctgtaatcatcttgctcacgagcctctgaccacgcgtcttgcgctgatgaactcaacttgttaaacgcaatgtactcgtcagccggcacaaccgcatcacgctcataatcttccttgaacttcgcaaacaaagcttgttcatcgtcagaaagttctgaagcatgttcgtcaaagtaagccaccaacgctttggcttggtcaccagttgaaacacccaaatacttttccgttagataactttgtagttccgcacggaattcacctgaatccttgggcatccccgttagttgatcccagctggccaaagccattgtttcttccaacaaggcttgttctttcaatagcgcgcgtaaatccgcacctgtgtatgagtccgtcatctcataacctccgtttttagtcgttcctttattctaatcgaattttaatacaaaaacaaaccagaaaaaaactcaccgacacgagtcagtgagttcaatcatttttaaaatttcatgccgtacttcttgtggctgtaccaaccgtaaccaatcgtccaggcgataccaccaaaggccgcaatcatgtctgtcttgtccaagaacaaggttccgaagatgaacaagaagaatgcaagcgtcaatggactagcaatcttgtagaatggcatcttgaagccatcttcaatgtagtctgcactagcgcgatacttgcggtgggccaacataatcaagctgtagataaccaacgtaatcgccgccgtagctgatgcgaagaagttaaaggctgattcaaagattggcaatgcgttgatgattggcgtcaacataatcaagatagctgagaacaataccgcacgtgatgggattgctttcattgatagtaccttgaagtatgattgccactttcctgtattttccaaagccaaagcgtaaacgtctcgcccagctgagtaaatcaacgtattcaaggctgacatcgctgctgtcaaaaccacgaagttcaacaacgctgctgcccagtgaataccaatcaacttaaagataaacacgaatgggctttggtttgatggcaagtaatgccaatcataaattgacatgataattgccaaggcacccacgtagaaaatcaagatacggaatagcaccgtgttgataacctttggcatcacctcgcgtgggttctttgtttccgctgacatcaaaccaacgaattcaattccaacgaatgcgaagaagaccattgggaatgcttgcatgaagctcatccccccgtttgggaagaacttgaagttatgcgtgatattcccgaatgaaactgggccaccgtgtgcacctggtgcattgaacccagttagcatcataataattcccgttgcgataatgcctaggatggcaataattttgattgatgagaaccaaaactctgcttcaccgaagaaattaactgcaaacaagttaaccccgaccagcaagatcatcacgataatttcgattaaccaagctggtacatttggtaaccagtattgcacgtataacccaatggccgtcaactccgccatagctggcaaaatcagtgtaatccagtatgaccaacccacgaagtgcccagccccaggacctaagtactttgacacaaaggccacgaatgaattgttgtccggatcggcgtaaagcaactcaccaatggcacgcatcatgatatataggaagattcctgttagtaagtaaacaaataggattgatggtcctgtcagactgattgagtctccggctcccaagaacaaccctgttccaatcgttccaccaatcgcaatcatcgtcacgtgacgctttgataacccacgatttagtgaatcaggcgcggcgtttttgtctgccatgcgctgcccctcctctgaataaatttgctatgatatacaaatttattttctcttttattctctttttattcatcagccaaaaggcaaacccttaatagcaacgagtaatatcatagcacaccagtgtatttttttgcactcttttttgaatattcgtacatgtttttgcggtatatgcattgtgaggtgtatatattcaaaagaaacattcaacgcttggttcgttttaaacgataaaaaccatccaaccgtgaagttggatggtttctttattagtgttgtggattgtagttaacgactgaaccatcttcattgataacttgaccgttgtggttttgatcatcaaagaagaatgacaaaatcagttcagcagcattttctgtcgtacgaacgaagtcaccttgaatgtggccgttcaagtcagtagaaacagcccctggcatcacggcaaaaatctcaacaggcatcccttgttgctcgaactcaagaccaaagtccttcgtcatcacattaagcggtgccttagcagccatgtatccaagtgggtgccaccacttacctggctcaattggcgttgaaacgttaataatcgttccattattcttttgtagtactggcaaaagccccttcgtcaactcgtatggtccgatgaagtcgaccttatagatatcaagcaactcttgtgcttcaaactcccatgccgtacgttccatatcacctgaaataccggcattgttaatcaacaagtccaacccgtcgtagttcgcgttaatgtttgctactgcttcatggatgctatccaagttagcaacatcaaccaacaacaattctgcattaccaaatgcttgcaagtcgctcacagcagctgcaccacgctcggcgtcacgtgcgccgaccaatacggtgtagcccttttgtagcaattgcgttgcaatcgcataaccgattcccttgtttgcaccagtaaccaaagctgtcttagccattaataattttccttctttctttaaagctccattattatatagccacgactgacaaaaagtaaggtcttgaaattattaaaaaacctgctctgactggcctaattaatcgtcggttttcctcttatcgacgcccgatttgcccacgcactagcgcgtcatcatatgattttgccaagttcattggaatcgtcattaggaactcagccatatcagatagattaacacccaccataacaacacgacgtttgcggctttgcaaacggtgctcaacaaccgtgtaaagcatttgttcgtcgtgtgtgcgtggtgcaagttgaattgctgacgtggttgtaatcaatgcaatccgttcttccccatcatctaggtcgttaaagtagctagctgtctcagttaaatcaaccggcaccttgaaacgcaattccaattcatccccattgtacgagacttgcaccgtgtgcaactcaaacaccccagtgccgtctaaatcatcatttaattcgtcgaccagcggacgaatctcagtcatcaattcacgattgaaaaacttctcagcgctttcagtcgtaccttgtccactcatttggtagcccacatagggatcttcgtgctctgtcaaaatgttatcgacgacgtgattaatgtcaaacttcatatttattctctttcttaacttataaagcaacaatgtttggttcaaagcccatttcttgtacgaatttcataacatcgccagttttgataaaccatgtttgtgtattgtcattgggatgaaaaacgagcgtttccgtcgaaactatctgttcatcaaaatagacacgaacatcatgatcaacattattcagtaacccaaagatagaaacactccccggcgttacgccaagcttgatctttaatcgttctggtgacgccatgctaagacgtgtcgactggactgttgattggaatttcttcaaatccagtcgcacattatcggacataacgactaagtagtactcggtcttattgctgttattaatgagcagcgtctttgtgcgcgttcccacatatccggcaatcaatttatcagcttcttcagtggtgaaaactggcggatgttcaacacttgtgtaaccaatacctaacgatttaagcttctgagcaacttgttcaattggcgtcatattggattcctttagttttggcttgagatgattagttagttggatttttaattatccctattatacagttccccgtcattaagtagtaaatacaaaaaaacacccaaccaaggttgagtgttttttcagtattgaatagcttaaaattaagccaaaccgtacttcttgttgaacttgtcgaccgcaccatcggcagtagtaaacttttgcttaccagtgtagaatgggtgtgaatctgacgtaacttcaacacggatcattgggtacgtagcaccttcgaactcgatcgtctcgtttgaagtacgagttgaaccagtcaaaagcttgtaaccagtagttgaatcaacgaaaaccacttggtggtaatctgggtgaatatcagccttcatcgtgtttctccttatcgccctagtacattgcgtaccagagtcagtttatttaacctgaatataataccataacttcgaaaagaatggtagtctctcaaccaaagaaatttgcagaatattcacaattagtgattagcgccctttgcgaattctgtatcatcttcagccttaagcacagccataaaggcttcttgtggcacatcaaccgtaccaaccgccttcatgcgcttctttccacgcttttgcttatccaacaacttggcacgacggtcagggtcacctgtgtgaatctttgaggtaacgtccttacggtatgccttaatcgttgaacgtgacacaatctttgaaccgattgccgcttgcactggaatttcaaagttacgacgtgggatgatttgcttcaacttagccgtaataatgcgtgaacgctcttgggcgaagtccttgtgcacgataaagctcaaggcatcgaccttatcaccgttcaacaagatatcaatcttaaccaagtcagacttgcggtaacctgaaatctcgtaatccaatgaggcgtaaccacgcgtgtttgacttcaacttatcgaagaagtcaaagatgatttctgacaatggaatgtagtacttcacgttaacacggttttggtccaagtaatccatcgtatcgaattcaccacgcttttgttgcgccaattccataaccgccccaacatattcgttaggtaccatgatttgtgcgtgtacgtatggttcttcaatccacttgatggcactggcttcaggcaactctgatgggttggccacttcaaccatttcaccgtctgtcgtgtacgcgtggtacgttacagatggcgccgtcgtgatcaattccatatcgaattcacgttcaagacgctcttgcacaacgtccatgtgcaacaagcccaagaatccagtacggaaaccgaatcccaacgcttgtgacgtttcaggctcaaattccaatgacgcatcgttcaattgcaacttttcaagcgcttcacgcaagtcgttgtactttgagttatccgttgggtacaaacctgagtacaccattggcgtcattggttggtaacctggcaatgcttcagccgctgggttcttaactgatgtaatcgtatcaccagggcgtgcgtcacgaatgttcttaattgaagcagcgacataaccaatatcaccagccatcaagaagtcacgcttcacagggtgtggtgagttaacaccaacttctgtgatttcgtattcagcacctgagttcatgaagcgaatcttatcacctggcttcataaccccttccttcacacgaacggtcaaaataacacccttgtatgaatcgtaggctgagtcaaaaatcaacgcttgcaatggggcttccaagtcaccctctggcgctggaatcttggccacaatttgctcaagcaattccggaataccaataccttgcttagctgatgccaaaacggcttcagatgcatcaataccaatcacatcttcgatttcagcacggacagcctctggatcagcggctggtaagtcaatcttgttgatcaatggcaagatttccaaatcattttccagcgccaagtaaacgtttgccaacgtttgggcttcaacaccttgggcggcgtcaacaaccaaaatcgcaccatcagccgcggccaatgaacgagatacttcataagagaagtcgacgtgacctggtgtatcaaccaagtggaagatgtacgtctcgccgtcgttcgccttgtagtgaacttcaaccgcgttcatcttaatcgtgataccacgctcacgttccaaatccatcgtgtcgagcaattgattttgcatctcacgctcagtaaccgtgtgcgtcgcttccagaatacgatctgaaattgtcgacttaccgtggtcaatgtgagccacaatactaaagttacgaatgtgagattggcgcgccttcatttcttgaatgtccattatttatcgcgctcctattctgtcaaatttttctgtccctaccattatacagggtatttcggtgcctgacgatagcaaaaagagaccaatccgcctagattagcccctttcaccttacttcttggtcacgtccttgaattcgccttccaagacttgtgccttgttgcgcatttcatggtcgtgacgtgctttacgtgattgcgtgtaaacaaacaatccgaccagaatcaaaataatcaaaaaccacatacttgttctcctagtgtgttacggtccaattcaacattttttgaacatgggcaacatcgggatcatctgagccaccaaacaatgtttcacccgtattcatggtagcaatttgcgccatttcatcagtcgttagttcaaaatcaaatacatccaaattcgatgccattcgtgccggcctcattgactttggaatcgtgctgatacctcgttgtagtagccaacgcaaaattacgtgaccaacttctttgccgtggtgctcagcaatcttagtcaaaattggtgaatggaacacatcatgcattccctccgcaaacggtgcccacgcttcaaccaagataccttgttcttggaagtacgccaccttgtctgcttgttggtggaaaggatggttttcaatttggttaaccattggcgcgatgtcgtttaatgccacaaattgcgtcatcaatgctggtgaaaaattcgatacaccaattgcacgaatacgaccagctttgtatgcctcttccaatgcacgccaagcgccccagatatcgccaattgggtggtgcaacaacaccaaatccaagtagtcagttcctagtaattccaatgagcgtgaaacagaagcctttgcgccctcgtagctcatgtcttgtacccaaaccttagttgtcaaaaacaagtcacgacggtcgacatcactctcagcaattgcgcgaccgatatcaccttcattgtcataaatcacagccgtatcgatcatacgatagccgttcgcaatggcatccttgactgcttgggtagcttcagcgccttggacttgcgcaacaccgtacccaagtaccggcatcttcaccccatttgctaatgttcgaaactccattttcattgcctcgttatcttatccgttaataccctgtattatacgcttctgtaatgaaaaaacacggcaaaattgccgtgtttttgtttacaagattggtgtcagcaaacgtgagaacatttgcttaaacttgcgccatcctgactggttatcgaagtattgacgggtcaaacgtgttgaaactcgcaaatctttttcgaaaatctgattcatttcagcagccaaacgacgactgtacataaaggcattcacttcaaagttcaaagcgaatgaacgaatatccatgttggcactaccgactgacacaatcttatcgtcaatcactaacgtcttagcatgcaagaagcccttgtcatacgtataaacttcggcccctgctcgaaccatcgcacgtgcgtagtattctgtcgcacgataaacaaacggatgatccggcatacttggaatcatgatgcgcaccttaacccctgaacgcgcagccacagatagcacatccataatcgcttggttcggaataaagtacggtgattgaatcgtgatactttcacgggcaatcgccagcatgtgcaagtagccttgataaatttgcttcgagtccgactccggtcccgatgagacaatctgcatcgcgacatccccagcctgtgtgttgtctgggaagtaatcatcactgaactgcagtttttcttcagtggtcgtcgcattccaatccatgaagaagcgactttgcattgccaacactgcatcaccttcaacacgcaaatgcgtatcacgccagtagccgaacttctttttcttgcccaagtattgatcaccaacgttaaagccgccaatgtaaccaatattaccgtcgataatcactaacttacggtgatcgtgattattcacacggaatgaaaagggctgccaatcatgaatcaagaacgtttcaatttggccacccgcttcacgcaagcgcttaaacatcttcttgtgacggccacctgaaccccacatgtcataaatgacacgaacgcgcacaccttcagctgctttcttcgtcaacaaatcaaccaattgattaccgatttcatcgtcataaatcgtgtagtactcaacatttacgtgatgcttggcttgttcgatatccgcaaacaattgggcaaacttctctttaccatccgtgatgaccgatacgtgattttcatttgtgaaaattgcttgctcattattcaagaacaggcgaacaaatgcctgttcttcttgataatcagccgtggcaatgtgcgccatttgcttcttttgcttcttcgcaatgcggtcaatgcccatgacgcgttgcgttcgaatatcaaaaatgcgcttatttgatagcttacgtccaaagaaaaaataaaatgcgaacccaaaaactgggaacaacaacagcaccagcatccaagcccataccgtcgtgatgtcacggtttcgatcacggaaaaccgtgacaatcgctcctagcgtattcgcaatcaacaagacgattagcgcaatatttatccaatgttctatcattgctaatccccactttcctaccaactcataatcgtacgtctattgtagcagtaccctgaatgaaaaaaccagtgcagtcacgcactggttacattttcatctaaatcttaacaagaagttagccaacattttcggcaaattgtgaattatacaactttgcataggcgccattcgcagctaacaactcatcgtgcttaccacgttcaacgatattaccatgctccatgaccaaaatttgatccgcatagcgaatcgttgatagacggtgtgccacaacgaaactggtacggccagccatcaaacgggccattgcatcttgaatcatccgttcagtacgcgtatcaaccgaacttgttgcttcatctaaaatcaaaatttcaggatctgccacaaaggcacgcgcgattgttagcaattgacgctgtccctgcgagatattggttgcttcttcattcagcaccgtatcatagccatccggtagcgtcttaatgaagtcgtccgcgtgggccatcttcgccgcttcatagatgaaatcatccgtcgcatccaaacgaccataccgcaaattatccataatcgttcctgagaacagccatgtttcttggagcaccatcgcaaagtgatgacgcaaagactggcgactcattgacttcgtatctaagccacgcaaacgaattgtccctgacgttgtgtcataaaaacgttccaacaggttaatcatcgtcgacttacctgccccggtcggcccaacaatcgcaaccatctcacccggcttcaccgacatattataatcggtcatcagtggctgatcaggcacataactaaaggccacattttcaaaggtcaccaagtcatccgtttcaatcggttcgactggttctggattatccatctctggctcatccagcacttcaaaaatacgctcagctgaggccacagtcgcttgaatcgtattcgttaagttagcaatctgggtgattggctgactaaactgattcgtgtactgcaacatcgcttggacatcacccaagctaaccgtacctgacgccaccttaatgccaccaattacggccatcgcgaggtaatccaagttattaacgaaacgcattgatgggaaaatcaatgttgaaacgaactgggccttccaagctgacttgtaatacgtttcattttgcgcatcaaaatcaaccatgacgttcttctcttggttaaacgtcttcacgacggtgtgggcggcaaacgtttcttcaacttggtcattcagtagaccaagcgacgcctgctgacgggcaaagaaacgctgtgacaacggcgcaattgttcgcacaatcaacaatgaaattgggactgtcgcaaaggcgaccaatgacaattgccagctaattgtcagcataaagtagataaccccaacgaacgttaaagctgatgtcaccaactgaatcaatgactgatttagtgttcctgagatattatccatatcgttaacaacacgcgacatgatgtcaccgttttggtgagtatcataatacgacaccggcaacttcgtcattttcactttgaaatcttggcgcaattgatagaccgtgcgttgcgcaatccgggtcataatccattgctgtgtgattgagaaaatggcactcaagacatacaaaatcgacacgaataccaaaatctggaataccttatccatgttaatgtgaattccggtatgcattttcaccgatcgtgtcacgtcattaaagataactgttgtcgcttcacccaaaacctttggcgcacgaactgacaacacaactgataccgctgcaataatcagtgaaaagatgaccccagcccgatccttacgcaagtacttaaacaagcgaatcacagtcggccagaagttcactgccttttcaacggggcgtcccatgccgccacggccaccaccgcgaccgccactagtataactacgcatcgacacccacctccttcaaatctgcttcagacaattggcttcgcatgatttcttgatatgcggggcaagtcttagccaactcttcgtgcgaaccaacgccggccaattcaccattgtctagcaccacgatgacgtcggcattcataaccgtcgcaattcgttgagcaacaattaccttgattgccggtgccaaacgttcgtcagcattaatagcagctcgcaaacgtgcatccgtggcaaagtctagcgctgagaacgaatcatcaaacacatataccttggcgtctttaatcaaagtacgggcaatcgccaaccgttgacgctgacctcctgagaagttagccccgccttgctcaaccgtcatatccaagccaccttgctcttgaataaaatcatctgcttgtgcaattttcagagcatcccaaatttgttcgtccgtcgcatatggcatcccgaacgtcatgtttgagcggaccgttccagtgaacaatgtcgctttctgctgggtaattgacaccgcctcgtgcaaatcatgttgggaaagctttttgacatcaacccctgatagttcaacgtgaccaccggttgcatcaagcaaacgcggaatcaaattaactaacgtcgactttcctgaaccggttccaccgataatcgccattgtttggcccgtggttgcctgcgcagtgatatgactcaaagcggggcgttcggcaccttcaaaacgatatgacacatcgttaaatgtcaatgatgctggtccatcaggcaatgccaccgtttgatcagcatccgtaatcgtgtcggctgagtccaatacttcattaatacggtccgctgacgcttgggcacgtggcaccatgacaatcaccattgatagctgcatgaaactcatcaaaatttgagtcgcatacgtcaaaaatgccaccaagtttcccattggcatcagatcagcgccaatcagcttggcacctaaccacacaatcccaacgttggtgaatgacaaaatgattgtcatcactggcatcatcatcgctactgttgtgaagacgacacgcgccgtgtgcgtcaagtcatagttggcctctttaaacttatcaacctcgtagttatcacgatcaaacgcacgaataacacgcacacctgtcagtccctgctggaaaatcagattgattttatcaaccttcttttgcatcgtcttaaaacgaggcactgaaatgcgcatattgataaacacagcgagtgccaaaacaggcaatgcgaccgcgaagaccatcgttaaacggtggtccaaacgccaggccatgatggatgcccccacaaacaaaagtggtgacatcagcatcatacgtaagacagtttggaacacgttctgaatttgcgtgacgtcattcgtcgttcgcgtaatcaacgttgcatttccaaacttatcaacgtttttcgcatccataaacgtgaccttgcggaataacgcactacgcaacttcatccccaaacgctgactctgagtcgccgcaaagaacacattcaaagcagcacccgaccagccggcaatggcaatcaacaacatgatgccacccatacgccagatatagtcaatatcgttttgggcaattcctttattaataatgttcgacgtaattgtcggcaaagacaaatccgccgatacttgaaccattaaaaacaacaccgccagtatgactggaatgggttgtaaatatcgttttcctattcgaaacataatcattcctcacgttctgttagacaccgttagtttactcgcctttttcggataataaaagaaaaagctcatggacgcaccatgagctttgattatgtttacttgttctgaccaacaaactcccagaagagctcgcttgcctttgaatgttgtgctgtattcttacgcataaaggctaattgactcacatcattgaggttaatcggacgcttgatgatatcaggattagctgacatatcgacactcttttccatcatgattgagacacccataccgttcgcgatcatatttaagatgatatcgatacgttgcccttcatacgccacctttggctcaaacccagcggtacgggccatcgtcatgacgcgattataaatcgtcgtctcacgcccaagcaacaagaattcttcatcttgtaaatcgctaattttaacctgtgtcgcatcagccaaaggatggtcttttggtacaacgcaaacgaactgatccttatctgtgacgatggtttcgtacttctcattaatatcaccgaagtcacgcccaaacaccacatctgccttaccattgtccaacgactgagtaataacgccgtgatcaacttcagataggtgcagtgatatttcgggatacttatgatgaaatgcggcgattaactcaaacccacggtaattagaaactgatggaatcgcatgaatcgttagtgtattctccgattctgccgcgtgctgattaagtgtgcgcaacatcgcatcatattcggacataattttagctgcataaatagcggtaatgcccccggcctccgttaacttgatggttcggtgactacgctcaaacagcttcgtatccaattccttttctagcgctaagatttgttttgagatgttaccttgcgtcgtgaataaacgttcggcagtctcggtatagcttagcgttttcgccaaatctaaaaatacctcaaacttatggatatccataatacgtcctcttaaatattactctttggaatagtttatcacatttttggatttgttgcgtttacttatcaagcgtaagatagaaatatcgcgttttatggaggtaagagagaatatgaatatgcctattggtattattattaatgctttgtccgttttagcgggcggtatcgtcggtggccttttcggtaaccgcatttcagacaagtttaaaaatgaaattaacatgattttcggcgtcgcttcaatgacaatgggtgtcatcgccattgcgccaactaagaacatggcgccagtcatctttgctttgattcttgggacatcacttgggttgattttccacgttggtcagctggttaaccgtggtgctgggtttatgcaacgtcaaattgctcgtgtgattccaatgaaatcaagtatgcctgaggatgaattcatggcaaccttgttgacagttatcgtcctattcaccgcctcaggaactggtatctatggttctttggttaacggtatgactggtgatgcgacaattttgatttctaagtcaattttggatttcttcacggcaacgatttttgcggccaaccttggctttgtggtctcagtaatcgccgtaccacaatttattttcttctttattctattcttgctagctgggttcatttacccactaacgaacccagccatgattacggactttaaggccgttggtggtgtgctaatgctcgccacgggattccgtatgattaaagttaagatgttcccaactgcagatatgattccttcaatgatcatcgtcatgccacttagctggctatggatgacctacattctacctgtattaacccactaaacacaaaaaccgcttaatccacaagctgtgaattaagcggttttattattcaactaattacttttcagaaatagctgcgatacctggcaaagtcttaccttccaagtactccaatgaagcaccaccaccagttgagatgtggctcaattggtcagcaacaccaagttgttgaacagcggcagttgagtcaccaccaccaacgatagtcgttgcaccgttctccttagttaccttaaccaattcttcaccgatagccaaagttcccttagcaaagttaggcatttcgaacacacccataggtccgttccaaacaacagtctttgcgtctgacaaaactgacttgaacaattcgattgacttaggaccagcatcaagacccatgtaaccgtccttgataccatcttcagcaatgtacgtgtcagcatcgttagcaaacttgtcagctgctacggcgtcaacaggcaataccaacttgtcgccagcttcttcgatcaattgcttagccaaggcaaccttgtcttcttcgaacaatgagttaccgatagccttaccgttagctgcgtcgaacgtaaatgccattccaccaccaacgataaccttgtcagccttcttcaacaagttctcgataatcgtgatcttgtctgaaaccttagcaccaccgatgatagcaacgaatggacgctctgggttttcaacggcaccacccaagaacttgatttccttttccatcaagaatccagcagccgtttgtgcgatgtttgaagcgataccaacgtttgaagcgtgggcacggtgagccgtaccgaaggcatcgttaacaaagacgtcacccaatgaagcccagtacttaccaagctcaggatcgttctttgactcgcgcttaacttcttcaccgttaacaacgtcttcgaaacgcgtgttctcgaagatcaaaacttgaccatcttccaaaccagcgattgcgtcttccaattccttaccttcagtagcaggaacgaaagtaacaggttgacccaacaagtcagccaaacgttgtgcaacaggcttcattgacaagcccttcttgtcatcttcactcttgatacgtcccaagtgtgagaacaagatagcgcgtccgccgttatccaaaacgtacttaatagttggcaatgcagccacgatacggttgtcgtttgagacaacaacttcaccgttctcttccttcaaaggaacgttaaagtcaacacgcatcaaaaccttcttacccttcaattccaagtcttcaacagtcaacttagccattgcaaaagtccttctttctgtgtgtgattgcttttaataaaaatcaataactatattatatcaaaaaacaggtggttcagaatgtctaaaccacctgtttttactctatctactagaaactagcaattagagagttgccaagtgcaacaacgtacggatcatgtttgaagtgaaaccgtattcgttgtcgtaccatgcagcagtttgaaccaattgcttgtcaccaacagtgatgaccttagtcaaagttgggtcaaatacagcaccgtgcgtgtcgccgatgatgtctgatgaaacgatttcgtcttcgtttacaccaaatgagtcgttgacatacttcttaacagcgttgttaacttcttcggcagttacagtctttgacaatacagtcgtcaactcagtaacagaaccgtcaacaacaccaacacgttgtgcgtgaccgtccaacttaccagcaacagaaggaacaaccaaaccgatagccttagcggcaccagttgagtgaggaatcgtgtttgctgaagcagtacggtttgaacggaactttgatcccttaggaccgtccaagatcatttgcgttgaagtgaaggcgtgaaccgtcgtcatcaaaccgatctcgataccaaattccttgtccaatgcgttagccaatggagccaatgattgcgtcgtgcatgaaccagctgatacgatgtgatcatctgaagtcaaagtgtcttggttaactccgtaaacaaccgttgggatgtttccagctggagctgagatcaagaccttctttgcacctgcatccaagtgagcttgtgacttttctgctgaagtgtagaatccagtagactccaaaacgatttcaacaccatcgtttgcaacccacttcaagtcagctgcgttacgctcagcgtaaacgcggatcttcttaccatcaacgatgataccttcttcgtcagctgaaacttcagcgttcaaagtaccgtgcgttgagtcatacttcaacaagtatgccaacatagcagggttagtcaaatcgttaattgcaacaacttcgatgtcgtccgcagtatccttcaactcaaggatgcgacggaaggccaaacgaccaatacggccgaaaccgttgataccaatcttaacagtcattattaagattcctcccagaaattctttgtaaacgtttttacgttgtctattatacgactttgtataaagtttcgcaaacagttgtaacaacgcgctttcaacatcgcaacaaatatgaaatttgttacgaaccgagtcgatcttttgtcctgaaataaatcaaaactcccaaccaatcgatatatctattatacgccactagcttaaaaaaagctcacttttgctttgattaagaacaaaaatgcccaggattcactcctgggcatttgttactttttcatagaatttacaagacgtcgctttgtacggcggaacgtcgttgacatgaagctcgtgtgcaattcaatcaacgtcaaaataacaagcaatgtcaccgttccaatgactgaaaaccatgtccccgtcatatcaattaatgaacgttcgtcacggctagccaatgaaattgaagaggccttcacaacctcttcctctgacaaagcttcgctaatcaaatcgaagtctgccataccaatcatttgttgcaacgtaaatgggtcgttcaacgattggaattcgtgcaagttttcttgcaattgatcttcttcactcttcaaacgatcttcccaaccatcacggtcgttatcaaaaatcgttagcaaacgaatctcgtgaatcaaaaagatgtaatcagcgacatattggtaggcggcttgttctagagacaacaaaccttgtgccatttgtccttggtgatcgctcaattgatgggttgccttcttcaaagcatctacgacatcagcttgtgccttaaagcgatcgcgcatactatcgaccttccccaatgcggtcgtgtatgccgtatacatttcttcattatcaggcgtatccgccattggtacagcagacgtttgtgcgtttgtatcaaacactttcgtctcttccccgtatgctgttacttgcatgcctagtgcgacaataaatgtcacaactgccataccaaccttttgccactttttcataacattcatgccttccatttctctcttgtaaaagaatagcaagacatttttgatttatttggcttaatttatgacgaaattccagaaaatgtgaatttttattgtagagtatcccaaaacaaaacgcacccggcctcactgaaccagatgcgttagaaacgttgcttatttttgtaaaacaattcggtgtgcttgactagcgttcgcaccacttaaacgagctaatgcataacgcgccacacgccccaatcctcgtagcacgtgcacaccacgcaaatcccaaatgaaatcaatcgcagttgctaacgttactaagatcaaccatgcaatcgccatcaaaatccccaaaacaaatactccattccatgctgcaatcataacattacctcccacgattaatttaaacctaactgtcattgttaattaaagtcctaaacgtctatcgcttaggacataatttattatatattaggttttaactaatttcaaccctaaagttaggttttaattaacggtaactaatacggtccattgggtgggctgcattaaaggcattaataatctcaagcatgtctcgacgagtcgcacccttttgggcgtacttaaccgctttttgcttatcttttgagacatttgatagtgttgattgaaaatgcataccgttacgttggttagatggtaaagccataatcgattccttctttcaacatgttagccaggtagtaatccacgacgctgataataattaaccgtctcatcagcaaagtcacttggataccccaaatgttcttctaacatccaagctgcaaatggctcatctgagtgttgacgggcaatacgcattaactcttcctccgaagtcatgtaggcaatgacttcttcacgtgcgttaacctcattattatgagcacggacagcatcatagtccaagtggtcccctaagtcagaaatagcgtgatgatactcttcgaccagcgtacgcgctttatcaaacgtatctaattcacgatcaataaagatataggccttgttcccctttaggtaggcaacaccgtctaatcccgaattttcttttaatggcatcgtatctagaatgataggttctaacccgtgttgcgttaaatcatcctctacgcgcattaatagatcatcgtaatcattacttcgcattgcgatcctcgtagtcagcaatcaatccttcaatatacgctttggcacggtcgataacacggtgacgatcttcgtctggtagccctgaaatatccaagccccagtgtgctgccatcaaaactggttcatcagttgcaacggccgttgaaaccttatctgggtcttcgactaggtctgactttgacacaccaaagtattcagccattgcttcaatcttatcgatgcgtgggtacgtcttaccgtttgaccagtcagaaattgttgccgttgacacaccaacgatttcagccaaacgggccgctgtaatttctcgttgcttgattaggcgcttaatgtttcgccccataatctccttaccttctgatgatgccataattttcacctttttcttgtttgtgtttttaatgtttatttcagtcttataggtattatattaaaggtaaacttaacaaaatgcaaggttaaacctaatcttttttatgctattgcgcgctataaaacaattgggctatactaaataacgtattggacttgtagtgtaatggatatcacgtcggattccggttccggagatgagggttcgattccctccaagttcatcatgcatgctaaaaagaccgagatttaaaatctcggtcttttttctatttctatatgttacttagctaccttcgcgtaaccggtgctgtagttaatcacaactcctggctccacattaggaacgaatacgttaaactctagtgatccgtctgatgacttggcctccaagtgtgaaccagatggtaccaagttatcaccatcgtaaaccggcgttacacggtaacgaaccgtcttacgattatcttgtgcgcgtcgaacctgggtctcgtaatagttttgacccgtgttgctgtcattcccatttgaggcttggttagcccacgccgtttgtgcggtaatgttttgtgggtttgcttcagaagcatcaaaaccacgaacgcttccagccaacgcgtaaccaattgaatgtccacggttatagagcatcttgtagttaccaccaattgatagttggtgccacccaactggttgcatttggcggctgttacccgtctggtcacgtgattgatattggcgactcgcctttgttagtagcgcattggcaacgccggcacgtcccaaggaatcttgcttagcaagttgcacgtatggtgctgaacttactttagcgttcaaatcagttttattatcgttaagaataaacgcaccgttaccattaaaacgcacgctattcgtgcccaattgcttcaccacattggcagtcaaaactgatgatgccaatgactcatttgggtgctcatctgatgtgctaccgtaattaaccttcgcatcagactttacactggattgtgcataatttgtcttcgttacttgtgtgccattgttatcctttagaacggtttgttgcaaagcaaaaacacctaatgcaatcacaacacctgctacagatacttgtcgcttacgtcccatgtcaaaaactccttctcttatatccctgagatattattataccagtaagttctacttaatattgtctttgaactgtcaaaagttgcatgttatctggtattattagtgcaatcaataaatacaaacgaggatgtcattatgacgaacaagaacttgattgcaaagcaagaattgtcacaccctgccgactggaagcctgaagctgcccacgccgacgtacgtgcgcaaattgaggatgccatcgccaagcgtttgacggaaatcatcgcaactgttgccgatttcggtttcgaatcagcgacggtcaacctacacgacttgcaagacttcgtgcgtgatgtcgtaattggtcactaccaattccatttccgcaagaaccctgctttgcgtgaacaacttgttttggcaaacgaaatgccactttcagttttcaacacgctcgttcaaagcggcgtcgctgatattttggataactcagatttcgaatactcattccacactgacggtgaagttcaaattttctggaactaaacttaaaaaggcgtgaacaaacagattgtttgttcacgccttttttatttccgattgcccggaacgtcttgattcttaggtaacacatactgctgtatcaagtcgacaatttgttgattttgtggcaaatcagaatgctgggcatcatccccagtcaccgtgatttctgtaaaatgggcgacctgtttttggaaaataaattttccagtctgcactgactgttctggcacgatgccatcatcgtcataggtttcagttcccataatcgagtataccgttaagtcactcggcaacttttcgcgtcccttaatgaagtcttgtagcatttgcgtacgattattagggttcgtttcctcaaagttatacggtgttccgatggtcattaacacttgaacgtgctgtgtatcactgtcatagtacttttccaaaaaacgggtccaaattaacccaccatttgagtggccaatggcttggaattgtcgaaaccgatatttcttctgcaacatttgcaaagcttcattgaaccaattggcttgctttttaatattgctataaccatcgtgattattctcaaacgcaatcacgaaatacggtgctagatcaccgttacgcactttaccggttgtgaccattgaattatcagtcttaaccgtcacctttacaagactgtgcttgttgtttcccttattcagttgattaatcagttgatcaaatcgattctgcgatgcggatgatcccggaattaaaattgtgggcgtcatgcgtgagttgaagattcgttgattcgttgtcgttttactttgactccaacgtagaccaacaatcgccatcgtaatcaagaggacactcaacagccctagtattaacattaaccagcgtctacgcataggcgacctccccactcttatgtagttcttgtacaacacgccagaagataaccacatccagtgctaacaaaccaatcacgacaagaacatacaacaacatattatgtgatgccaaaccaccaaatagaattgtcggcgtacctgatggcacccagtaaacagctggtgcaagatgaagcgctaataataacgcaccaatgccaaggttaaccgttgacgccatgagcattgtctttagaacccgccagttccacataattggtagcgcaaacgcgagcgcccaccattggtcaaagaacgttggaataatggttaaaatcaatagcactggcaacggcttattccgggcttgaatcaagtatgtgattaacaacgccaacatcaagcccgccccaccaaaccacacaaatgcggatagtgggtataacgagaacacatgcggaatcgtctgatgttgcaaggcagccaccaagttttcgttcgcagccgtcgctgaaatatcaggtcgaataacaccagcaacagcgtttaacccaaaccagttacccaagacagctattagaacccacaaccaggtttgccataactcagttgaaccatctccaatcaaagcaactaaaccttgttgtagcaagccaaacaaagataatttcagccagctatgtagcgtcacggcatatgcaccaatgagtagcgtgactaaaatcgccacaagatactgatgcctgggcttaaccgattgaatcggtaccataatggcaaacaccatcaaaggtaacatcgcaagattcattaaacttgctgtcgtattcagcatttgccaactcactaatgtcaccagggttagcaaaatcgtttgttgatggccttgaaattcatcctgtaatcgtttttgaatggcaagaacgatgaccaacacgcccatgatttggaagcctttatctaaaaacagcgtcataacacgattaatctcgccaaacgacgacatgatatgacgaccataaccaagtgtgaccgcaaaataaccatctggtcgcaggaataattgttgcatcaaatacaaccaggttaacaccaatacaagtggcagcatttgttgcatagcacgccggacagcttgcatattttctctcatgctcctcccatcctttcgtttaactaggaatgttgtcattataagtggtcaaaaaatggcgattagacatcatatctaatcgccattattctaccaccacggctttcattaatgcttattacttaaaagaatcaacatttttcgccgtggtccaatcttcatcgaagaattggtcattcatatcatacgttggtgtcttgcttggcgttgttaagaagtggtttacttccttgtccattgctaaccaaccacgccaacctaagtgaatggtatcttgcataaagtgtgccttcccaccatcctgtgagaagtccgcaatattcgtaaagccttgtgaggtcaattggtaacgaatttttgctaccgcatcttgatacatgttcatatcaagtcctgtatacttagcccacttttcattaactggtggaatcacaaacagaacatttgtcttcgtcttagcaaattgttgcaaagccaactcaaagtccccatattcaggtgaacttgtgtaatcaaatgccttttgtgaccccgctaactgcttaacgtgcttggcaacacgttgcttataaaacgcattatcaataccgaatgggttatttgtcgtacgcttagcggccagcttatcagctaacgcatcaagcttttgattgtcatagggttgtggcaaaagcttcgtcttaggcaaaatcttcttttcgtagttattacccaattggaagtccgcaaacaacgcatcttgatgattgatgaagtctaatcgaacagcaatcattttctgatcaccactagatagcttttcaccctttgcaatcttcttcaagtaacctgtcaacgcgctcgaaacgttcatttgtagcaaacgcttggccgcgtatcgatcagttggtgtgtcaccagctgtttttagccaagtcaacgcttgtgcctgactgaagtagtacttgaacgcagctggatcctcgccttgcttcacaaaccattgtggtgaaatcacataaacagcttgcttaccttgcatttgcttgctaatttgttgcataccgaagtattgcgtcaaagattgcgccccacgttgtccaagcaaaaatggtcgatagtcacgatcataagcttgggccagcactgacgggtgcaaagaatccatacggctccactcactcgaaccaaagaatggtacaaaacggtgatttggatccgtcaaggcacgttgcttcaacgtttgatttttaaaaactgtcggtgtcaaggcattggcagcgcgctgctcatcttgaaaattgtgtttgttggttgacatgggtgccaactcaatcaccgcaacgacaagtacaaaagctagaatgacaggaccaaagatcagtcctaatcgcttaagcattgcgcaactcctcgataccttcaataatcttgtttgcagtattccagtcgtcacgacccatttctgaaaccggcaccttaatgttgaactttgattcgatttctagcacaagctcaaccgttcccattgaatccatgataccggcatcaaacaaatcttcatccatcatgtcggaaacatcttccaagaacaaatcgttaatcatggcaatcaattctgcttttacatccatttttatttaccccattttaaactgtaactgttagtgttggtggaaccaaagttggttcaagaaccctgagaacaacaagaaactcaacatcacgacattaaacgtgaagaagatggcaaatgcctcggtaaacttgttgtgtggcacctggcccttgtggcgcttcttgtaacgtaaccaccagtcatttacgaccaaggcaacaccgtggaacacaccataagaaatgtagtaccaagttacaccgtgccagaatcccataatcgtcatattgatgatgtaggcaactcctgatgtgacattacggttcttaaagactttgttgcgcatcagaaccatgaccaaacgcatgaagatatagtcacggaaccaaaaactcaatgacatgtgccagcggttccagaagtctttaagattcttcgccataaatggcttatcaaagttaatcggcgtttcgattcccatcatgtatgaaatggcgacggcaaacaatgaataccccgcaaagtcaaagaacaaatcgaatccgtatgcgtacataacgcctaacgtaggtagattgaacagtccaccaacacgtagcgcttgttgctccaaaggtggcaacaacaatgacccaaaaatataagccaaaacaaacttgtacaagaatcccaagaacaagtacttaaccgctttttcaagcattcctaaatacttttcgcggtcaggtacattttcataatcttcattaaagcgacggtagcgatcaataggtcctgatgacaaggttggcatgaacaacataaatcgcatgaattgcggcaatgtaaattccttcagcaccccatcacgaatttccataatcatgccgactgagcggaacatcaaatatgaaatacccaaaaatccaagcaaagaattttgaccgttatcgatggccggcgtgatttttacaatcgccaatggcaagatgtctaacaagacggccccgtagaacacccacttgttatcggctcgcttgcgatacgctgcataaccaaacaccatcaccatttgccaaataatgtagccaatcaatgcgataaactgttgccagtgtgtcccagcaaacatcaacacgatgaatgctaatgacactaggccttcgtaccacttaattcgcttaccatacagcatggcaatcacaattggcactaacgccaaaactaagtacccaaagtattgtggatcaccatatggctgccaattcggcaatgctttaagccaatccatcatcgattgttaacctcagcaatcaaagccttgatgttaatcttaccgtttggcgtaattggcaagtcatcacggtacaagaaacgtgatggcatcatgtaaggcatcatatcgtccttcaagtcttccttgatggccttcgtcaattgcaaatccttttcgaattgctcacggacacctggctttacaacaacgtatgccaacaagttttgcaccttgtgttgatcgttataacgtggcacagccaccgctgactccacatattgtgacaagttcaaaacgtgagaaacttcttccaactcaatacggtaaccgttgaacttgatttggaagtccaaacgaccgccgtagtgcaacataccatcttcgtcaaagaagccgaggtcaccagtgtggtacgctggttgaccatctaattcaaagaaggcagcggctgtcttttcagggttgttcaagtatccctttgaaacagctggacctgagacgatgatttctccttgctcaccaactggcaacttgttgccttcttcgtccatgacaaaggttggtgaatcaggctttgggaaaccaattggaaaacgctcagccttttcaatcattgctggcgtaatcgccacagctgacaaagcaaccgttgcttccgttggtccataagcattcacaatgcgagcatctgggaagcgttcgtgcaactttgctgctgtgcttaccgttagctcttcaccatcgaagtagaagtacttaatttgtggcatcttttcagccgtaaagtcttctgacaacatggccatgtccgcaaatgatggcgttgacgtccaaacttgaattggcaaatctggcaaaactgcgaacaactccttgaagttctcggttacgtgctttggtagcgcgtataacgtaccacccattgctaacgttggtgcccaatacatcactgacaagtcaaatgagtatggtggttgcgccaacatttgtggttgctctggcactgagaaatcatccgtgtttagcatccagttcgtgtatgacaacaagttgttgtgtgaaatttgcacaccctttggcaatcccgttgttcctgaagtaaagataatgtagtaattatcatcttcttcaacagcgtgcgtcatctcatatgaggcacctgacttaaaggccgtttgtagttgatagatatcaataactggcacatctgcaatctcaattggcaacggatcaaccgcaatcaccaagcttggctttccaattgacaaaatgtttagcaaacgctcattagctgagttaacatcaactggcgcataagcgtggcctgacttgctcaaaccaacaaaagttgccaacatttcatattcttgaccaccaaacaccataaccaatgacttgtctggtagatcaagtgagtcaacataagctgccaatccatctgagtcgcgcttcaaatcagcatatgagtgcgtctcacctagcacattgtagacagccatatctggttgtgtttgtgcgtatccatcaatcgtcttcaacatgttcgtaacttgcatgttactaagcccccaataaatctcttatctctagaattcgttataaataaagtgtccttggcctaaacctgaatagccgtataagtagaacaaaatcatcaatacaactgcgtaaaacagcgtttgcaaaacaaatttcacaactggctgctgactcattgccaccagcttttcaatcatatctaaacctctcacacatatttctgtctttttcgcaacataaatgtcacaaaagtttcattttttattttagcacgtattcataaacgaaccataaattttaccttttcttggagtttaattttttagtcttttcgtaaatttactaaaaagggaccgaaatcctaaaataaagattgttcggtcccgaatgttaattcacttttttgttgttatattgcgtaatttcaatgccagcctcagacaacgccatgtgtgcaattgaaccattttcaggtcgctcgtgcacttgaattttaccttgtccataacggtcagctaatgaaataagtgtatttccgtgactgattaatagtactgtatcaccatcttgcaattgctcgttggctaaaatttgtgcaaaaccgtcatcaacacgttgccaatactccgctgcattctcagcgtcatgccaaggatcagcgtccttcagcaagtcctttgtcttatcgacaccatatgcatcaacgatttgtgcatacgtcgtcaaaccaactggtgccccggctgccgtccaagcgacatccatattgctcccttcaaagctgccatagaactcttcacggaaatgccaagacgtcgtcaatgtgacatccccagacgctttgttggctgccaaaatatacttagctgtatccatcgcacgggttgtatccgaactataagctgctttgaatgaaacgttcgccagcgtctcaccaacgcgctgtgcgtcagcaatccctgcctcagtcagtggcgagtttccccatccttgtaacttgttatagcgattaaagtacgtcttaccatgacgcacaacgatcaaattaattgtcttcatgctaaccgtcctttcaacgccattatagcaaacttactttttacgttccaagacacctttacggcgacgaatttgttcaggcttaaggtgtgaacggaaaatttcaaccgcttgctttgccttagcgccaacgaattcaaactcttgcccggccgttgtcttaacaaagaaaccacggtaatagaaattcaaaaagatttccatgctgactgattcaacattatcccaaggaatttggacataaccaccaccagcgttagcacggaattccataccacggtcaccataaaacatacgcccctgtttgatgttaaccggtgacatcatcgcatttgcgttaccctctagatcaatttttgtattaagtgcttgtaccataaatttttcctctactattgatatgtatccccttagttaggggattgttttaatttagttggtggtgtgtgtccgccaactcttttctaactaaaaatggtagcaggcgtttccgcctcctaccattttagcaaacattatatcgttcgaatgattatcccatgataccaagtgcgtaagccaagataccaacggcgaacaatccgaagatgattgtgatagctgatacgcgcttacgtagcaaccacaataccaagaacaacaatagcaatggtgccaaaccaggaatcaattggttcaacgtgtcttgcaacgtcgtaatcttgtaagcacccaaagtttgaccaccttggatttgttgtacgatttcgatcaactttgatactgaaacgtgtccgtcgttgatttgtgaagccaagcttcccatatcaacaccagcaccgtcttgtaccttaacctttgaaacaaccaatgggaagttcatcgtcgtccaacgaggaaccagcacacccatgataaacataccaaggattgatgcacccatcgtaatcttttgcatggcaccaccggccaagttttgcgtgatgttagttccttgcttgtaaccaaggtcttgtgtgtaccacaagaatcccatacgcaagacgttccaaacaacgaagaagatgattggtcccatgattgaaccaccttgcgccataccagctgcaaaagctccaagcactggacgaacagttccccaccagattgggtcaccgacaccggccaaaggtcccatcattccgaccttaacaccttgaatcgtttcgtcatcgatatcagcaccgtttgcacgttgctcttccaaagccatttcaacacccaagattggtgaagccacgtatgggtgtgtgttaaagaattccaagtgacgcttcaaagctgcggcacgatcttcctttgatgagtacaacttcttgattgcaggaatcatggcgaatgcccaaccaacgttttgcatacgctcgtagttccatgaaccttgcaagaagaatgaacgccaccaagttgcacgaagttccttcttagtcaagtgaacttcattctttactaattcagacatgatgttattccccctgctcctagtagttgttcaaaatggcatcgactgggtcgccaccatttccgccggcagaaccgccgccgtttgatccaccaccgttaccgccgttaaactttggtgacaattgtaggtaaatcaatgcaagtaccaatccgatgatacccattgcaatcaagttcaattctgtaacagctgatagggcaaatcccaagaagaagaatggccacaactcagcagttgccatcatgttaataaccatggcataaccaacaaccacgataaatccaccggcaacggccaatcccttagtaatcacttctgggatagcgttcaaagcggcgttaacaggtccggcaccaacggccataacgattgccgttgggatagcgatacgcaatccttggaagaccaaagccaaccagtggacacgctcaacacctgcgatgttacccttttcagcttcgcggtcagcgacgtgagccaaggcaaccgtaatcgtacgaacaccgatcgtcaagatttgtccggcaacggccaaaggaatagcgatggccataccagtcttgatgtcaacttgtgcaggtccagtaaccaagtaagctgaaacaactgatgccaaagcggcatcgggtgcgatagcggctccgatgttcatccatcccaaagccaacatttgcaacgttccaccaaggataacaccttccattaggtgaccagttgccaatccaatcaacgttgcagcgaccagtggttggtggaattggaactcgtccaagattccttcaacaccggccaagaatgcgattagaattacgaaaaacgctgaaatcatgcgttcatcctcccaaataatttcttagcaataatatagtagttattcaattgtgattacttcaacaagtcgaagatatccttgctttgatcacttggcacctttcgaacatcgaaagtgataccttggtcacgcaagtactccaacgtcttcacgtcttcgtcgtcaacggcaacggcgttcgttaccatgcgcttaccttctgagtgagacattgaaccgatgttaaccttgtccaacttaacgccacccttaaccgctgcagcgacatcttgaggtgtttcaaacaacaacaaggccttaactgaagcgaaacgtgggtcatcccaaacatcaaccaacttttgaattggcacaacgttaacctttacaccaactggtgcagcttgtaccaacaatgtcttacgcaactcatccttcgcaacaccgtctgaaacaacgataatacggtttggttgtactgacttcgtccaagccgttgcaacttgtccgtgcaacaaacgtgaatcaatacgagccaagcgaacgtcaatttggcgctcaccagagtgctttacttcattaatatcccccgcagctaccgctggtgctgcttcatctgatgaagtagcttcagtagctggtgttgcctcttccgtttcaggaattgacttcacaccttccttggcaactggtaccaagtagtgtgcaatttcggcagccgtttccattgagaaacgagcaccatatgcttctaccaacattggtaggttcaaacctgacacaatcgccatgcgatcttcgtgttgtgcttgaatacgagttgccgcgttaaacggtgacccgccccacaaatccacaaggaacaaaacttgtccctctggctcaaacgttgccaacgcatcgtcatacttcttcatcaagtcctctggaccttcgtttggcataaacgttacaacttgtacgttctcttgctccccgaagatcatttgacctgattgacggatgccggcagcgaactcgccgtgactagcaataatgaaattcaccataattgccacgctccttaaatttattaatcccttaggtacaaaacaaattgtaccctacatatgttcatatgtaaacgctttcagggaaatacgttacaattttatgaattttcctgtaaaacgcataatatcgatattaaatatttactgtgttttatttatgaaaaaagtcttgtttttgtttagcttgtataaccagcgcgctttagcaccaatccatgttcaggcgtacgcgcatttacaacaatttcttcaactgcaaagatgtgagccagttgctcatccgtaaagatgccagatgcaatcgcgcactcacgcaatggccggttcgtcttcagcgattccttcgccaactcggctgcttgcttgtaaccaaccatgttcgccatcgctgttgcaaacgatgccgacaaatcaatgtctttggccaagcgttcttcattgtgagtaataccagcaatggcatgttcacggaacgttttcatggccgacgtcaaatgcgtgattgacgcaaacatacgatagaacaaaactggctcaaacgcattcaattccaattgtcctgcttcaacagccgccgtaatcgtggcatcattgccaatcacttcaaaggcaacctgattcacaacttctggaataactgggttaacctttcctggcatgattgaacttcccgcctgacgcgcaggcaagttaatttcgctcaagcctgatcgtgggccagaacttagcaaacgcaaatcattactcatctttgataggttaaccgctagcgtcttcaaagcacctgataacgtcgtaaacacatccaagttttgcgtagcatcaaacaagtcgacggcttggaataattctaagccagtcacggtttccagctttggaataacgtgtacttggtagtggtatgacacattaatacctgaaccaattgctgagccacccaagttcagagtatgcaaggcagcttccgcatcttgcaaacgacgcaaatcacgacgtaatggcttcaaataggcgtggaatgaatttccaagcgtcatcggcaccgcgtcctgcagttgcgtacgtcccattttgtagacgcgggcaaattcgtcagccttcgcccctagcgtagaaatcaaagcttccaactcatcaaacagtggtgccatcaaacgaatcatggctaacttaccagctgatgggtaaacgtcatttgtactctgaccacggttaacgtgatcgtttggattaatacgggcgtaatttcccttttcatcccccaacaattccaacgccagattagccacaacttcattcacattcatgttcatacttgtgccagcacctccttgaattggatcaagtgggaacatcgtgtagtcgattggttgctgcaaaagttgcttagttgctgccacaatggcgtcagctgtttcaattggcaagtcgccagctgccgcattaaccaacgcggcggcttccttgatttcaatcagtccgcgaattaattccgggttaaccagttcccctgtaattggaaaattctcaacggcacgctgtgtgtgcaccccgtaatatgccgttgctggtactgaaactgttcctaaagaatcgctctcgtgtctcatcttatttagtcacctctttaataaattttgactagtgtaccgtgtatttatgcccaaagtatgtctttttgttaggcttcctaacatccagtaaccgttaaacgttttacgaaatcatgttttggcgatgatgatataatgaagggacttctttcaaggagatttaaatatgaaacaaacctttcggtggtggcaaaatctttttgtcgaatacacacttttatttgtattaaccgctggggctatttttttgccctactacttaaccggaacgtcgcttgtctggcaatcagatgggattgcacaacactttccggctttggtgcaatggcaaggcgatttgaaaaacttgctattcaatcatgaatggccgaacgcctggcaatggcaagtcggacttggcgcggattacctccaaacgtttgcttattacacgatgggtgatattttcacgtacggggttgccttagtcagcaaagcgcatgtgctggcctattacaacttaagtattgtcatccggctctttttagctggtttaagttttattgtcacggcacgccatttcgtgcccaaacagcaaaattggcaatatctaatcgggactttcggttatatctttttcggatataccgcctttgctgcctttgaacatccgttctttttaaacccattaattattttcccattgctgattttgacgttgcatcgcgcattgcgcaaacaccgctatggctggttcactgtattagttgcgtggacgttatggaataatttttatttcgcctttatgatggccatcggtgctattgtcttttggttgggctatcaatggcttaatcagaattggttgaattggcgccaacacctagctttgttagccaatgctatcatcggtgcattattacctatgattttattctttccaagcatcatggcagtcctacagtccgctcgttctggtaagtcattagctaacggactaacggtctaccccgcctattactacttaggcttaccgggtaacttgatcggtaacttaacgacacctgacttttggttgactggtggctttagtgccctcagtgtcatggccattatttttagcattcgtcggtggcgaacatacaagccatatgctggtatttggctaatcagtttcatcggggttttactacccgttttcgctggtcttttgaatggtggttcgtccccttccaaccgttggattttcatgttggcgttaccaattagcctggtgaccatcgttatgcttggccaattaaaacaacttaccgctcgtgattatctagcattttcactagttgggctcttatcgaccgcttcactgtttatcatgagtagtttcaacctgaacatgcgctttgggctagttattgcttggttcttcggcacggtcgctgtgttgtggttcacacagcatcacctatcacgcccaaaactcgcttggctgttagttgggctaacgttattcaacgttgtgttaattacgagtcgtaaccacactgataacacgaacccaaatcaaagtgacatgttatctactcagtcggtgaaaaagcttttggccaatcaacaaaactacgaaccaacctcaaacaagttcgaacgtagttttgttgataaccagctaagcaatgcaaccggtattgcgccggcaactaatctacctatcctaagccatgttaataacgttgaaagttactggtcactccaaaacggtgcagttggtaacctaatgacagcgttggaagttgccccatcaaatcccaatgatgtaacgggtaatctcgataatcgcgatgtcttaagcaacgttttgggtattaaccagcgttttcaaaaccctgatacattgacgccagcttcgtatgcagaacagtcagatgtcatggtcaatggtcaaaatgttttaacgtcacagaatgcgtatccgttggtatatttaccaaaatataccattgcgcaacgtgactttaaccaactatctgcaacaaaaaaagaagctacgttagccgatagtgtcgttgtcccaagtgtgacatcaggcgaaacttcagcctttgctaaaaaggtgacaacagctaaggttcgtaccgaccaaacaaaaccggcgaagaacagcgtacatttccgttatacaacccatgcgtcattgttgcccgatggtatcttcttaccagctgataaggcacttaaggggacggaattgcatttaaccttgtcacatatcacgtaccaccctgcgtcgttaacagagcaacataaccaagctttggcacagtacgaatatgattatgagcaagcgagtcgtaacccgcaaaacgagcctgatttacgtcacaatacggctgcctactcatggaactggtaccaacataatatcaagaatgctggtaatgaaatcggtggttatacgattaccgctggttatgcggatcgtgaaatgagtacaacacaaaccggtcaaacgaacctgtccttctttaacccacgtcaaagcgtcacgttgaatctggggcaggcaacgaaaactagtcaggaacaattcatcccgctaaccttctcgcgacctggcacatatgagttcgatgtctcaattgaggccattcctactgataagcgctttactaaggttgctaaggcaacacaagcaaccgctccacgtgttcatctaactgatgatgcagtcacaacaagggtgtcagtaaagacgcctcgtgtattggcaacgaccattccgtacagctcaggttggtcagccaagggttacgaccttcagaaaatcaataatggtttcattggtattcccctacacagtggtcaaaacaacattcaattaacgtacgagacaccaggtttaaccattggtcgttggctaagtttaatcggtatcgttctatttgtgctaacaacattcatacaacgtagtcggaaataaagcagaccgggaatgtcggtggtcttagacctccgacgtgaccaagtcgcccttatcaggtgcgtctttggtcttgcccctgactgaagtcaggggttttagaccaacagctgctgtgataaaaaaagagattaacacctacgcctttaaacagcgtaaagtgttaatctctttttttaagcaaattttcctgactcatcagccaataacaattcacgttcaatcttttctttagcacccaaatcagccatccactcggctgggaaatctggatcagcaaacgtcatgataactgccactaaggctgcaatcgtatccgtatcatcacctagtgcagctgctgtctgaacagcttccgcaaagctcgtggtgtgtaataaggtccacagaacagcttgcaacgtatccacaacatatcctgaactaggcacctcatctcgcgtcatagccttaagacgcgagatgatatccgctgatgattgctcatcagtaatggcaagccagcctagttcttctgtttcaagtgctgccgtttccatcgccgtgcggttagaacggcgaattggcatgtctagagcacgttccacattttgtacgcgtggcatcatgcgtaggaaatagataaagaaccgtgatgccaagcgagaacgacggtggccatgcgttagtcctgtcaactcatcactaatttcttcgattgtgcgatcagaatcaaactcataaaaagcgactggccaaacacgcatcaaagcaccattaccattgttcagctcatcctctggacggaagtaacccgtatcaccagtctcctcgtatgacttaattgcggctgacgtaccattaccgacgtcaaacacttcaccatagggcgtaaatgcgccattctccaggtagtcaacaaaatttcccatcaccgtctttaaatcaaagggttcaaacaaagcattaatagttgatagcgttaagctagtatcatcactccacgtaccttttggttgtgaatgcgtttgatatcccaccatttctgatgatacttcataagtatcacggtctttaaattcataagggacgccaaatgcatcacccatcgcgaaggcatacatcgcttgtcttaagtatgttgctttcataagctgctcctctaattaaacacgatccattgcaaaccagtcagcaatgctcatccattcacccgtagacttggcttgaatttgatagtcagtaatatcatatagggtcttacgatcaccctttagtggtgaccaatacgtctcgtcagcacggcgaataacatcccaatagttataaacctcttcagtccctgcttcatcccggacatggaagccatcagctaaattgaaactcttctcaccgacttgaggaccaccgacacctaaatcaacgagtaattgttgatatgattcatttgtaattggttcgttagccatatcttatccctcacttgttctatgctaagttcattttacaacagaagttgcgtgctgacagtacaaaaaaagaggcttaggcgaacctaaacctctaatgatcgggacgacaggattcgaacctgcgaccccctggtcccaaaccaggtgctctaccaagctgagctacgtcccgatattgatttgttcaaaataaaaagcccgtttccggacgtttcattttgaaatgccgtcggtgggggtcgaacccacactcccttgcgggaactggattttgagtccagcgcgtctgcctattccgccacaacggcatatctaatattaatcggatgatagaaagtttaaaactttcaagggcggtagatgggaatcgaacccacgcatgtcggtaccacaaaccgatgtgttaaccacttcaccactaccgccatggcaggggtagagggaatcgaacccccaccaacggttttggagaccgtcgttctaccgttaaactatacccctaaaatggagacgtaatatttaattatacggtcacaacgggattcgaacccgtgatctttcgcgtgacaggcgaacgtcctaaccaactagaccatgcgaccaatggacgttacagggatcgaacctgtgaccccctgcttgtaaggcaggtgctctcccagctgagctaaacgtccatgtgcatcgcgacgtcctatcctcgcaggaagcgatcctccaactactttcggcgctattgagcttaacttctgtgttcggtatgggaacaggtgtggcctcaatgccatcgtcacgacacggtatttaattgagaaaatttagctctctcaaaactgaatcataatttgtaaatcaaacttcgtttgagccttacaccacgtagagcaacggtatcgtaaaccgtaggtcgagggttcgaatcccccagtcggcatagttaaaaccatcctcgcttgaggatggtttttttgtacaatcgtgcagtcgaaaggagagttgtcatgaacgaagaagagcgaattattgagttagaagcagccttaaaggcctctgaagctgaagttgataagtggcgcactggagctgaaatttatgaagctcaagtcggggacttacaaggtgccttgcaagaaatggcagcggaacttgatcgactagcccttgagaaccaacaattaaagcaacaaacatcagaagcggttgttatgacacctcaaccaatggttgctgatcaaaatgcagcaatcattcaagatgcgttaatcaataagattaagcaactacaagcacaattaaatgaacgctaaaaatgggtaccagaaacattctggtacccatttttgctatgccatttgaatgtcacgcaatccgacgttagaatcaagcgtccctgatggacctgacaagctataacgaagatacttatcaacatctagacgcatgtcgctgtccatttgtgccttcgtatatcccttaatgtaaacaggacccaagtcgctgtcgatgaccgtgtcaaaatcgttagttaaatccttagcctcacacaagaccacgttaaaagcgacgtctagtgtacacatcccagcatctgaaaacggtccaacgccgtcatcaaaatccaagacgattttggttgttggtgttagcttagcagcaagcttagccttagctgcatctgaaattgttaaaaacatagtatccacctcctgcccccatagtaccatgatgaacggtaacgtacaaaagtctttgcacaaaagcgtgaactgtcggccaagtcgttgtacgggtaatttattgttgatagagttaaagtaagctataggacataggagggatttaattatgcatttaatttggacattgattgtgggagctattattggtgcaattgccggtgctattacaagccgtggtgcatcaatgggatggattgctaacattgtggctggactagttggatcatggctaggacaaatgattttaggtgactggggtccatcactagcagggatggcattgataccatcaattatcggtgcgattatcgttgtgttagtggtgtcatggatttttgtaaaagctaataagaaataaggtgaacgggagttggcaaattgctgactcccgtttcctctttcattgactaatgagtagcttaattttaagattaattgtctggtgtcgcgatgtttcgcaaaaacgtcataaatgagtgctaaaatgtaagcattcttatggaaattggggacgacacaatggaatttgtgacacttaataatggcgttgaaatgccaatggttggattcggtacggatgcagccaacgatgcactatcatatggtgaagtgatggatgcggccgtgcaagctggttaccgtttgtttgatacggcagcgatgtacggcaaccaaaacgaacttggggactttttggcaggttctggtttgaagcgtgatgactatttcttgacgagtaaggttgctcaaaaggaacaaggctatgaaaacacgttgcaagccttcaagaatacgacggctgctttgcaaacggaccacttggacttgtacttggtacactggccaaagtttgatccattctttgaaacatggcgtgcccttgagcacctatacaaggaaggttacgtacgtgctatcggtgtttcaaacttcgaagcacatcacttggatcgtttgttgacgaaggcaacggttatgccggcagttgaccaaattgaaacgcacccatactttaaccaacatgtcctacacggctacttggaagagttaggtatccaacaccaagcgtggagcccacttggccgtggtgctgttttgcaagatcctgttttggcaggcatcgctgagcgttacggtgtcagcatcgcgcaagttattttgcgttggcaaatccaacacaacgttgccgtgattcctaagtcaggaaacccagcacgtatggctcaaaacttggctttggacttccaattgacgacgactgatatggcgcgtatcgacgctttgcaacgtggtgagcgtatcatgggtgcaccagaccaaaactatacggaagatttgtggtaaaaaaacatggtgaagcagggacaatttgcaggcgttagttcagcaaagcgtttgaagaattttaagcaacaagctaaggcaacagaagcaaaagcaatcacacccgagaaggtgggagagtttttacttgttcgttatcacctaacgcaaaatacacgtttggctcctttgatgaaggaaacgatgcaacgggtattgatgaccttgcttgataatgcaactggcacaacgtggtcactagacaaattgtttgtgacgacgcttggccaaattgcgaatcaggtaccttggcaattctatgccttgttggcaacagaatggccacgtacacaaaagttcttgaacaaagaagttcctgctgtgccgttgaataagcgcatcattgtcactgatgatgtgactgatgtacccgaaaagattgcccagcaactggccattaattggtttttgatgatgtttgccacaatgccagaacgtttggcagctgtgacagaacaacaggttgctgacactaagcaatcattcttacaggatggtgccattaattggtctaatgttggaaccgtatattcaacgacgccatttatcatgcctgatgatgtcgatgaggcaactaagacttggttgatcgacttacaggcattaacaattgaacaattacattaaaaaaatcgtccaacgcatgcgtgcgctggacgatttttactattcacgcgtaccttcaatggcggtacggatatgatcaaccacttgttgggttttatcaccaagttgcaccccgacaagagtgaacaagctatccataatcgtgatttgagcaatcaatgatgacattgattcgcttcgaatattaacttcttcagcggcactggccaaaactaaatcagctgtctttgctaattcagattgctgataagcagtaatggcaataattttaacgccgttgttcttgagttgacgtgcgattgttagcgtgtcgtggttacgacctgagtgtgataccacgatggcgacgtcagtagcacgcatgcgaacagcttgcatcagttgcacgtcgtagtcagggtgttgttcgacatccaaaggtgtacgcaacaacttgtggtaaccattcaaggcgacgattgatgaaccaccaataccaaataggacaacgcgacgagcttcaaccaaccacttcgtagccgttgcccagtcatcgctgttaatcattgatagggtaccttccaatgcgttggttgcaccactgaacaccttttgaacaatttcagtcgtatcgtcttcttcgtcgatttcaccaaagaacgtgtcgtctgattgcgtggcaacggctaagctgagtgaaaactcacggaatgaaccgaagccgacgcgcttaacaaaacgggaaatcgttgcggttgaaagtccgaccgcattagcgagcccttggattgttaatgaacgaatttcttctgggttggccaggataaagccagcgattttttcatctgatccagataattgatcacgcattgaacgaatgcgcgcaaaacctgattgtgccatgtcaaactccttttatttttagaatcgggaaacgttgacataacaacgttctgtctattttctattgtaccgtattttggatatgaaaacattttacaacaaaagggttgcaaagtgaaaaacttttgcattataataatcatgtagaaaaaaagcacaagaaaaaaagaggtaactcaaatgaagttcgctatgatcggccttggtaagatgggcttgaacttggtaaagaatgctgcagataacggtcacgaagttgttgcttttgacttgaacgcagactttgttaaggaagctgacgcatactcagatttggtatcaccagctactgatatggatgacatgttggcacaattgccatcaccaaaggttgtttgggtcatggttccagccggtgttcctacgaactcaactatcgatactttgatcgagaagttggacgaaggcgacatcatcatcgacggtggtaactcaaactacaaggataacttggagcaaaacaagcgcacgactgctgctggtatcaagttcttcgatgctggtacttcaggcggtatgtcaggtgcacgtaacggtggaaacttcatgatcggtggagacgacgctgaagcatggaaggttttggagcctttgttcaagtcaatcgccttggaagacggttacctatacactggtcgtttgggatcaggtcactacttgaagatggtccacaacggaatcgaatacggtatgatgcaagccatcgccgaaggtttcgaagttttggaagcttcacaattcgactacgactacgaagccgttgctaagttgtggaaccacggttcagttgttcgttcatggttgatggaattggccgaagagcaatttgctaaggaccctaagttgtcagctatctcaggtcgtatgcactcatctggtgaaggtaagtggacgatcgaagagtcattggacttggaagttccagcaccagttatcgcattgtcattgatgatgcgttaccgttcactacaagaagacacgtttactggtaaggttgtttcagctttgcgtaacggcttcggtggacacgcaatggacgctgctaagtaataaaacggcttcccccgcttaattactttgtgagacccacaaaatataaaaaataaaaaccacaagtttaatcgccgctgttggtcgccctatcgacctttggcgctgcgtctgccaccggggaggacccatggcaggaactaatagccatttttaatgactatatgcgtggttccaatgcttaagttgtgagattcttgagtgttgtcatcttgtgctacatgagatgagattgtgagagcgcacccgacaggaaactgtcgggtgcttttgttttagtgtataattttgggtattaacttttagaggatgtaggccaatgaaatatacagtaacgattgatatggctgcaattgatgttgtggcaacgttgatcgatgaaaatcaaaataaaaaggtcatgcatttcccttacgaggggatggcatttccaactgatccagtgacacctgataacattgtgaacacgttggttgatgcattagcgtcaatgcgtgcagatttgccaggtgagtacgacgaaattgttgaagtccgatttgcgacgggcattgcaaatggctggtttgcactggacgaaaactttacgccgcttactgacgttgtctcaggtggtgataatcgcgcagcgaagtacgttgatgccttgatgattaacggtatcggtggtcaattgcaacgtaagactggcttgccaatgacggcgacggaaccgcttgtgttgacgctatggatgaagaatgagcgtcctgaagcttacaccaacgcagcgcacttcatgggcgtgcttgaatatgtgacataccgtttgttcggtttgaacattgttgacgaagcgttggcagcccgtactggctactacaatgtcgcccacaagacatgggatgtgcaagcactggccgtgaccggtttaacagctgaacaattgcctgaaattgtggctgatactgaaattaaggcgccacttttgcctgaagtgatggctaagactggtttgaatgctgacacggttttctacctccgttaaggcggaagtagctgagctggatatgctataattgaaatgttgccggggatgcagttagtcgaggagtgatgtcctagggctgccgtttacggagggtgcgatgccctgctgtccggtaatggtcacatgtgggaggtgaaggacccgcatgtgatcggaggaaaacgcatcgaggcttggacacctcgatgtatggggattgttaacagggtggtgcctgttaacatgatacggtgaaggagtttaagcggtacgtggtggtccgcttaaacagaaagagacctgcgctcatttagtgagagaggtctctttttttgtgcatcaatatttttctatatcataaatatttaaaactacaccctacccttcctaaaaataagaaagcgctaccattgttgatataaaagtattttaagaaactatttagtgaaattttgttcaaatcgttaacccagcaaaagcgtaaatatgttggtacacttgcactataaatgtatattgtcacaaaactgtaacaatatctcactttaggaaagttaaatgggtatttactatgggtgaaacaaaaacaagaaagaagatgtataaaagcggtaagttctgggtggctgcgggactaactgcgctttcagtgggggtggtttcctcatcgcctagaatgttgtcacgtttaggtgaagagatgaccaaggcgtcagctgcacaaacgacgtcaacggtgacgattgatacggtgacggatgcggatgatgctgcaggccaaaatcgttatgttgtttggggcccctcgggcattaaagatcacgatgagtatgctggaaagggaacgtataacagtaaggcatggtctgctgaaagtagcacttacacagatccagcgagtcaaacttacgcaaagctgaccgccaacggatcaaatacgattggatactactatatcaatcgtcagtttgatgcgtcgcaaaagtttacgattgatgggtacttccacccgaacactggcggtacagatggaaatctgccttctaacggtaattggtctgactgggttggtttggttttgacgccgactgatcctgcaaaaatggcaacagattacaatatgtctaatggtggtggtggacttggaattcaagggtttaaaaatgcctacgcccttggattggacttctaccagaattccggtgatccagcagccggcccatttggtgccttgcgtgcgacagatagttcaggtaatttgacatctgtaccgactgccatgtataccaatggccaaaacttgacggaatggaaaacaactattaagtaccagatgacttggtggccaacgggaggtcctggtggtgggccgtacattacggcttctttgaaggatactaatggtaagtcatggacaatcaataccagtaatgcgggtatcacattggttgcaccgaaggccttttctatcggtgttaatgccgccaacggaagtaaagctgctgacaactttggatcgattgataacttgtctggtacgtttgcgactggaaccacgacggttaagtatgtggatgcgaacggtaatacgattaagccctcaacgagctttattgccgctgttaacgacactgttggtattactaatctttctccaaaagcaaaggctggtacagcagatatggcctttgccgcaccgacgattcgtgggtacaaggtgtcatcagcaaccgatgtgacggtgtcacaaacggcagctaacaatacgattaccatcacttacacggccttgccataccaagagtcaatcattcagaccgacacgccagctttgtggagtgggtcaaatgtgattacgtcatactggagtgttgaccaagataacccattgggaagcagtgcaacagtcgcacaaagtattgtagatgcttcgttgattcgttcaggatatagctactacgtcactgatccaaacggtagcaactattcaacgatgtcatctgcgtatgcagccggcacgaatgcttgggacagtacgtcaaattctgccggtgtgcaatctgacgggacaccacaaacgtggacggttaagtatgtgccagattatcaaggcgcttatttgtacacccgtgattattcatacgcgaatggttcatatgtggctggttcatcagcatacaaggacgcagccggtggtcgaactagtaatgcaatcacttttgcaactaaggacagtaacctgcctaagtcaggttacacatacaccgttactggtccagataacgtgacgtattcaacgttggattcagctgttgcagctaactctttcgacaacacggataacaaggtgaatggtgttcaatcttcatcagatgcgtcataccaatacttcacggtaaactacacgccagctacgcaaacaacgagtttggtggttgattcaaattcacctgtgaaggctggctcagttttggcatcatcattgggtgcaaccagcgcaactttgtcattgccatatacggatgctaatttgacgacggccggttattcatacgtggtgaagggaccaaatggctcgacgtatgcaactttgtcatcagccgtggccgcaaatgcaatttatgacgccaccaacaactctggaacgactgattcatcagcccaagtattcacggttagttatgttggtgcttaccaagcggcagcggttaagtatgatccaaatggaccaatttcagctggttcaacactcacgtcggcaagtggcacaacgggtggcacaatcagctttgcaaccaacgatacaagtttggtgaaggctggctacacatacacggttaagtacacgggtacggatgcgccagactcaacggcgtacacaacgttgtcatcagccgtggctgcgcacccacgttatgacagcatatcaaattcaggtagttcagatacatcatcacaagcctttgtggtgacgtataagacaaatcaatatgcctcattgtttacggattcagctgacaattcaggcaactcagttttgagctattcagctgttaacgaaacaactaacggaccagctagctcagctatttcattcaagacgactgactcacagttggccaagagtggttacacgtatgtcgttaatgcattgaatgcagctggtagtgtcattaattcatatacaactttgacatcagccgtggcggctaacaagtacgacaatacgtcaaacgcggccaacgcaacaactgatgcgcaagtacaacgtttcaaggttgtctatgcaccgatgacggcgaaggtcacgtataactatgttgaccaagcaggtaaggtaattagcacggctcgctcagccaacggttatgtcgggtcaaagattccagatggctcaatgacgattgctggttatacattggtaggaccagataagaattcagatgctgatggtttgttcgatgctgatttggattcggtcatcacgtacgtttataagccacagtaccaagctgccaacttggtagtcgacagtgcgtcaccaatttcagcaaattcagcagttgaatctgcatcaggtgtgacgagtggctcgcttgcatttagcacggctgattcgcaacttgcgaagactggttacacgtatgttgtttatggccctaagggtgattcatacgcaaccctgacggcagcattgaaggctaatagcttgtatgacaacacggaaaacggttcggcttcggctgactcttcagcacaaacgttccgtgtgtcatatacagccgatgcccaatcagcctatattcgtgttcaacagaactcaccagttaaggcagggtcttcggttgccaatatcacgggtgtgactagccaagcaatgtcgtttggggttacagatgccgatttggcaacatctgggtacacatacacggttggatatggttacgacgtgaacaatacagtttggtattcaacgctgtcacaagccttggcagccaacagcgcgttcgataacacggataacacgggtacgaccgatgcggcggcccaacgtttcgtgatttcctatgcaccaatgagccaagcggcctcagttgtggtggacgccaattcaccaattagtgctggtacaacggcactttcagctaatggttcaacaggatcagccatctcatttgcgtctgatgcgtcatacgcaacgctagattcacaactggccaagagtggttatacgtacactgttaagtacggtagtgacacgacagcctacacaacgttgtcatcagcattggcagcgcactcatactacaacgctaataacacggcctcgggaacatctgatgctaaccctgatatgttcacagttagctataaggcggctagtcaatcagccgtggtcaacgtggctggtacgtcaccgattaaggccaactcaaaggttgattcagcggctggtgtgacgtcaggagcattgagtttcgcaacgtctgatgcaagtttggcagttgccggatacacgtacacggtcacgggtcctgatggcaagacgtacacaacgttgtcatcagcagtcgctgcaaactcaatctttgataacacgacaaatacaggtagcaccgattcagcaattcaaagctttacagtgtcatataaggcagcttaccaatcagctgcattggttgtggatgctgattcaccaatcagtgcaaattcatcattggcttcagctgccggtgtgacgaagggtgccgtttcatttgcaaagacggatagtcaactagccgtgcaaggatacacgtatgttgtctatgcggctaatgggtcaagttatgcaacattgacggctgcaatggctgccaatgggacgttcgatgataccgataacggtacggccacttctgacggatcggcgcaagtgttccgtgtgtcatataaggcggattcacaacaagctaaggttacagttggtttggaatcaccaatcagcgctggatcagtgattgattcagcagctggtccgacgagtggtgcaattgcgtttggcacggtgacggatagttacttgtacacgcagggataccactatacggttagtggtccggatggcacatcatacagtacgttgtcgcaagcaattgcggcaaatagtgcctatgacaacacagataacacgggatcgactgatagtaagccacaaacgtttacagttaactacacggctgatatgcaacgcgcatcattgggcgtgacatcagattcaccagttagcgctggtagctggttggcctcaatctctggtggtacggcgacgtcaatgccattcgagattgccgatacgtcattggcggtttctggatacacttaccgtgttatgggaccagatggtgagtggtatgcaacgttggctgctgcgcaatcagcaaatacaacattcgataacacgagtaatgcagatgattcagatactgagacgcaaaacttcatgattagttatgcgccgatgagccaagcggcaacaattgtcggggctgctaactcaccaattcaaaagggaaagacaattgaaaatgcgtctggcttgactggtagtgcgattgccttctcaaacactgatgcaacgctagctcgtagtggttatcgttatgtggtttacatgggttctgatagtgcgacgacttacagcactttgtcagcagccatggcagctaacacggtttatgacaacacgaataacacaggttcatcagatgcagcgccacaagtatttacggtgtcatatatcgctgattaccaatcagctaacttggttattggtggcgcaacgcaaatcagcagtggtgtcacactcgactctgctgctggcgtgacaagtggtcaggtatcgtttgcgacaactgattcagcactagatattgatggctatcgttacattgttaagacgccaaatggcaacacgtataacacgttggcctcggccttgactggtatgacaggtttgtatgacaacacgaacaacgccacagattctgatgctgcaccacaaacgtatacggttgagtattcagctattacgcaaacggctgaagttgttgttggcgagactggcgatgagtattcaggccgagtgattgaagaagtgaccggtgataccggtgcagcccttggcttgaagacaaccgatgagtcattgcatgccatgcaaatgacgcatggttacacgtataacgtgacggtccaaaatgccgatggcacttgggtgacagatgaaactggttcaccaaaggtctatgcgacattggatgaagcggttgcggacaacaatagtttcgatgcggttgatacgggtattaagcgttttgttattaacccaaccccttcataccaagagagtaagttggtcgtaagtagcgattcaccagtttcggctggatcagcggttgaaacgattagcggtgttactaaggcaccaatctcatatgcgacaactgataccgatttggccgttgatggttaccaatacaatgtgtcgattgtacgacctgatggcacatcgcaagcatatgcgaacctgtcagcggcggttgcagctgaggcggcttatgacaatactgacaatggggatgcccaatcagattcatcagcacaatcatttattgtgagttacaaggcggattatcaatcagccaacattagctttgccgatgcgccaatgtcatcaattgccgcagctggcgtgacgagtggtgtttacacatcaacgtacacggcaccggaaggatactactttacagcatctggtcaaccatctggcgccagtgttgcggcggatggccgtacggcaacgtttacgtttacgtatgacaacacaaataacgccagtgcttcagatagtgctgcgcaagactttacgttgcaattgtcagcagccagtcaatctggtcaaattagttttgtctactcaggtgctattggatcaccaacaacgcctgatccaaaggcactatctggcgtgacaggtgattatcttgaagacataatcaaggcgccagaaggatactacattgttgcgattgatggttccgcatataacgtttcgtatgccaatgaccaacacgatacagtgacctatacattgacgatggatgacacagataacggtaatgaaacatctgataagaagccacagaacttggtgattacattggcaccaactaaccaaacggcaacggttacccaacacatgccagatggcacgaccacggtaactgatacgcaaaatggtaagacggccgagtcatacgcatacacgtacacggcaccggctggttactatgttgcgagtggcgcggtgacaacagcttcaggtatcacggctgacattgcgacggatggtacaacggtttcattggatggaaactttgataattcaacgaacacaggaacagctggtactgatacggcaccacaaaacactgatattacgttggcccagtcaaagcaacaagcgcaatttgaaattgacgtcccagatggcgcaacgtcagtgacggctaagagtgagacgattgatggtctgactggggatgcaattaatgccccaactgggtacgcggatgctgatttggcaacgccaggatacacatacacggtaactggtccggatggcacaaagtacgacacaatggccgaagcgttggctgcaacgtcgaacttcgataacactaacaatggttctggcgaagattctgacgtacaaaagtttgtgattacgtatgttgctgatgaccaaactgcgactatcacgcaacagtacgcagatggcgcaaccaatacgccagccttcccacaagctgatgaaacattgaatggtaagactgatcaacaaacgtcaggtacaatcacagcgccagcgggatacgaaatttcgaatattacggcagctgatggcgtgacatggtcattgtcggatgacaagcagacggcaacttacacggttgtttatgatgcaacagcagataccgacaagtcttcacaggcaacggttatcacctacgcgccattaccacaaacggttgacgttaagttctttgatgaagtcggacgtccgttgacgtctgatacgggcgtaacgggccacacattgaatggtgtgacaaacgaaacggttaattaccaggatgctgatttggtgaaggatgaacaaattgctggatacagtaaggtagttgataatactgctgacaacgtcaactttgatgacgatacggcagtagatcaaaaggttcgttatgtttaccgcgacgtgcaagcgccaacggttacaacaaccaagaccgcattgacgacttcaaaggccggcatgccagctgatgaggcgactttcttggctgatgttggcttcagcacaactgataaccagcaacacggtgacagcacaattaagactgactatgaaacgattgccgctttggtagccggagatggtcagccacgtgatgtgaccattacggttactgatgcgactggtaacaagacgaccaagacggtgacgttgagtctcattgatacggcaccggtttcacaagagcaagctgttaaggatgcacaaaaggctttggatgatttggccaaggatccgaacacgacggctgaccaacaaacggcagctgaagaggctttgcaagacgcaattgaccaagcggttagcgagcgtgaggcagctgaaacggctggtgatgatgcgttgaattcacccgacaccacagcagtggcaactgatgatgcggttgcagatgcaatggcaaagttggataaggcgatgactgacgctgacaatgatcaaggtacgacacaggcaatcaaggacgcgactgatgcacttgataacgctgttgcgcgtgctgaagccaaggctgttgatacggcgccggtttcacaagaaccaagtgtccaagatgcccagtcagcgttgaacgatgttttgaatgatccaaatgccacaacggaagcgattgaccaagctaagcaagcattgcaagatgcagttgcaacagcaaagtcagaacgtgatcaggctaatgacgacgcaaatacaacaatcagccaagtaactgattcaaaggatgatgctgttaagcaagcggttgctgatttggaagctgcccaaaaggatgcagctaacaatgttggtacaacgcaagccattgaagatgcacgccaagcggtgattgatgccgttaaggatgcaggtgagacggcacttgcacaagatgcaacaccagttcaaaatgaagcgtctgtcatcgataagaagcaagcgcttgaagatgttctgaataatccagaaagtacgccagacgaaattgttaaggcgacaaacgattacaatgacgcagttgaacaagcgaaggctgatcgtgacgccgcaaatgaagccgcgcaagatgaaatcgcaacggccggtagctcacatcaagctaatgaccaatcagttatcgacgcaacgaagaatttgcaagatttgattgataaggcgaagacgggtgatgcgggtgcgttgacggaagatattgagaaagcaacgcaagctttgaaggatgctgtggcagctgccggtggtgcgcaagaagcggcccgcgctgatgcagccaaggcgttgaacgagacatcaccagttagctacgaaccggatgttcaaagtaagattgatgacttgcaaaagttgttggacgacccagcttcaacggctgatcaaattaatgatgcgaccgaggcgttgcgttcagcgactgagacggcgattaatcaacgtagtgccgctgatgatgatgctaaggcagccattaatgccgccaatggttctaaccaagcggacgagccagctgttcaggcagctgaaaaggcattgcaagatttagttgatcaagcgcagactgatacgccagatgctttgacggctgatattcaacaggctatcaagaacttgcaagatgccgtttcacaagctgctgaaagccaagctgatgcacgtcaagctgcggaggctgctttgcaagcgacggcaccagtttcaaatgaatcagccacatcagaagctatcgcaaacttgcaaaatgtcttgaatgatacaaattcaacggcggaggagattaagcaagctacagatgctttgactgaggcaacggcgagcgataaggcgagtcgtgacgagatgaaccgtcaagcagatgatgccgtaacggcagcgaagacatctgaccaagcgactgaaccagaggtgattgccgctattaagaagctgcaagatacgcaagccgctgctgccgctgattcgtcaacagctttgacggccgatatccaaaaggctattgatgatttggcagccgcccaagaaacggctaagcaaaaccaaacggccgcccgcgatgcagccgccgatgccatcgaggctactaagccggtttcaaatgaagcgacggttcttaaggctcatgatgctttgcagaagttgttggataacccatcatcatcaacggctgacattgagaaggcaacgaaagcgttgacggaagctaatcaagctgaacaagctaagcgtgatgcgattaatgatgaagcagataagtacgaagacaaggttgccgcatcaagcacgcaaaatgagccaactgttcaagctgctttggatgcgttgaacgagattcaagaagaagcagccacagatacgcaagatgcgttgacggccgatatcgcggcagctttggatgccttgcaaacggctgtggtacaagcagctaaggaacaagctgaagcacgtgataacgcggcggatgccttggctagaacagcgccggtttcaaatgaaaaggcggttgctgatgccatctctgctttgaacaaggtattggatgatccagcagcaacgacggaagacatcaagaatgccacacagaacttgatgaatgcgacgagtgatgacaagattacgcgtacgacagccaataccaacgcacaaaatgcgattacggatgcatcaaacacaccacaagctgatgaaccagctgtgcaagatgcaatcgcgaagttgcaagacatcatgaagcaagcagccaatgatgaaagtgatgcgttgacggctgacatcgatgctgctcgtaatgctttgaagcaggcggtagccgatgccaaggcggctcaagaccaagcgcgtaaggatgccgcggtggcggttgcttcagctagcccagtttcacacgaattaggtacggcggaagcgattagttcaatcgaagctatcctgacaaatccaaatgcaacaacggctgaaattcaagaagctactaagaatttgaatgctgcaattggttcggataagacggatcgtgatgcggccaatacggctggtacacaagcgattgcagacgcccaagggtcagatcaatcagctgagccttctgtccaagcagccatcaataatttgaaggatgttatggcaacggcggccactgatacggattctgccttgaccaaggatatccaagcagctattgatgcgttacaaacagctcaaactaccgcggctaataaccaacaagcagcccgtgatgatgcgcaagatgccttgtcaaagacggcaccggtttcacacgagccagccgtagcggatgcgattagcaacttgcagaagttgttggatgattcaacgtcgacaacgaagtcaattgccgatgcgacacaagcacttcgcgatgcagttgccactgcgcaacctttgcgtgacgcggccaacgaatcagcggacgcagccacagcggctgtcccaactgacttggctaaggagccaactgtgcaagcagccttggatgctttggatgaaattcaaaagcaagccgcagctgaccaggatggtaacttgaccaaggatattgaagcagctacgaaggcattacaagatgccatcacaaacgctaataccagtcgtgaagcggcacgcgatgctgccaacgatttgatgggtaagacggcaccagtttcacacgagaccaatgttgctacggcgaaggatgcgttgcaaaagttgttggatgatccaacatcaacaacggcggatattgaaaacgcaacagcagccttgcgtgatgcgttgcaaccagttggtgctgcgcgtacgcaagccaacgatacagcaaagtcattgattgatattgtgaagccgtcagcgactggtcaagtaccagcagttcaggaagctttgcagaagttgcaagatatcatgaaccgcgcggctggcgataatgctgatgctttgacggccgatattgaagcagccacaaaggctttggaggctgccgtagcgacggctaacaacactattgaagcggctcgtaatgcagccaatgatttgcttggtaagacagcaccggtttcacacgaagcggaagtcgcaaatgcgattacggctttgaagaaggtactggacgatccaaatgcatcggccgatcaaattacggcagctacaaaggcgttgcagacggcgcttgatgacgctaaggcaaagcgaactgatgcaaaccaagcagccgataaggcgattacggctgccaagaattcgtctgttgctggcgaccctgccgtacaaaaggcattggatcgtttgcaagcaatcttggaagcagcagcgaaggatagttcaagcaatttgaccgctgatatcgaggccgcaattaaggccttgcaatcagcagttgctgaagctgaagccggagctcgtaacgttgttgtgccagcacaacaaccaacatcggcatcagttgttaataccgtcactgagccagtaacgaccgtagaaacggcatacgttgcccagccaacttcacttcgtgcacaaacgccaacggtttactcattggcttatgcgaacgaaccaggtcgaattggtacgttgcctaacactggttacaaggatgattggcgtttgatggctttgggaatcttcttgttctcatcaacacttttgctgcttgcagcaaagcgtcgtaagaaggatgaagaggactaaactgatcaaacaacgacagcttgaataacgtaatgaaagcggccaaactcggtaacacgagtttggccgctttttatggtatcttttatttaagagttaaatgggagaggtatatcatcatggcaaagaagaagaaatcgacagcaggtaagtgggtgaaacgcattgcggccctcttcatgctgttcttgatgttgttcggtgtcttttgggcggcgcgcagtgcgtttgtgcaaaatgagccagcatcatctaaacaagcgtctaaaaaatcatcaaccagcgtggataatcgtgtcgttgatatcgatatcacgaatggcgatgtctatattatgcctggtacacaaactgtggctaagaacgctgagacagttaaggcgattgttaagcaagatgatggtagttatatcatcacaaagtcggatggcacgaaactaaaggtgctggctaaccaagttcgtcaaataattcgcgcaaatgattaagtcgctttggtacaatgtaattaacgaaaaataagcgcgggagtgtaatgattatgaagattgcagtaattggggcaaccggaatggccggtcaagcagtttttgaagaagcaacaaagcgcggacatgctgtcacagcgattgtccgagatgccgataaggcacgtgaaaaactaggatcagatgccacaattttggtaggcgacttgttcgagatgcacgcggatgtgttcgaggaattcgatgtggtggttaacgcatttgccaaccacaaggatgcttacttgaatttggatgcattgacgcacctgttgcacgagttccgtcgtttgcaaacgcgtatcatcttcattctaggtgccgcgtcacttgtccaagcaaacggtacacgtttgttcgacttcttgaaagaactgccaggtaacgaagcctggattgacgagccacgttatggcgtgcttgaactagaaattttgcgtgcaacaccagatgtcttctggacaggcgtttcaccacagcaaaacttcgtgccaggccccgccacagctcaccgtacagccaaggatgacttgttgttggctgaagatggtaagtcacacgtgacggcaggtaatatggcggttggtattttggatgaaatagaaacaccaaagcacgtccgcgaacgtttcacagtttcagatttgtaatagagaaccactaaagatccacagcgatgtgggtcttttttaatacctaaaaacgttgggtgtcattatctaaacagataaaaacctttggccattgggccgttttggaacgctttactgagtgacataataaaactcgtagcaaaggaagcgcttacataagcgtttgttaaagttcataaggaggggaaccatgaacaatcctgcgattaatgttaactcagagattggtaagttgaagtccgtgttgcttaagcgacctggtgctgaagttgaaaacatcacaccagacacaatggaacgtttgttgtttgacgacattccattcttggagatcgcgcaacaagaacacgacttctttgccaatactttgcgtgagaacggtgttgaaaccctttatatcgatgacctagctgttgaagctttggacactgatgagaaggtccgtgaagctttcgtccaacaatacttggatgaagctggttacggcatcggtacgactcacgatgcactgaacgattacttgaagacgtttaacacgcgcgacttggttaccaagttgtatgccggggttcgtcgtaatgaatttgattttgaaaatgattcactacacgatttggctggtcgtgatgcggcaaatccattcttgttggatccattgccaaacgcctacttcacacgtgacccacaagcatcaattggaaatggtatgaccattaaccacatgacgtttaaggctcgtcaaccagagtcattgttcacggaattcgtgatgacgcaccacccacgctttgctggtcacgttgatatctggcgcgaccgcaaccacaacacgcgtattgaaggtggagacgaacttgtgcttaacgaccacgtacttgctattggtgtttcacaacgtacgtcttcaaagtcaatcgaagcgttggctaaggaattgttcgctaacccagacagtcactttgatactgtcgttgccgttgaaattccacacaaccacgcgatgatgcaccttgatacggtctttacgatggttaataaggatcaatttacggtcttcccaggaatcatggatgagggcggtaagatgaacatctttatcatgacgccaggcccagatggcacggtaaagttggctcaccgcactgaccttggtgcaacgttgaaggaagtgttgggactttctgagttggacttgattgagactggaagcggtgatgcgattgtcgcacctcgtgagcaatggaacgacggttcaaacacattgaccatcgcaccaggagaagttgtgacctacaaccgtaactatgtaagtaacgaattgttgcgtcgccacggaattttggttcacgaagtcatttcaagtgagttgtcacgcggtcgtggtggtccacgttgcatgtctcaaccaatctggcgtgaagatttgtaaaacagacaaataaaggagaaaaagaagaatcatggcaattaactcagtattccaaggccgttcacttttggctgaaaaggattttacctcagcagaaattcaatatttggttgatttcggtttgcacttgaaggagttgcaacacaatcacattccacaccgttacttggaaggtaagaacatcgctttgttgtttgaaaagacatcaacgcgtacccgttcagccttcaccacggctgctatcgaactaggtgctcacccagaataccttggttcaaacgacatccaattgggtaagaaggagtctgttgaagacactgcgattgtcctaggacgtatgtttgatgccattgagttccgtggcttcaagcaatctgatgttgaaggattggctaagtactcaggtgtgccagtttggaatggtttgactgaccaatggcacccaacacaaatgatcgctgactttatgacaatcaaggaaaactttggccacttgcgcggtttgacgttggcctttgttggtgacggtcgtaacaacatggcgaactcattgttggttaccggtgcaatgttgggtgttaacatccgcattgttgcacctgaagagttgcacccaacgcaagaagttgttgacttggcaaatggatttgctgctaagactggtgccgagctaaaggttaccgctgatatcgacgaaggtgttaagggtgctaacgtcatctacaccgacgtttgggtatcaatgggtgagtctgattgggagacgcgtgttaagttgttgacgccttaccaagtcaacatggacatgatgcgcaagactggtacgcctgatgacgaattgatcttcatgcactgcttgccagccttccacgatacgaacactaagtacggtgaagacgtcaaggaacaatacggtatcactgaaatggaagttactgatgaagtattccgtagcaagtacgcacgtcactgggacgaggctgaaaaccgcaagcactcaatcaaggccatcatggctgcaacgttgggtaacttgttcattccagatgtacctgcgcttgaagaagccggtaagtaattatggcagatactaaggataaaggaattgctttacctgccttagtagcgctagtcgttagttctgcaatcggtgctggaatctttgatttgccagcgactttggcccagggtgcaacgcctggagcggccattcttgcttgggtaattacgggatttggtattttgatgttggcattgagtcttaatcatttggtgctgacgaagcctgaactaactggtgtttctgactatgcgcgtgccgggtttggtgattttgctggatttatttctggctggggatactggttgtcagcttggctaggtaacgttgccttcgcaacaatgctgatgtcagcgttaggttacttctttccaccacttaaatctggaaacagcgtcagcgccattattgtcgcctcaattgtgtcatgggcactaacgttacttgtcacacacggtattgagtcggctgcagccatcaatacaattgtgacggtgaccaagttggtaccgatcttcgcctttgttgtcattgctttcttgagtatgaaggcgggggtcttcacggcacacttctggcaaaacatgaccactaatgttcaaggacaacttgtcttttcaagcgcaacgggtgcgggtatctttgcgcaagtgaagggttgtgttatggccatgatgtgggtcttcgttggaattgaaggcgctacgatgatggcgtcacgtgccaagaagaagtccgatgcaggaaaggccacgattatcggcttggtgtcattgctgattatctacatggttgtttcgattttgccttatggttatttgtcactagaacaattgcgtgggatgcaacacccagcgctactgtacctgtttgaaagcatgacaggtcgtttgggtggtgcgttcatcagtgttggcttgattatttcaattttgggagcttggttgtcatggacgatgttgccagttgaagcaacatcattgatggcagaacaacgcttgctaccaaagtggttcggtacgttaaacaagtaccgcgccccacaacactcattgttgttgacgcaaattttgattcaaattttccttatcacgttgctctttactgatcaggcgtacaactttgcgtactcattgtgtaccgcatcaatcgttgtctgctacgtgttggttggagcttatgaactgaagctcggtatcgggtcaaagaagtggtccgttatcttgccaggtttgattacagttgtctttgaagtcgctgcgattgtcttctcaggtttgcagtacttgtggttgtgcacaattctttatgttttgggatttgtgttgtactaccgagcacgcaaggaagacggcaagcaggtgaccaagtcagagtacgtgatgatgggaattgtcttgttgctagcagtagcagcagttgttgccttagccacgggtagcttaaagatttaagagattggagaaatgtaatatgacaaagcgaattgttgttgcacttggtggaaatgcgattttgacggatgacccaagtgcagaagcccaacaaacagccttgcaacaaacggccaagtatttggttaactttttggaaatgggggatgtccaacttgttttgacgcacggaaacgggccccaagttggtaaccttgttttgcaacaattggatggcagctcagcaaagaacccagccatgccattggatactgttggggcgatgacccaaggtgaaattggcttgtggttggcggatgctttgaatgaagagattattagtcgcggattggatcaaaaggtcgcaactgttttgacccgtacagtggtcgatgcaaacgatgccgcctttgagcaaccaactaagccaattggaccattctacacagctgaagaagcaaagactgttcgtgatgagcacccagattggaccatcgttgaggacgctggtcgcggctaccgtcgtgttgtgccatctccaaagccaatcagtattatggaggcggacgcgattcgaacgcttgcgcaagaaggtgtaacgctaattgcagccggcggtggtggtgtcccagttgttcgcaaggacaatgacattacaggtgttgaagcggttattgataaggactttaccgcagctaagttggccgaattggtcgatgctgatgagttagtcattctaacggccgtgcaatacgtcacgaaggacttcaagaagccaactcaggaagatatcaagcaagcaacggttgccgagatgcaagcgttggttgatgaaggtcaattcccggctggatcaatgaagccaaaggttgaggcagcaatgagctttgttactgccactggtcgtaatgcagtcattacatcattggataatattgcagcatatcttgaaaatggggatggtacggtaattaccgcgtaataccaacgaaacagacggtttccgtataaaggagtccgtctgtttttcatttgtgaaagcgtatacttattaaaagaagagttttcataatgaacaaaaggggattagcatgctacagaaatttatgacggaatggctgtatatttctgactacgatacgccggtcagtcgcgagtttgtcggagaagctaatattcatggtgttgatttagcgaaacagtatgtggcggttgttgttaaaggggaggcagcgaccatgccggaatataatttagcgtttgatttagataaatatcggcgatgctatatcatgacggacgagtgtgtcccgagctttacaagcgctttagccgattcttttagcatcggtattggcacagcgcactttgatatttcggctagtgttaaggaagccttatatatcaatttactgactgatgatattaatcgggtattgcggtataacaagtttgcctatctgattaatatcgccaagacgcagtcggcagacaaaaatattgttgcgtactttagtaggttggatgaagaggcgcagctgactttatggatttatgccaataatggtgccattacggaaacggcggcgcaactgcacgtgcaccctaaaacggtgcgttatcgtttgaataaagtaatggcaacaacaggattggatcccaaggtgggagtggatttggtgcctcttatcgtcagttacattcaggggaaaacagaggactatgacattctagtcggtgagttacagagtatctctgaccgtatgttaccacgcgataagcaagcccattaatcggaactgatgcaaaaaagatgccgggttcactgatttttggtaaactaagtactcggacaaacttttttaatcaggagatttattatgacagaacaactagtattacgggccttgcaggcgatattaatcattgcgttaatcggtatggcgattttgtataccgtatcaatgcgccgaaacaagattaatccattccgtaagtttgtcccgggattcctgattggatttatcacagattttggcgatacattgggtatcggatcgtttgcaacgacgacggctttgttcaaaggaacgaagtggttggatgacgaccgtaagctaccaggaacgatgaacgcagcgcacgccattccggtattcgttgaggcattgttcttcctgtcagcagttaaaattgaagtcacaactttggttccaatgaccttagcagccatcactggagctgcattcggaacacgtatcacggctaattggccggtacgtaaaatgcaacgcgggttgtcgattggtttggcattggcagccatcgcgatgctgattaagctcatcgcaaacccaggtcatgctgattcaatggccgttcacggtttgcacggctggttgttagtgctaggtttggtcgtgaacttcaccttgggtgtgttgatgactattgggttgggtaactatacgccggagttgattttcttctcattggttggggttaatccattggttgctttcccagtgatgatgatggatgcggcgatgattatgatgacgtcggccatcggcttcgtacgcacgggtcgtattgagtggcgaggctttaccggaattatcgtcggtggtgtgctgggtgttattgttgccgcaacggtggtgaccggcattaatatcacggtgctaagctactttatcgtagcgttggcagcgtacacagcgttcaatttgtaccgcgattcacgcaagccagaaccggctgatattattaatacagataactaattctttaagcagtgtgttgacgaaatataatcaacacactgctttttaaatattaaagatgcttagggcaaatgaaaggcataaaatatagagagtagatgacggggaatatgtaacctgaaatggggataagatgataaaaatactgaaacttcttttagcggtggtcatcgcgatgctcgttgggacacaagtggcatcggctgatgacgactatgagattaaacaaatgtatgaacacgtaactgttaattcagacggttcagctatgattcgctacgatttgatttacgattttgatgatgacatgaacggtgtttacgttagtcaggaaacggatcaagatgttaagttgattgggtcgccaacggcaacggttaatggtcagtcggtcggcagttatagcgcgggaagccgatacggcctggagcaaaagcgtgatggggatgtcacacaatttcgggtgcattatcctgtgaaggctgaccatacgtatcaagtcacgtggacataccaactagcgaacgtcgccaagcgttatcaagatgttggtgaaattaattggaaaatcatcggtgcgaattggcaaacggatttgcagcacacaaaaattgtgattcagctaccgaaaatgacttaccaaaccttgcaggcatggacgcattcgaagagtgcaacaaaatttgtggtggataaacaagcggggacgctaacttatgaaaaggcacgggtgaaccctgatcagccggttgaattgcatacaatgtttgaccaagcagcattatcgacagcaacccaacgaacgggcaatcgacgatcggctattctgaagcaagaacgagccattgctgaacgagctgaaaagacagcaaaacgagataaagcgatgcaaggctatgtcacgtggcttgctattttgccgtttggtttattgtttcgcctgattgtgctgtggcgtcgtatccgtgtgcaaaataagcatgttattgagacgccgcataattatgaattgccatctgatttaccgccagcggttgttggttggcagttgcgtgacagtggcgcagcagtttcgacattgtttagtgccactttaatggatttgttagcgaagcgagttttgattgtttcggaagaaccgacaaagaaatggcgtaagacaaattatcggattcaactggatcgcacgacagcatttaacgattttgaagagacgttattaacgattttgtttggcgaacaagttgagattgggaagagcattcaaacgcagacgatgcaagacggtgagagtgcttttgcaaaacgttacaccgataaaattgatcgtttcgaggatcaagtccgacgagctgccaagccagtcaatttgattgaccatgatgcagtgtcgcaattaacgcaatggcaagtttggactattgttgccgcagtggctgtcgtggtaattaacggcgccgtctgggtgatgagttcagcgcacattgcaggatggtttatcggggttagtgttggtctatccgttctgattgccgtggtggcatttgcgatggcggtgaaaattagacaaatatacacagttgaaggatggccaatagcggaagcctggtttggctttggacgcatgttgcgggatgttggtcaattcgaggtgaagcaagtacctgacgtgatgttatgggatcgttacttggcttacgctgttgtactcggtgtggccgacaaagttgcggatgccttgcgccaagcccagctcgaaccggtagatgatatgtcaaaccttgtgccaatctatgtggcctatacaatgttcagcccgtcgagtgtctcagccttcggtgttgcaagtagcgggtctgacactggtggcagttggggtgctggcggttcatcgggtggattcggcggtggatctggtggtggcgcgttctagaatcgtacctttttatcggtataatttcgtgttatactaccagtatcgcatgagcggtttcagtagataattggtggacagtcagagagttagtggtcgttgtgaactaaccaattccgaagctcgaattacacccgcataaacctcatgtgcgtcgccccaacgttactgggaagatgagtggtcacggcataccgtggcaaattaggtggtaccgcgtttaacagcgccctaatcagtgttatagctggttggggcgcttttttgtacccaaccaaagaatcaataagatgtaataatctaaaggagacaggattcatggcagaagatattttgcaagaacttgaatggcgtggtgccatcaaccaaactactgacgaagctggtttgcgtgaccaaatggctaaggagcaaattggggtatacgttggtatcgacccaactggtgactcaatgcacatcggtcacttgattccatttatgattttgaagcgattccaattggctggtcaaaagccagttatcgttgtgggtggtgccactggttcaatcggtgatccatcaggtaagaagtcagagcgtaagttgttgtcacaagaagatgtggccgctaacgttgaaaagattcgcgcccaaatggtcaagttgttcggtgaagatggcttcacgattgttaacaactttgactggttgggaaagttgtcattgctagacatgttgcgtgagtacggtaagttgttctcaatcaacacgatgttggctaaggacgtcgttgcatcacgtttggaagcgggaatctcatttactgagttcacgtaccaaatcttgcaatcaatcgacttccacgagttgtggaagcgcgaaaacgtgcgtttgcaagttggtggatcagaccaatggggaaacatcacgggtggtatcgatttgatccacaagcttgaaggtggtgaagcaccagcctttggtttgacggtgcctttgttgttgaaggctgatggtacgaagtttggtaagactgaagggggagctgtttggcttgaccctgaaaagacgacggcattcgaattctaccaattctggttgaacacggctgattcagacgtcgagaagatgttgaagtacttcacgttcttgtcacaagacgaaattgctggcctagttgctgacttgcaagaaaacgcagctgctcgtaacgcacaacgtcgtttggctcaagaagttacgacgttcgttcacggtgctgatgctgttaagacggctgagacgatgacgaaggtcttgttcggaaacgctgacgtgtcagaattgacgactgatgaagtcgcaatcttggctggaaacgtgccaacgttcgaaatcgacaacactgaaatcggcttgttggacttggttgttgcagctggcttggaaaagtcaaagacggccgcacgtaagtctgttaaggacggggctatccgtatcaacggtgagcaaattactgacgaagaagcggttatcaacccagctgcaaagtacgatggtaagtacgtcatcgtaaagcgcggtaagaagaagtgggccgttgcggttgttcgttaatgaactaactactatataaataagtaaagggcactgcatatttttgcagtgcccttttgactattgatgacgctcgctgcgtgtggttggttgcttaggagcaacatcaggcgtagcgggtgtttttggttgttcttgcataattggcgcgtcagccatcgtcgtttgcttaacgatagcctctgaaccaacgccactaatcttttcatatagtagcttgtgttgcggacggaagattgtgattaaccaatctaggaccagcacaacggctggggccgcaaacaatagaataaacgtgtatgttcggttcaacaattcagctgataccgttccggtagaaccaattagttgcaaccagaatgggaagaagtaaatcgtaaagccaaccatcatagcgtttcgaaggaaaatgcgccaacgctgtgatttagacacgtcataacgggtacggacgactaattgaccaggtgttgcgccaattaagaatggtgcaataccccaaacaataatgtatgaaatgatgtcagctacaacttggcttggcatgacgacattaaggatgaagccgataattgatgcgataacgaagtccaccccaaatgatagtagacgacgtaccagcgtgacacggtgtccaaggctacgtgcacgttcatccatgcgatcacgggatgggaaaatcaacccaagtagtggggcgaaaatccaaccgataacgccacccatggtgttcaaaatgaggtcgtcaacgtcgaacaggcggtaggggcgccagtagatgtgatacaacgcggtatattgcgtcgtttcgtaaaacgccgttagcatcatcgttagaattaacgttgtgaagaaaccgcgcttgaagtaaaagtgcaaatacataccgaagggtacggttagcaacacattaaaggctgcctgcgtaaatgatgggtccaacaaaccagccttcaagccaccaccgtggaagtaggggttgtcgttaaagaaggtgcggacaacttggagcggatccaggttcatcgtctgtgcgtgaatcgcctgcaaatgctccaaggttgcttccgttggtaacggcaaaatgaccatgaaataggccgttgtaaagtaaaatacaaaactaaacgtcatcaccgtgtgccaaaaagtcacggatccgaagcgacgatattgcaaaaataaaaatggtacgaataaaacaattagtatgattggaaacgcaataattgcgtctttgataggtacgccaaagcctcccacaacactttcctccgcttttctgtcatacttagagtatacagtctagaccactaaatttcacaaagttggcattttctgttgcatttacttttcgtaagtgtaaaataagttgcataaatattgatagatttttatttgagattttttgaagcgaaagaaggacttaggatatgactacgatgaaggccgttgtatttgacgaatttggagacgttgatgtcttccacgaagctgaagtagaagtaccagttttgacgaagggtagcatcttgatcaagcaagctgctatcgcaatggacccatacgatgttaagttccgtgccggtgcctttggtgtgcctgctaaggaaaacatgatcggtggatcaacgattgccggtgttgttgaagcagttgccgctgacgtaacggagttcaaggttggtgagcgcgttgttgctgtaccacacgagcacggatacgcagagtacgctgttgttgatgctgacactgctggtcacttgccagattcagtttcatttgaagatgcagctgctttggccttgggtggtcaaactggttaccaagccgttgttgatgcattgaacttgcaagaaggtgagtcaatcttgatccacggtggtgccggtgctgttggttacgctgctttgcaaactgctttgtaccgtggcgcatcaaagatctacacgacgtcattgcctactgacatcgactacctacacgagttgaacgcagacatcgagacgattgacttcacgacgcaaaagtttactgacgtgattccagagtcatcagttgatactgttgttgaaatcatcggtggtaacaacgctttgggttcaatgcaagttttgaaggaaggcggacgcattgtgtctactgttcctttgggtgacgacgttaaggctgctcgcgatgccaagaacatcaagggtgactactacgtgatgcaatcaacgactgaagttttgacgaagttgatggagcacttgggaaatggtgactacaaggttgctgttgccgaagtaaagccatttaacttggaaaacttgaaggaaggtcacaagattgttgagtcacaagccgttcgcggtaaggttgttttgactttctaatttgaccaactacaattaaacgcacatcagaaaatccgcacgacctttttccaccggtcgtgcggattttagtttatagtggtcatgaaattaaacaaaagaggaaaatacaatgtataaggaaccactcgtgacggttgctgtgttgagtcacaatcttgagggatacattggccacagcctaaaaaccgtaaataagcaaacttataagaacatggatattgtgattttggatgatgcgtcatcagatgacacgatgtcagaaattaaccactgggcagctcgcgatgaccgcatgcgtgttattaagaataataagcgtaagggtgtcgcagctgttcgtaatcaagcactcaaccaaattcgtggtaagtactttatctttgtggatggggatgaccaattggcaccatcatttgtcgaaacgctggtcggtgccttggaagaaaatcctgatatcagcatcgcgagtgtcggctttagctggggcgctagtggtgcgccgaagaaggctcacgaggttaagttccgaaagattgatcgcgctggtatgtttgaaggcgtgacgcaccgtggtcacgtcatttcagggatggtttggaacaagatttatcgttcagcagatttgttggatagtaaggtccgcttcgatgaaacgcttgaattggccgaagaccacttgtggattgcccaagtagttgcgtcaaaggcaatgtcagagtactcgttgtttgcgacggacgttctttataacaaggtgtctcgttcaacgagtatcattcacactgcatcacatgctttgcgtgaacgtgagcgcgaaatcgatcaacaaatcgcccgcatcggtgatgacatcatttaatgagaaaacgctggccacttttcattggtcagcgtttttgttatgcttctccttaaagaacgggggaaagaaacatgcaattttatgaaccaacagcaaatgatgatgcaacaattgaatcagttattaagcaaccagggaagcaagtgatgtttttgcaagcggactggtgtggagactgcaaggcaatcaagccgtttgtacaacaattcaaagatgccgttactgacggtggggcaaattgggttgatgccgatcgtgatgctaatttggcaatcgcacaagaacaaggtttgatggggattccagcatttgtcttgtttgaagacggccaacaagttgcccacatcggtaacggtgaacgtttgaatccaaaggatgttcaaaattggattaatgaatacgttggctaatatgaaagaactctcatattagttgttgacattctaatttttagtgtgtatgataaagcacataagttaagacatgaattcggtgatgagaagagtagtgttacggatgaacccagaaagcgattggttgatgtgaaatcgtttcgttcaaggcatgaagatgagctcggagaaatgacgtcggtgcaagctgatgtcacggtaggaaccgttatcttccctggtttatccgcttaagtgcggcgaactgtagaggtgtatttggtgacgagtacataaattagggtggtaacacgattaaagtcgtccctagctagagattattctggctaggggcggctttttctttttaggcaccgcattcatgacgaaaatagagagtatttaataaacgaggtatatagattatggcaattgagattacacgcgcagaagcagatacattgttgaagacaccattgatttcaaagttgttgattgagtggattaagggtgaagaatcagaaaagttcccccttgcaaacttggcgaacgcctcagcgattttgtttgaaaacttgaagcaagttaactgggctggtttctacttgtatgatgaaaaggttgatgaattgattcttggacctttcttgggtaagccagcggttgttcgcatcaagcccggttcaggtgtagttggtgagtcatttgagaagcaagaaacaatcacggttgctgacgtgcacgtctttgatggtcacatcgcgtgcgacccagcatcaaacgctgaaatcgtggtgcctttgacaacggctgatggtaagcgtttgggtgtcttggatatcgattcaacggccttcaaccgtttcggggctaaggaaaaggctgagcttgagcacttcgttaagactttgttgcaatacatctaatcagaagtcactagacaatcctgatagaatagagttacaaaaataaagttaacgaggagtaagacatggcagagacattacactatgacgtggcaattattggtgctgggccagccggtttggccgctgcggaagatgtgaaggctgcaggtaagtcagtcgttttgattgaaaagtacctatggggtggcacgtgcccaaattatggttgcgatcctaagaagattttgttggccgctgttgaagccaaggaacacgtagacttcctacgtggggatggtgttgacggtaaggttgatattaactgggaagatttgatgggccgtaagatgcgtttcacagaagcaattccggacaagacggttcattcattggatgctaacggcatcggtcacatttacggggctgcccactttattaacgaagatacagtgattgtgcacggcgatgaagatgttgaagtgcaagcaactgactggattttgacggttggccaacgaccagctgaattggaaattccaggggctgaatacacaatcaattctgagcaattcttgagtttggctgagatgcctgaagatattgtgattattggtggtggttacatcgctgttgagttcgcatcaattgcagctgctgcaggggcacaagttcacttggttgttcgtggtagtgagttgttgtcagaatttgacgaggcgtttgttgatacgctatttgatcaattggatgaccgcggtattcgcatttacttcaacactgaagtgacggaagtgtcaaagacggatgacggttactcagcaacgttgagctttggtagcacaattccagctggtgtggttgtccgcgcggttggtcgtgttggaaacaatgacacgcttcaattggaaaatgccggtgtcgaagacgatatccacggtattaacgttgatgaattcttgcgtacgtcaaacccacacatttatgcagcgggtgacgtggccaacaccagcaagccacgtatcacgacggttggttactacgaggcacgttatgcagcatcagttatcctaggtcatgaccaaccaatcgaatacccagcggtgccggttgtggtttacggtacgcctaagttggctgcagttggtgtgccaacgcaatatgccgaggaaaacggttactcagtgcgtgatatcgacatgacgaactggtttacgtattaccgtaccggtgagccagctgcccgtgccaaggttgtcttggatgccgacaagaagttggtcggggcaacggtcttgagtgcgcatgctgatgagttgattaactacttcactgaagcaattaacaacaaggatggctatcaagcaatccgtgatcgtttgtacgcgtacccaacgccagcatcagatttggaatatttcttctaaacaaataacggccaggaatttatttcctggccgttttatttattgttgttgtacaggtgcactggtatgcgataggactgtcttgcagtgactgtcttgcagtcacggctaaccacaaccgtgtgcgttaattcgccatcttcaaacgttacttcgaccgttcgatcagttgggttgtagacttcgttcgttgcggaaactgaatctggattcactttggcagccgtagcggcggtttgcaatgctttctccaacatcgcactactatcttcctttttggttccagacgattgcaccgtcaaagcttcctcagcaccatgcaacacaccacgttgatagccgtttgagtgccctagaaaataggccgccgtgataattgctcccatcattaagatgaggcaaaaaataaccacggcgggtaaccggttcgttcgtttgtgaggctcgataggacgcatgcaactttctcctagaatttttaatacttaatatgcttaactatacccgcaaaaagttggggaatcatgccagaaatgacatgtaaacacgaactttgagtagcgattttctgaaaaacgcttgcaaattcgcgtacttttggtatatttgatgaaacaaatgagaacgtaatcgctatcggtataattgctggagaatggccagcgagttcctacccgtttcccaagagacggactaccgatagtgttttgagatttctaatgcacccattctgcatgcttttttgcgtgtgaatgggtgctttttagttctatcgaatcaccgagttggggtagtggttacacagaagagatggaggggtttgtttatcatggaagccgttacggaagttggggttacaacgaaatcaaagacgtcgaagctgcaagaagctgttttgggtttgcaacacgtcttagcgatgtattcaggtggtattttggtgccattgttgattggaacggctttacatttctcgccacagcaaatggcgtatctgatttcagctgatattttcatgacgggtatcggaacgctgctacaacttaaaagcacacgcctcaccggtattgcgatgccagttgtattgggatcagctattcagtcagtgacgccattgattaatatcggtagtacgttgggcattggtgccatgtacggtgcaacgatttcagcagggctttttgtgttcttgattgccggcttatttgcgcgtttgcgtgaatacttcccaccagttgtgactggatcactgattacagttattgggttcgcgttgattccggttggcattcaaaacctgggtggtggtgatgtcgcagcaaagtcatttggaagcgcagctaatttgtcagttggtgtgtttaccatggctgtcattattttggtcagcttgctagcgaagggctttacgaaagcaatttcgattttgcttgggattattctaggcacaatgtttgcgggtctgctcggtatggtttcgttggcgccggttgcacaagcatcttggttccatttgccaacgccatttttcttgggaacgccaactttccactcatcggccattgtcacaatgattataattgcattgacgtcgatgattgaatcgactggtgtgtacttcgccttggctgacctaacaggtcgcaagttaacgaataatgatatggcaaagggatatcgtgctgaagggttggctgttgttctatcgggtttgttcaacacgttcccatactcaacattctcacaaaacgttggggttgtgcgcttgtctggtgtgaaatcgaaggcgccaatttactacgctgctgggattctgttgttgattggcttgctgccaaagtttggtgctttagcaacgattatcccaacctcagtgttgggcggtgcgatggtgattttgtttggtacgattggtgtacaaggaacgacaatcttgcgcaaggtggactttgccaaggagcgtaatttgatgattgccgccatctcaattggggctggtatcggggtaacggtttacccacaaattttccaacacttaccagagttggttcgattggttatcgaaaatgcagtggttgtaacgtcagtattagcggtgttcttaaacatcgttttgccaggacgcgaaaaagaaacaggggatgaataatgaagttgctagaggaacgaattaagcaagacggacgcgtgattggaacagaagtgttgaaggttgataacttcttaaatcaccaggttgatccggctttgatgaaggcgatgggggatgaattcgcccgtttgtttgcggatgcgaaggtagataaggtgttgacagttgagtcttcagggattgcgccagctgtctttgcggcattggccttgaacgtgccaatggtgtttgcgcgtaagaagaagtcacttacgttgtctgaggaccactacacggcggatgtctactcattcaccaagcaagaaacaaaccacgttattgttgataagcgcttcattcaaccaggcgaacgtttgttgttgattgatgatttcttggcaaacggtcaagcggttgagggcatgatgcaaattgctgaagcggctggtgctgaagttgtcggggtcggcatcgtgattgaaaagacgttccaaaagggacgtgctttgttggacgaacgtgatgtacgcgttgaatcattggcccgcattgctgcctttgaagatggagaagttatctttgcggattaattcgagatgaatattcaccagatgttcatggtcttttttaaagaagaagagtagactgagggcatacacatggaggtgagtatcaatggcaaaaattgatttgggtggctcaggactaattgttcctgacgttgccttgggggtaatgcgtattgctgataagtctgctgctgaagcacaagctttggttgagaaggctttggaaaaggatgtgaacttcttcgacacagctgacatttacgccgcaggtaagagttcagttgttttggggcaagcgttgaaggatgccggtgtaaaccgtgaggacatcttcttgcaatcaaagggtggcatcatccttgaagatggccaaatttcaggtgacggctggaagggacctcgttatgacttctcaaagtcacacttgatctcagccgttgacgaagaattgaagcgtcttcaaacggattacttggatgtcttcttgttgcaccgtccagatacgttgatggaccctgagcaagttgctgaagcttttgatgagttgcaagcatctggtaaggttaagcacttcggaacatcaaacatgaacccatggcaagttgagttggtccaagcttcattgaagcaaaagttggttgccaaccaattgcaattcggtatcatgcacacgggaatgatcgactcagacattcacgtgaacatgtcagatgagcgttcatttgaccacgacggcggtatcttgtcctactcacgcttgaagaacatgacgattcaagcatggtcaccattccaatacggcttctttgagggaccatttatcgacaacgataagttcccagtattgaacgcaaagttgcaagaattagctgacaagtatggtgtaacgaagaacacaattgccgtggccttcattttgcaccacccagctaagatgcaagttattttgggttcaatgaacgtgaaccgtttggacgagatgatgaacggcgacaaggtaacgttgacgaaccaagaatggtacgacatctactttgcagccggaaacgatttgccataaaaagcagagcatagagcaacgatgaatcaactgattcattgttgcttttttattttggtaacataaaaaagcccgctgcaaatgcaacggactttgaatgataattagaatactagcatcacagcaccggcgattccgatcaatagaccgtaaacgacggccgggatggctgtcttacgcaagattgcgccttccttaccagccaaaccaacaacggcactggcagcgacgatgttgtgaacacaaatcatgttaccagcagcggcaccgatgacttgcaaggctaagatgattggcgctgacaagtgagcagttgcggcaacgtcagcttggataggtgagaacgtcaacgttgaaactgtggcacttccagtaatgaaggcaccaagttcacccaagaatggggcaacgaatacccaaacgccagccatgtgttcagacacagtcttggcgatgtaagttggcattgatggcatgttgatggtgttcatccctgagttagagaagacttgcaccataatcaacgtcaccatcaaggtgattcctgtgctgaccattgaggcagacacagtctttgcagctggcaagaatggcttaattgtacgggcttggacaatcaaagcgattaaagcagctaacgttaggatgaatcctggtgaatacaaaactggccaatctgagctgatacccttaataccaagaatgtttacccaacccaaatcaatcgcgtggttcatgaaatccttcaaccagacaatcgttcgtgatagcaacaagagcaccacaacgatgaggtaaggtgaccaagctgtcaacaatgacatatttcctgatgcgtgttgattaacctcttcgtcgttttggacaccatcgccagcgaaattcgcacccttccaagggttcgtgaacgctgtctttggtaacaagaaacgtgtcttaagcgtgataaccgcaataattagcaatgttagtggtgtcaaaattgacacgaattcatagccgatgaggtgcgcatacacccaagcgaaaccgttgtaggcgataccgatgaacaaagcccatggtgtcatctccaaccagtcacgggctgattttttgccacgattgaagaatgtgactaacagaataaccaacataagtggcatgaacgttccaccgaacaaatcaatcgtggtcattgaacgtgcaatttcattcatgaaatcagtcgcgtttgatggcgccacgttactcaacccaaccgttagtggtgttcccacagcaccataagcggctgaagttgaatcagcgaccaaggccaacgttacggcggccattggtgtgaagcctaaagcgatcaacaatggcgccgtaaccatagctggtgttccaaatccagaaacaccttcgatcaaaccaccgaataggtaggcaatcaaaacggccagaatacgcatgtcagctgatagcgattcaaaaccagcgttgatacgtgtaatagcaccggtgtgacgcaagacgtgcaagaccatcaatgccccaaacaaaatccatagaattggaaatgttttgtgaatcccttgcaaaattgatgccaacatgacattagttggaatgtgccagaagaaccatccggccagtgaaacgaccgcggcgctgatagccattcctttcatagccggcatattgaaaaccgccaacaaaatcaatggcagaacaactgccaaaagtgcaataaatagcatgtaacccccaagaaaactcgttttttcagtcctcttaattgtacagtaaatcacaacttaattggatagctgtccgatttttatacgatatttaatgacttgtcaggatttaaataaggcagaaatttagtataaatgttagtatcttctcattgagagaacgtttggttaatgtgggttgtggtgagtaaaatgaaatggatgcatgaaaagcaagaccgtaataagttgaagatgtttcgctaccttaaggagaacggggaagcgccaattacacaaattatgacagatttagatttgtcacgttatttggtgacgacaacggtcgagcaattagtggttgatatcgagattctcacaggggttcccgatagcattgtgattgaagatggatcagatgtcatcttcaagctaccaattcaattgttggattgggaagcgttgggattgcactacctgcaaatttcaattcgtgggcagatgattaatgacctgttccatgaacgcattacatcttgggaagatttcgcatttaaggttgatgtctcagtgccaaagatgtacaaggaacgtgcggcggttattgaagaacttgctcgtgaaggaattgaaatttctaaggattatcaattggttgggaacgaagcgcatattcgtttgtttaagctgcaactattgtcttattacaacggtcggcgtgaatcaccgttccctgaagaagtaagtgaacaatctcgtgaatcgattaagcagttgatcgagccggaatgtccatacttacgcgagacgcaagttgttagtttgcgtcatttgtatgcgatttggtggttacgactaaaaggccatcactatgtggatgcagccttagctgatcgctttttgaagccaactgagcaactttcttcaagtagccaacgtattatttcggctttgagcgcagagttgcgtaagttgccagatatcacggaggaacaagttcaggcagaggctcgctttatcattttggtgcttcatacgctatcaatttttccgcatgaaacggaatttgaagatgcgagtgaagaatcaattgcgcactggcgtctatttgaaaaggcgctccatgatgcatacttgtgcttgtttaagaatcgtggtcgtcaagaatcaattcgtgcggtgacgcgttcaatgcaaccgatgttgttgcgttaccttgttttcccatataccggggatgacgactttgattacatgatggaccgtgaacagttggcgccagaatttccaatggcctacgaattctctgaggatgtgttggagcgctttgcaattgaaactggcgacaatgaggcagattacaaaaacttcttgttgccgaatttgatggcagtcattatgatgtcagcggacttttatgatcgcttgccaattgttaatttaacgattgattttggggcacaccaaagccttgagcgagttgtggcacagtcattgcagatgttcccaggctacaaggtacagattaatcatttgttgaccgagcacacggatattttgctgacggatacaccgcaacctgttgatttagattgcacggtatttatttggcacggtatggggacacccaatgaagttggccaactccgtgatgaaattaatcgggtgaagatgaaaaaattcacagcttggcgtaacgaacaagctgaacaagattagctattaattggaccaagggcataagttcttggtcttttttgctggcggtgtacaatagacagtacgaatagaagtgaggtaacgcgagatgaagattggatttatcggaactggtgtgatgggccgaggcatcatcaacaacttgttgaaagcaaattacgacgtggttgtgtacaaccgtacaaaagcccacgcccaatccgtgttggataacggtgcaacctgggcagatggtccaaaggcgattgcagaagcagccgacttggtcatcacgatggttggttaccctaaggatgttgaagaacaatattacggtgacaacggactatttgctggtgcacatgctggtcaaattttcgttgatatgacgacgtcaacgccaactttggctgaacaattggctgctgatggtgagaagtacggggttaaggtgttggatgccccagtttctggtggtgatgttggtgccaagaacggtacgttgacgattatggctggtggtgaccaagctgcctacgatagcttgcaaccaatttttgatgttatttcaaaggctgcgaaccgctttggtgtcgctggtcgcggtcaacacacgaagatggctaaccaaattatgattgcggccacgatgctaggtatgtcagaaatgatggtctacgcaaaggctgctgatttggatgttgccaaggtgatggaaacgttggctgctggtggcgcacaaaactggtcattggataactatggtccacgtgtcttggcaggtgatttcgaacctggtttctacgcaaagcacttgttgaaggacttgcgtatcgcgttggatgaagctgctaagatggacgtgtctttgccagctactgatttagctgaggctttgtacacgaagctagttgaacaaaagaatctcggcgacgagggaacccaagcattggtaaagctttgggcacaatatgcatagaaacgatgaaaggcgactgaaaggttgcctttttttcatacaaaatacgcaacaagataatacggtttgtttaagatgataactgttacaatagggataataatatttaattactaatataaagctcatgagagggcagtactatgaatttcttcgttaatgcgacgatgccaaaccagaaatctggtattgagcacgcgcaactaaagcgttttgaattatttaataatcatcatgaagattcacgtgttgttttgcgcgattgggatccaattgctcacattaatgcgaatgcagctgggattccggatgagcaactcatcaacatgtttgattacttccaagaggcgatgactgtaacgccgaagacgttgcatgctgaggaccttgattttggtgtgccaggaaccgtgttggttgatgaaccagagaataaccgttacttggtaaatgcacaaaatgggcaattggtagcgcgtgttaattatgatgcgaccgctgatcgtcgcgttcgttcaacggaattgtttgatggctacaacaacttgttccgtgttgaccactatgactcacgaggttttgcctcattgttgcaatggtacacacctgacaacaagattgggacggaaacttgggtaacgcctgaaggacgcaccgttattgagacgttcaacaagaatacgatggctggtgagtttgtgaagtcgggctggcgtttgattgaacacaatggtcacgtgttgcaattcgatacgattgaagaattgacgaagcacttcttcgaccgtttgaatgatgacttctggcaggatgagaagccaaacgtgtttgtcttggatcgttcacacctgggtgattggggacttttgcgtttgcgtaagccggcttatatcgcaatgcacttgcacaattctcatgctggggatgcgcaagatccaatgcattcaattttgaacaaccactatgagtttgctatgaacgcgttgaatgaatacgatgctgtcgtttcagcgacacacaagcaaacgcatgatgtgaacgagcgtttccagcctaagacaaagctcttcacaattccggttggggttgtgcctgatgaattgttgaatgcgccgcgtgtaccagttgcacaacgtgaattcggtaaggttatcgcctttgcccgtattgcttgggaaaagcacttggatgacttggtacgtgccgttggtatcgtgcacaaggaattcccacaagtcaccttggatttgtatggttatgcggatccgactgataactacaaggcacgtactgcggttgaagaagcaattcgcgaatacaacttggatggtgtcgtaacgatgaagggttatacgacggatattgatgccgttgaaaacaatgccatgatgtacggtttgacgtcacgcatggaaggattcaacttggccatcatggaagctatttcccacggtttgattgccttttcatatgatgtgaattatggaccaaacgaaattgttgaagatggcgtcaacggaaacgttgtcccatacgaagactatcaagcaatggctgaggcaatgttgaaggtgttgcgcgaccctgagttggcacaacaatattcaacgggcgcatatgattcttcagaacgttattcagaagaaaatgtatggcaagcatggcgcggtttgttggatgatgctgagcgcgtttggccggctaagttggcggctatgccagcacatgcccatgatgcaaagtaggagtgtgaacaatgaattattttattagtgaaaatgtttttacatttaattcagggactgagcactcacaagtaaagcgagtgaagctgttcaatgcccaaggacaaccggcgctatatgtgacgcgtaattacaatcgctttttggcacgtgatgcagcatcaattggcttaaaccaagacgaagtgcttaatatgtatgactacttccagggaacgacggccgttgaacgcaaggaacaaccattgcgtttgttggaccaaattccattggatgagtatcacattgagggtcacggaccaaattactcaacaattaatcatgcaggtcgtgaattggctcgtataaatgtcatgccagcaacggttggtctagtgaatgatattctctactacgaccgatttggtaacacgactgcccgtgaaaattatgattggcgtggctttaagtcatcagttgattacttccatccgaatggtgcgcttgcggtccaaaaattcttgaaccaagacggtgtgccggtgattgaagtgatgcacatgaatgttaacggcaatattttgccaacgatgtacaagttgttgaactataagggacgcgattggcgttttaacacggaagatcaaatgttcttgttcttcttgaatgagctaacaaacgaaaatcctggttctactttggtgtcagatcgtcgtagtttggatcacgtggtggcggatgtacaatttgcagcgaagaagtttgcggttttgcacgacattcacacacctgacatcaagaacccagtgcgcggtaagctttacgatgcctacttgaacgttttggaacgtcgcgttaaggattttgatgctatcttggtcccaaccgttgagcaacaacaagatttgcaaaagcgctatccaggtgtgacattccgtgttgcgccagatacatttgtggatgatgcccacttggctgctgaacatgtgaagttgccagaacgactttcacaccgcattgcttatgtcggtcgtctttcaccggagaagcgtccagatcaagcaattcgtgcattggcgcgtgtggtaaagtcaattccagatgcaacgttagcattccatggttatccatctaatgctgatattttgaatgagttgaaggcgttggctaagcaattggatgttgaacaaaatgttatcttcggtgattatgtgactggtgaaaagctagccaaggcatacactgaggcacaagtgattgtccaaacatcagttgcggaagggttcggtatgaacttggttgaggcaatgagttacggtgtaccggtagtatcttatgatattacgtatggtacgaaggaactggttgatgacggcatgaatggttatgttgtaccagctggtgcgcatggcgatatggcggatcgcttaacggcgattttgtcagatactggtttgtgggcagctctttctgaaggtgcttaccgcaaggcacaaaccttctcagctgatgagatgatgccactttggcaagctgcattacagtaagaacgatgaaagattcagacctacgggtttgaatcttttttattgtcgtcattcctgaaactttgtaagcgctttattcacaactatcaactaaaattgaacaaagtacgattaatcggaatgttgattagcgtgtttaatcgcgagttattcataaaatcttggggcggatgatggcagaacgaccatatctttttgagaaactggcgatgcagggtggaaaagtgaattttcatcatgaaatcgattatatagaggggatgaagatatgagtcgagaagattatcaacaaaagttggccgacgaagcgcgtgtgcaaccgcaaacacacaaaaagatgtataagtctaaaaagcgctgggttatcgccggtatgacagccttggccgttggtggtgccacggcaatggcgcctgaagaggtcacgacgttaatgtcggatgtgtaccaaaccgcagaggaggttgtcggtggcggggctgcgtatgctgcctcggccgcaactgctgcggttaacacgacgaccgcggtcacggtgacggattctggggtggcgtcagtggcgtcgaatgcgaaccagacgggaacgttaacgactgcgcaagtgaatgcatcaatgcgtgcaaatggcggtggggctgcagcgagtgggtcaagctggcaaatcacacgtagcaatgccactagtgattttggaaatgtgcaatataaagagcaaatcaatgcgggcagtggtttcacaatcacaggtaatttcgcaacgacccaatatcaagctggaaattatcttgggttggcctttacgccagactttgcgcaaggtgccaagtatgcaaacggcggcaatattggtgaaaacggcatggccagcacaacctttgcaggtgttgacatgtggtacaacagtggagcagatgcacaaacagcttttgatttaaccgaaagatcagctggtcagatgacggccatgggtattcgacagacggacgccagcggttcattgattgcggacacgaacacatcgaattttgcgcaagtgatttcatcgattgcatatggaagtcaagcagatgcggcttcttggtcatactcagtaacgtgggcgccaacatcagttacggcgacatctgctactggaacgatgacgattacggcattaggttcaaatgctaagacgagtaatactcaaaaaacgattaccaagaccgtgaccatgccaattaatgttgttatgcaaatggttggaacaaacggtggggcaagtacgcctccgacgatgactggatcaattgcatctattcaacgtacggttgcaacgacgcctgttaacgtgacttacgttgatggtttcggatcagccttgatctcagcaactagtttcacagcccaaaactggacagctgtgggaattacaggtaccccaacgccaatcgcgacgaatgcgacggcttctttcgctgcaccaagtatttcaggttattcagcagttgccgtttcatatgcggccaacacgaatacaagtgcgttggtcacatctacaactaacttgttagtgacatcagctgcatcaagcaacaatattcaaattcaatataaggatattgaagcgccaaagatgtcgttgacgaatacggttacgtaccaacaaaacgagacgattaacagctctgacatggtcaatcgccttgtgacatctttgggggataactcaccaaaggcagtgacgacgagtttgacgagtggcagtatcaatactgcttctgcgggttcgtatcaagtccagattacagcaacggatgcggctggtaatgcaaccagctcaatggcaactgttacggttttgccaaagtcggttagtgcggtttcaagtgttgctagttcagcgtcatcagatgcctcatcagcaagttcaatgatttcgtcagcaacgagtgcggcgaagtcttcttcagcaagcgttgaagcctcatcagccagccaaacggcatcatcggccagctcattggcatcaaagtacagcagcaattcgtcagtcgcttctgttgcctcaagcattggttcgattgctgcgattgcaagtagtgcgaatgttgtagcgtcgacgaatacagcaattgcgaagtcggctgcatcagctgcttcaagcatgtacacccaaacgtcttcagttgaatctgcggcggcgattacgtcagcctcagcgtcatcttatttagctgccgcttcaagcatggccgcagccggacaagtgtcatcagctgctgatgcgattgcatcatttaacaatgcgtcgcttgcatatagttcacaagtgtcgtttgcacaaagttatgcgagcgcagccaagagcttgatggttgtgacaagttcagcgattgcggcggtatctgctgcacaattgcagacattgagcgctcaatcagcaacgacgagtttgtataatacgattgctgaacgatcattgacaattcaaattttgtacctagattcgcaaggcattacaacgtcttcttcagcggtaacgattagtggcgtaaacggcactagctattcatattctgtagcgtcactttcaggctacattatgaatcgtacggcggttaatggtactttccagtcacaaaattatgcacctaatgttgaatactcacctgcactttcagtagcagatcctggaacgtcactggcaacagcgcttagttcaattgcacagttgcaaagttcattgtcgatggctgtttcatatgcgcagtcaggtgaatcagttgtcgcctcatattcaaaggtggtttcatcgttggctgctcaaagcgcttactcgagtgacaagatgatgagtgtggcgaataagagtgcctcaacggcaagtaattgggcctctggcgcaaccaagggatttgtcatgacgtcttccacggcggcagctaacgtggcttcaagtgcagcattgctatcgatggttgatgctggtgttgattcgatggaaagcgcggcaaatgcctacagcagttatgctgctttggctgcttcagctaatacgaacggcaatactagtgcggtggattcatacacagtacttatgaattcagcaagctcggcttacaactcggtctacaataagcaaagtgtgcttgtttctagtcttgtgaaggatttgagcaatagttatttggctaatattgatagttacgtgtctgatgctacggatggtgctgacgtgttcatttcgatggcaagtacagctactagcagtgcattctctgttgcaactagcatcacgatgtcggctgcaactgcgtcaaatagcgccgcccaaacggcagcgacgaatatgtcgaccgattcaatcacggcttctaatgccgctaaggtagcatctacggcaaacgctagtgcgattacagctgacagcacgactgattcagctctgttagcaacgagttcagctgttaacgtgacctcaaaagctgcaggaagttcatatgcgtcaaattcagcagtggcaagtgcagccggtgccgcttcgacggcggttagtttggttgcttcagctaatgccgcggctggtttgcaagcaagcgtggcctctgcacaaaacgcaacagcttcaagcgctgcctcagttgtcgcgagtgcagctggtgtggccagttcggcagcattggctgcctcaagtttggcgacggtagcggctggtatttcagctaacgcgtcattaacttcgtcagctgcattgagctcacaacaatcattgatgagccaaatttcaacactagcttcaatggcttcgtcggcatcagcggcagcaagtgcagcggctattcaagctagttcagcagcctctgctggatcgacggctgcgtcagccgctaactcattagcaactatcgcaacgacgcaactttctagtgcaaatacagcagccgattcattgactgcactgatgtcagcgattgatgttgtgagcgctgcctcaagtgcagcgagtgcggctttggattcagcatcagccgctagcgcgaatgcagatttggctgctagtgatgcgcaatctgcagcgacaatggctagtgatgcgcaaacaaatacgactaatgcaaccgacgctgcaaacagtgcctcaagcaatgcatcagccgctttggattatgccaaggttggatctgaagcgggtaactcggcggtcgctaaggctgctttggatgctgacagtgcagctgcaacagctgcaaatgctgccagtgtggcggctaaggcttcaagtgctgcaaatgttgctgcgagtgaagctagttcagcagccattgcggcaagtaacgctgcaacgcaggcaagttcagccgcaacggccgcatcggtagctgcttcgactgctgattcatacatggccgctggtgatattacgcaagcgacatcggccgcggctgacgcgcaaacgttagctagtgcggcgagtgaagccgcatctacggcctcaagcgctgcagacgtcgccaattcagctatggcgcacgcagaagtggcgtcatctaacgccgctagcttggcggttgtcgcttcaaacgctgcatctgttgcgcaatctgctgaaacagccgcttcagctgcagcgggagttgatggtaagactggtgacacgggaatcgctgttgatattgattcagcagctgcctcaacggctaacgtgaatgcaagtcaggccgtcgttgacgcaagctcagcggcttcggcagccaattctgatgcgttagtgacatctaatatgaatagcaacgcgactgacagtcttgcttcgttggctagtgtggcaacggcgtcaagttacgcatctaattcagcaatgacatcagcctttgctgacgcctcgagtgctgctacggcagttagtgttgcaaacgctggtgccagtgaggctgcttcaaatgcgacgacacaatataaccgtgcgtcatcagctgcggttgttgcgtcgtcagcagcttcagtagcagcttctgaagctgtgttagcctcttcaatgtttacggctgcggactcactgttggcagctggtaattacagtgaagcgatggcgatgtctgatgcagcggtttcacaagctgccttggtaaatagcgcccgtgaagcagctgagagtgctgcaacagttgcatctggtgcagttgcgcttgctcaaagtcaagcggcgcaagcatcaagctatgtagctgatgcagacgcggctcgtgatgatttggcttcagcagccgatcaagtgatgacggctgcctcggctgctgatgaagcagcgaaggcaagttcagccgcgtcagcagcagatgagacggcgacgactgcgacggatagtcaagctgaaacgacggctgcaatgtctgacgctacggtgaatgtaacgaacgcaactagttcagctgcagacgccaagtcaaccgcaacggctgcaagttcagttgcagatgcaattggatcattaattaataattcagcctatgcaagcaatgcaacgattcaatcagccaacgatgtcgctgtatcagccgcaacggttgcatctactgcagcgtcaacggctcaatcagccgcgtcagcagctagtgacgcccaagcatctttggctgatgcacaaaaggtagttgatagcgcaacggccattgccgaagcggctaatgacgctgcccagtcagcttatgcagttgctagttcagctgcccaagaaggtcgttatgaaattgctagttcagccgctgcagaagcgattgcacaacaagcaattgctgaatcagcacaagcagatgttgcgaacgcgatgactgatgtaacggccgccgccagtgcagctagctcagctgctgcagtcgctaattcagcgaaggcgacagccgaaagtgctttacaaacggctaatgatgctttgaccactgctgaaacagccgctgaagcttctgaacaagcgtcgttggcgcaaagttcagctgaccaagcaagttcagctgcaacgacgacggattcaaccgctgatcaagtaaaggcaacttcaagcgaaattgccagccaaagtactgccacaagtcagacagcacaaacggcgacaacaacggcttcgagtgcctcagcagccgcaagtgcagctaaatcattagctgctgattctgcctatgccggtaactcagcgatggattcagtagcgtcagatgcggctactgctgcatctgatgcatcggcggcgggacaaaaagcagccgatgcaaattcgtatgctgagtacgctgatagtttggcgtcacaagcagcatcgaatgcgacttcgatggctaaggcagctgatgaagctgcatcaacagcagcatcattggcgtcagtggcaagttctgtagcgcaagccggtgatttagcgaccgcaagttcagcggccgacgctgcttcaacggccgcgcaaacagcggccgatatgtcgagcgccgcggtagtggcaagtgctactgcggatggttatcagtcaacggcagatagtgcagcgacaatggcctctgaagcaatgtcagaagcaacagcagcgtcaacggctgcatcaacagctttggcaaatgctcaaacagttgcgtcggcagtagcagatgcgactaacgcaagttcagcagctagcgccgcaagcaacacggttgcggacatggaaaccgcgacaagtatggcaggggatgcgacgagtacggcaaatgatgcggtgacaaatacaacgtcaactgctgatatcactaattcagcagcgtcaacggcaagttcagccaatagtgttgcacaaagtattgccgcgacagattcttatgctgacaacgacgccgtgaagtcagctgcatcagtggctagtgctgcccaacaaacggcggatagcgcgaatgcagttgccaagtcagctgcatcagaagcggccacacaacaatcgattgctagtgcagcgtcagaaaaggtggcttctgcagtaacggccgcgtcaacggccgcatcagaagcggcttcattggcgtcagtggcaaattcagccgctaatgcgggcgatgccgtaacggcaagctcagccgcaagcgctgcaagctcagctgcaacagtcgccgcaaatcaatcggcagcagcatcaacagccgcatcagaaggtgccgcagctgcatcagccgcgcaatcggcaacggatttggctaataacgccgaagcgacagcgcaatcagccgctgatcaggcagtggttgcccaatctcaagcaactgatgccgcagccgcaactgatttagcaaataatgcgaacgacgcagcgacgttggcttctgaaaacgccgcatctgctggggaagcagctaacacagctgtttcatcagtaacggatgcccaaaatgcagctagtgctgctggatcaacggcccaagtgacggcttcaacagccgcaattgcgtcatcgtatgcttcacaagctagcgacttggcaaatgattcagcctacgctcacaacagtgccgtacaaagcgcaattacagccgcaactagtgctgctgctgcagctaatgatgcccttacaacggcaaacagcgctgctacggctgcatctgatgccgctagtgccgccagtgccgcacaagaagctgcttcaacggcagcttcaacggcaagttcagccgccagtgccgcaagttcatatgctgaattggcttcaagtgctgctaacgctggtgataagtcggccgccgcaagttacgccacggccgcaaccggtgcacaaaccgcagcagcggcagcaatgagtgatgcacagctggctgctagtgccgcgtcggatgccgcttcagttgcaagctcatatgcaacgattgccgatcaggcctcaagtgccgctgatagcgccgccacggccgcaagtacggctctttctgagaccgccacggctgtcagtgcggcagataatgcagcgggagcagcaactgatggtattgcagcatctgtttcggcagatagtgcagccgctagcgctgatcaagcggtagatgatgcttcaacagctgctagctatgctgatagtgcccaatcttcggctgagcaagcaacagcaacagcatctaatgctgatacaactgcccaatcagccgctgatattttggcttcgagtgcctacaaggataatgtggcggtttcaactgctgcatcaacggctcagtcggcagccgataaagcaaattcagccaaggccaatgccgttcaagccgcttcggatgctcaaacagcacaagatgcagcgattgcagccgcatcagaagctgataagcaagcagatattgcggatgcagccgcttcaacagctgctgaacaatcatcattagctgcctcatatgcgcaagctggtgatttgagtgcggcaactaatgctagttcggccgcaagttcagcagctgcagtggctagtgccgctagtgacgcagcagcaagcgcagcttcgacggctaatgcagaaatgataaaggctagtgaagccgccagcgccgctgcaagtgcggatgccacagctagtgaagcattgtctgaagcacaacaggcactagctgaagccaagacggctgcccaagcccaagatgccgccaacagtgctttgaacagtgcaactgatgcgcaaagttcagccgcttcggctggtgatgttgcctctgaaacagcatcgacaagttcggagacggctgcgtcaaataacgcagcacaatcgacggcaagttcagctgcgattgcagctgagactgcatcaacggccgcaagcgaggcagcttctatggctgccgattcagcctatgcaaacaacagtgccgtgcaatctaacgccagtgctgcatcaacggccgcctctcaagcaagcgaagcgaacagcattgcccaatcagccgctgcagtcgcttcaagtgctcaaaatgcagctagtgaagcgacttcaacagctaactcagctgcaacggttgcctcatcggcagccgacgcagcaagcaaggcagcttctcaagcgagcgaagctgcccaagctggtgatttaagtgcagcccaagcggcaagctcagctgcttcatcatatgcagcgttggcaagttcagctgcctcaacagctgcaagtgcccaagcagacgctcaaacagcagcggatacagcaagcgcggctaattctttggcaagttcagctgcagccacagcatcgagtgcgcaatctgatgcaacttcttatgcatcggccggtagcgatgctgtcactgctggttcatcagcttcagccgcaacgaacgatgcaacgaatgcgacatctgaagcgactggtgccaattcagcagcggataacgctaatgtcagtgttgagaatgctactgctgataacgcaattgcgcaatcagcagctaacgaagcacaaagcattgcaacgaagtatccagctaatagtgcgattgcgacggcaaatagcacagcatcaagtgcagccagcgtcgctgactcagctgcacaagttgtgtcatcagctaatgtcgttgcccaatcagcagccagtgctgctaatgatgctgcgtcaaatgcaacagcagccgctagcgaagctaataagcaagcgcaaatcgcaactgatcaagccagtgcagctagctcatacgcccaagctggtgatttggctaatgcatcattggcctcatcagctgcaagttcagcatcggctgccgcatcaaatgcagcatcacaagctgcatctgaattgctagtagctgaaagtgctgcttcggtagctaatagtgccgctgctgtggcaagttcagccgccggtgtcgttagttcggcagccgtcgtggctcagtcagtgttagcagatgcgcaaacagctgctcaagcccaagatgatgccgatagtgccgcatcggatgcgcagacggctgatacgacagcctcagcagctagcgacacggcaaataatgtgtcacaaacagctagtgatgtcgcgaatgtgacctcacaagctaatgacgcggcaagttcagctgcgactcaaaagtcaacggctgatcaagcagcgtcttcagccagcgctaaggcagctgagtctgcttatgcaaacaacagtgctgtgcaatcagctgctgtcgctgccgagtcggctgcgatgacagcatcggttgctaacagtacggcgcaatcagccgcaagtgtcgcggatgaacagtcggcgactgcgacggcccaaaacgcaatcgcaagttcagccgcttcagtcgcaagttcggccgcagctgcagctgatgcgtatgctaaggcggccagtgaggcggcacaagttggtaattcatcagctgccgcaacgaactcggccgcagcagcgcaagcattgtctgaagctcagtcagccgccaaggtcacaagttcagccgctaatgcagctagtgatgctttggttgcagctcaatcagctcaaagtgaagcggctacagcagcgtcacaagcaagcgatgcgacagctgatgcaagctcatacgcccaagctggtgaccaagcaaccgcagcagcggatgctgccggaacggcaggaacggatgcaacgaccgctagcgatcaggctaagcaagctggtagcgacgcggacaatgcagaagatgccgcctcagacactgcctcgaatgctgatgcaacgaacacagcagcagagtcggcaacgaattacaattctgttgcccaatcagcggcctcagcagcggcagatattgcgtcaagttatccagataatgccgccgtttcaacggcgaatagtacggctcaatcagccgcaacggtagccagtgatgcagaatcaacggcaatagcagccaatgaaacggccagtcaagcggttctagatgctaatagtgctgcaacagcagcaagtgagtatgcttcaacagctgcatcgcaagcgaaggttgctgctgatcaggcaagcgcagcaagctcatatgcccaagctggtgatcgttcaaacgctgaagttgcctcaacggcggcatcaacagccgcccaagctgcttcggtagcgtcatcagcggcagcatctgagatggctgctgcaacgacagctaacgaaacggcttcaagtgcggcaacaactgcctcatcagctgcaacgactgctagtttggcagctgaaaaggctaagtcagctttggcagatgcgcaaacggctgccaaagcccaagacgaggctaaccaggcaactgaggatgcaaactcagctaatactgatgccgaaaatgccggtcaggctgccagtgatgctggtaagcaaacggctgatgcaaatgcgtcggctgataacgcttcaagtgccgcagtcacagcttcgacagctaattcaaatgcgcaagcagactcttcagctgcgaatgcgttgctagattcttcagcatatgcgcaaaacgctgctttgaataaggcaattgatgatgtgaattcggctgcgacaacagcatcgaacgcaaatgaagctgccagtgtggctgcctcgattgcttcaagtgccgccgcaacagcggattcagcttcaacggctgcttcatcagccgcaacagctgcaagtaacgctgctagtttggccagttcagccgccagcgtcgcgagcgaagcagctcaggccggtgatttggacaaggccactagtgctgcaaacgaagctgctgagcaatcagaagcagctgccagtgctttgtcgaccgcctcgagtgcatcagctgttgctagttcgatggctagcctagcttcaagcgctgaagctgtcgcgtcatcacaagctgaaattgcaaccgcagcagaatcagcagcctcaagcgccgcaacaacagcaagtacggccgccgctgcaacggatcaagcaattggcgccgaaacggctgataacaacgcgaagtcagcagccgcagccgcaagcaatgctgctagtgccgctggcgttgtggccggtcaaacggcagataatgcaagcgcgacggcatcagctgcttcaacggctgataaggttgccagtcaggcggatagcgcagcgacaagtgcaaatgcggatgcggcaaagtatccaaacaacagtgcggtaacgtcagctgcttcgacagcgacgagcgccgccggcgtagcggatgatgctgcgtcaacggcaagtagcgctgcgagcgtcgcggatgcccaaagcaaaatcgcaagtgatgccgctagtcaggcttcagaagcagccaaggcggctgccggtcaagaagtattggcaagcagcgcagccagtgctgccgaatcatatgcgcaagcaggtgacttgtcagccgctagcgaagcccgttcagctgcagatgcagctgctagccaagcggttgcccaacaagcaattgccgagagcgctaatagcaaagcgatgactgcttcgagtgctgctagtgaggcagcatcaacagcaagtagcgctgcgagcgtcgcaagtagtgcgaatgcagttgcctcggaagctgctgaaacggcatcgattgctgccgatgcacagtctgaggcggatgatgctcaaagtttggctgatgtcgcatcaagtgctgcgtcagcaacggctgatcaagctgaaacagcctcaaacagtgcgagtgtcgctaattcggtagctgacgatacgcaagaaactgctgagggaacatcagaagctgcaagtgcggctaactcagccgcgaaggatgccgcaagttcagcagcaaagtatccgaacaatagtgcggtaacatctgctgcttcagttgcatctgctgcagcgagtgaaactgatagcgccaatgccgttgcgtcaagcgcagcgtcaacagcaagtagtgctgcaacgaaggctgaaagcgcagcatcggttgcatcaaatgcaaacgcagttgctagtgaagctgctaactcagctgccagcgctgcaacagctgcctcttcggctgctcaagcaggtgatgagagtgctgcaagttcatatgcagcagttgcatcaagtgctgccgatgctgtgacatcactgcaatcagtcgctaacttagctgccagcgtcgcatctgaagcccaaagcacagcaacatcagccgcaactgtggccgatagtgctagtcaagctgccagtgaagctttgtcaacggcttcaagtgctgcgacaacggcgtcgactgctgctaatgcgcaatcacaagccgacgaagcagctaaggcagcctcatcagctagtcttgctaacacagcaacggatattgcttcagatgctgctgattccgcaacaagcgctgcctcaagcgcagcgtcagttgccgatgaagtagcaaataacgcaagttcagcggcttcagatgctactaatgctgcatcaagtgctgctaacgatgccacgacttatccaaataacagcgcggtaacgtcagctgcaacggctgccagttcggctgcttcggaagcgacatcggctaatgcggtagcaagttcagccgcatcaacagccgcctcagaagctaccaaggcagctgaggctagtgagacagcatcgagtgctgcaacagctgcttcaagcgcgacaacagcagcaagtacggctgcctcgacggctagttcatatgcacaagccggcgacgagagtgccgcaagttcatatgcagcgattgcccaatcagaggcgacggctgcaaagtcagctcaagcggttgcctcaagcgccgccacggctgccagtgctgctaatgatgctgcttcaagtgcgaatagtgttgcttcaagcgctgcccaaacggcaaatagtgctaatgagacagctactagcgaagcagcaactgcctcaacggccgcagttgctcaatcggaggcagatcaagctagcgaagccgcaacagctgcaagttcagctgcttctgctacgtcagaacaggccgacaagacggctagtgacgcggatgcaactgctgaagcggctaagtcaactgctagtgctgcttcaagtgccgcctcaacggcaacggtagcaaattcaacagcttcgagtgcggtagcggatgccggtaagtatccaaataacagtgctgcttcaagcgctgcctcggtggcaaccagtgctgcttcggttgcggagtctgccaacagtgttgcttcaagtgctgctagtgtggcgagttcagccgctagtcttgctaatgaagcgaatagcgtggcaaagaacgctgcaacggctgcttcgacagctgacaagcaggcctcaagcgctgcgtcagccgcctcaagtgccgcgcaagctggggatgcgtcagctgcaagctcatatgcgtcacttgcctcaagcgctgctgcagctgctagtgctgctcagagtacagcaacatcagctgcaagtacggctagtgttgctaacgaagctgctagtgcagcaaacgatgcggcatcaacggcggcaagtacagcaagctcagcaaatgatgttgttacaagcgccgcttcggctgcctcaacggctacagcagcgcaatcagctgctgatgaagctaccagcgctgcgagccaagcggatgcgaataacagtagtgccgcgtcacaagcatcaacggcaagtcaagttgcatctggcgcaagtcaggctgcgagccaagctgataagacagcatcaacagctagttctgctgctgaaaaggcgcaaagtgtcgcaacaaatgctggatcagctgctgccaagtatccaaacaacagtgcggtaacgtcagcggcatcaacagcttcaagtgctgctagtgttgcgcaaagcgctgcaagtacggcatctagtgctgccttggttgctgcgagtcaagctagtcaggcctcgagcgctaatgcggttgcgtcaagtgccgcaacggttgcttcgaacgctaatgacatcgctagctcagctgctgccgccgcaagttcatatgcgcaagctggagattcaagcgcggcaagttcagccgctagccaagctgccagcgctgccgctgtcgcaagttcagctcaagcagttgcctcaagtgccgctagtgttgcacagtcagcttctgaagccgcctcaagcgctgcgtcagttgcgtcaagtgcaacttcaacggcatcagccgcaaatgaaacggcatctagtgccgctgctgcaacatcaagagcggctgccgcacagtcagcagctgataaggaagctgcgatgaaccaagctggggatgctgctaagactgctagctcagcaacggcaacgacgagttcggctgctacgcaagcaacaaccgatgcatcggccgcaagttcatatgctaagacagcctcaagtgctgcaacggcaattggcagtgtagctaaccaaagtcactcacaagcaaatgccattgctaacttggcatcaaagacaactgatgcaacggtcgcttcggctgcagcacaggctgccagtgccgcatcagctgcggacagtgctgctagtgttgcgtcaagtgctagtgcagtggcccgaagtgctgcccaagcagccagcgccgccgcttctgaagcaaatgcgttgcatagtacggcgcaagttgctgagtcagctgcctcgatttacgcctcgttggcaacatcggctgcccaagctggtgatcaatccgaagctgattcatatgctgctaaggctgccagtgctgcgagtgaagcaactagcgcagcctcagccgctacaagtgccgctgccgtggctgcgagtgagacagcaattgcctcgagcgcatcagcggttgcaacatcagcgtttgctgaagcaacgtcgctagccaatgttgcgagtgccgcaatggtaaccgcacagacggcttatgaccgtgccactgcagaaacgacgacaccacaatctgtggatcaagtcgtggcgcaaacacaagacgcaaacgttgtaacgccggttgcagctgcctacgtggcagaaccgacgacacaaactgattcaggttcagtgacgtcggccacatcaggtgcaccggcaacgtctagcggagcaaatgtgttgccatacgaagctggtacgaaggctgatgagaagatcatccgtgcaacgccgattaatgtatcggccgagccaacggaaacaagtgaaccaactgacggaacagacgttaagaagcgtggtttgattgctggtgctttggcatcaatgctagccgccttgggtggtttgattggtatcaagcgcaagaagaacgacgataagtaaacaataaaaaaacaagctctcgagatttcaaattgatttctcgggagcttattttaatttcacgacaaaaagaaaagacccaatcggagcgacacttccgattgggtcttttctttagaggtagtgacgggaatcgaacccgcgatggcggttttgcagaccggtgccttaccacttggctacactaccaaaatatatttaaagttttataccacgaatacatattataggcgaaatgtgaacatcttgcaattcaataaggaactttcggagatgtcaagaaatttgctcacgcgatatggacaaaaatttaactactttacttctgttttctatcactgaaaagaaaaaccagccccgtattattcaaagtagggaaagtatcgaaattcttagggttttagtatacacaaaaatttgagtgactattgaggcgggaacaatgaataaaaacgaatttgcaaaggcggataatcacgccaagaaaaagcctgcatggataattgcaggaatgacggcacttacggttggtgccacgattgttggtccagaagtgattgatgaaattcaagttgagacgggtaataatgaaccgcgctcatcggttaaagcgaagaagagttcttcgccaattacaaagattggcgacatcttatttgacacgcgctcagcatcatctgatgcaattaatactgtgacggatgcgaatggtggtgatagtggtcacgcgtttacgtcaacacaaacacaggtgacgagtaactttacgggttccggtgcggggtttggtaatgcagcaggatcctatggtggccaatcggcgacgtttacatctttgacatcaggaggtcccagaaaccaaggtgcaattgcttttaataagcaattagacatgacagctaaatggacgcttacatttaatttaaatttaactaagtttaacagcggtggtgggcctgcgtggggagatccaaagccggctggtgacttcttgggtttgattctagcgcctgttagtccgacagcattgggtacctccgggggtggaggtggagaacttggaattggtgggggatctggagttggtatagcaaatgcggttgaatggggaattgatttctatccgaatgaaggtgatccgacaattgtggaaccatcttcaggtaacacgttgacttctggtgatgatggtactcaagttgcgggtttccgtacgacggattctacaggtactttgaataaggtaactagcgacaatggttttacatcgttcaatcatgatacgggtaaatcaatcatgggctttgcaggagatggacctaaaagcattaatgattcagaatgggcgggaaaatcagatcctaatctcgaagcgcaattcgttgcgacgtatacgtattcaaatggagttggcactcttattgtttcatcagtgccaggtagtggcggtacgtattcagcgactacgacgattccaattacggaaggtgttaactcaacgatgtcagttggatttaaagcttccgacggtgaccaatattcacaaaagggtgtaacaattcgtgaatttactctgacactgccgactgctgatacgacggttaactacgtcgacaaagaaggtaatgctattagtgggcatgcaagtacgaaaatcaaatctaatgtcaacgacacgttggaaatggtgacgtcaggcgcaaatactaatccaactggtacaaagcatacgtttacgccaccagagatttcagggtacacgtatattgggacgaagtatggggcagcaggaacgtcgactgctccattgacggtttctgacacagacgctaacaacattattaatgtacaatacgccaagaattccaagctgacaacggtctttgtggaccagaacggtaaggttctttcaactgtgccttctgttgaacttggaacggctggtacgaattatgatggccaaaagggaacagatgcaactgattatgcagattacacggcagcgttggcaaccgctaaggcgaatggttattcaggcgtcagcggcgtttactctgattcagcccttacaacaaaattgggttctgatctatcggcagcgacatttggtagcagcgacaagacggtctacgtgcaattgacgccagcgccacagacggcctcgattacgtacaacaaggcgagcgggctaagttctgacggtgcgacggcgcaagataatgctattgcgtcatcaccaactagtttgactggtgtaacgaatgacaagtatccatctaacacaatcaaggtgccaagcggtatgacggctaccatcaaggatgcagctggcaacacgctagacaccgatacatcaaaggcaacgcacttggtgaagaacagcgatggttcatacacaattgttggtgcatttaatttaacatcagcgggtgcgctagctgtacctagttttacggttacgtatgcaccaaacgctgcgaaaatgattcaacaatatccagatgaaacgcgtacggttgctggtacggcctatggtgcatattcaaattatggtgttgtgcaaaagactggctacgtgtcattcgttgatggtaccaaggcaaaccaaacgccagccggtaacttcggtgcgactgataaaacgtttgtgattacgtatgaagcggtacctgaagatgctggtgtcgtagcaagcgattcaactgtgacggcagcattggcagccgtaaatgccgcgactactgaggcagattaccaaacggcattggcagcttacaatgctgctgtgctagacgcgcagaagaagcacgtccaaactaacattgactcaattaacaacaacattgcccaaattcaaagtgatattacacagcttgaggcaattgcggcggacaacccaaccgacacagatatcgccggctggttggctgacgctaagacgcgtttgacgaatgcgcagacggcgctctcacaagcgcaagcggcattgactgcgttggatagcgctaagacgatggcagatgccaacgatcttgtagttggtactgatcaaaacagtgcagctgcggcatcggcgcaaaagattgcggatgacgacttgttgaacgcccagactcgtgctgcatcaaacttggctttggctaaggaagccgcaacgtcttcgatcacttcggtcacgaacgacaatacatcggcaacgagcacgatggctgatgacgtagctgaattggagcaattggctaaggattactcaggtaatacaacgatttcgaccgcgttggctgaagcgcaaaaggctttggaagatgctaaggctgcgcaagcgactgttgatgctgctgcgcaagaagtgccagatttgacgtcagtgcaagcagttattgcgcaacaaacagcagttaattcagctggtaaggatgtgcaaggcatgttggttgtcgcaaatgacgcggtgacggcggctcgagctgaagcggcgaaggtgcttgcggacgatcaggcagcagcaaaggcagcaatccaacaacaattggacgctgctgatgccaacatcacgacaattcgatcgaacattgatgcgattgaacaattgttgaaagacaatcctggggatgcagatattcaagcggcattggatgatgcaaatgcacaattaacggcggctaataagcaattggcatcgttggcaacagcgatgacggcatcacaagacgcaataacgccagcggaagtccaagcggcgcgtgatagtgcaacgacagccgcaacagcaattacagccgcgacgacacaatctacaacggatttggctgatgcgcaaaagaaggctgacgctaatttggcagccgcaaagtcggctgctgaaacggcaattggtgatcagttggcacaagtgacgaagaacattgcgcaaatcaatgatgacatcactgctttgacgcaaattgccgctgataatccagataatgatgaaattcaagcgaagttggatgatgccaagaatcaattgacgacagcaacgacgcaacaaacagcaatcaaggatgcccaagcggcaattgatgcggcaaccacagtagcagcagtgacggctttggaaaacacagccacaacggccacgactactgcaggcacagcgcaaacaaccgctgaccaagatttggctgacgcgaagacgttggcagcagctgatttgaaggctgcccaagacgcagcaacaaccacagtggatagcaacattgcagttattcaagatcaaattgaccaaatcacaaaggatatcgccacgattcaaacgttggctgataacaaccctggtgacacggacatttcagatgcattggcagatgcgcagaagcaattggataacgctaacgcagcattggcagacgcaaacacccaaaaggaagcaatcgctaacacgacaacgccagcggctgtggcagcagtaacggcggtagcagccgaggatcaagctaatgctgaagcggctggcacacagtcagcacaagatgtgacgactgctcaagctaagaacgatgccaatttgaaggccgctcaagaggctgccaaggatgctattcaagacaacatcaatgccattaacgactctgtcgcgcaaatcgcaaccgacgtcgcaacgttgcaaacacttgcagacaataatccagatgatcaagaaattgcggataagttggctgatgcacttacgcaacaaacaactgccaataatgctttgacggatgccgaagcacaattgaaggccgtggatgccgcaacgacggtagcgggcgttgatgctttgacaacgcaaggtcaaaaggatgaggacgcagccaaggcagcagctgatgctgtaagtacggatgtgacgactgcacaatcacaatctgcggacaacttgactaatgcgcaaactgaagccaagacggacattcaagcaaatattgaccaaatcaagaaggatcaagtagtaattgctgacacaatcgaatcactacaagatttggttgataagaatcctggtgatacggcgattgcggatgctttggcgaatgctgagagtcaaaagacaattgctgataacgctttgacggatgccgaggcacaattgaaagccgttgatgatgcaacgacacttgcagatgtgacgacaattactgatgccgcccaagccgatcaagctgcagctgataaggctgtgacagatgcgcaaaagcaattagatacagcaacagataagtctgcgaacaatttggccgatgccaagacagctgccgagactgccattgctgaagatatcgctgacattcaggagaatatcgatagcattcaaagcaatgttgatgacttgaagcaaatcgcgactgataacccagacaacacaacgattgctgacaagttgaaggatgctgaagcgcaattggccaatgcccaagcgcaaaaagaagctgctgaagcggccaaggatgcgattgctgatcaaacgacaattgctgacgtgcaaacacaaactgatgctgccgatactgccaaggacacttctgatacagatgccaagacagcggcgaatgatttggccgatgctcagacggcagcagcctctgacttggctgctgaccaagcgactgcgcaaaaggcggttgattcaaccatcgcaacaattgaagatcaaattggtgatattcaagatgacattaaggcattggaagatatcgcatctaagaacccagatgaccaagacatcgctgataagttggccgatgccaaggaccaattagcaacggctgagacggcgttggatacagcgcaagaccaaaagacggttatcgaacaagcgacaacacctgctgaagtggcagccgctgaaaaggcagcgactgatgctggcacgtcagcttcggatgccaaggatgcagctgaccaagatgtgacagatgcccaagccaagtctgaaagtaacttgactgaagccaaggatgcggctgataaggcactagatcaaaacattgctgatatcacgtcgaacattgacgatatccaaacgattgttgatgacttgcaacaaacggcaaacgacaatcctggcgatacagtgattgctgatgcgttggcagatgcaaagcaacaattgacggatgccaagacacaattggccgatgctgagacgcaaaaggataatgctgataacgcaacaacgctggctaatgtccagacagcggttgatgcgggtcaaacagacgctgataaggcagcacaagatttggagaacgcgcaagctgatcaaaagaccgctgacgagcaagcagctgcaaacttgacggacgcgcaaacaaacgccaagaacgcgattaatgctgacttggagacaattcaaaagaatattgatggtatcaacagcgatattagcgaattgacgcaaattgcagcggataaccctgataacaagacgattcaggataagttggcggatgcgcaacagcaattgactgaatctgaaaaggcacaaacggcagcgcaagatgctttgaaggctgttgatagtgcgacaacgccagctgatgtagatgcgcaagagcaaattgcgacgaatgccgtaacatcaacgactggtaacaaggaccaagctgaccaagatttggccgatgcgaaggatttggcagcttctgatttggcaactgaccaaacggctgcacaaaccgcagttgatcaagcgattagcgatattaacgacaacattgatcaaattaatgatgatattgccgaattgacggatattgcagccaataatcctgacgacacaacgattgctgacaagttggcagatgcaaagcaacaattggctgatgcgcaagatgctttgtcgacggcaactaatcaaaaggcagctattgaaaatgctgatacgccagctgaagtgacggctgcgcaagataaggcgactgaagcagcggcagcgggtgatactgcccaagcagcggctgacaaagacgtgacagatgcacaaacccaatcagatagcaacttggccgatgcgaagacggccgccaaggagtcattgcaagataacgttgatgcgattacgaaggatgtggcttcaatttctgacatcgttgaccaattgcaagaggttgccgataacaatcctgatgaccaagatattgctgataagctagcagatgcgcaacaacagttgacggatgctcaggatgctttgactgacgcgcaaaaccaattgaacacggttgatgacgccaagacattggctgatgtgcagaagcaagttgacgctggtacggctgatgaaaaggccgcagcggacgctttgacaaatgcccaaggtgatttgacggatgcgcaaaagcaatcagatagcaacttggctgatgccaaagagggcgcgacggcagcgattactgaccaaatcacaagcatcgatgatgatatcgctaagattaacgacgatatcgcagcattggagcaaattgcgacggataatcctgataacacggtgattgccgataagttggctgatgccaaggagcaattggcgaccgctgaaacggctaaggatgatgcacaaaaggcattggatgctattgactcacaaacgacgttggctgacgttgctgagcaagagcaagttgcaacagacgccgttagtgatgctgatacggctggtaaggcggctgatcaagatttggcggacgccaaggctcaagccagtggtgatttggctgaagaccaagcagctgcacaaacggcagttgataacacaatcgacaatatcaaggatcaaatcgctgatattaatgatgacattgccgaattgacggatattgccgctaagaatccggatgatactgagattgcggataagttggctgatgcgaaggaacaattgcagacggcgcaagatgcattgactgatgcgacgagtcaaaagtcggttatcgaaaatgcaacgacgccagctgaagttgaagctgctcgtgatcaagcaacaactgatggtgacacagcaactcaggcagctgaagcatcagcacaagatgtgacggacgctcaaacaaagtctgaccaaaacttggcggacgctaagacacaggctgagacgacgatcacggataacatcgcgacgattgatgacaacatcaagaacatcaccgatgatattgcgacgttgcaagatttggctgataagaatccagatgatgagaagattgcgggattgttggatgacgcgcaaacgcaattggatgaagccgaagcggccaagacgcaagcacagtctgatttggataaggttaaggatcaaacgacgttggctgatgttgccgatgtagtggcggacgcagctgatcaagtttccgaagcgcaagagaatgaaaatcaagcgcaaactgacgttgaagatgcccaaaagcaaagtgctgataatttggcggatgccaaggcacaagctgaggtgacaatcgatgaccaattgacggcaattgatgacaacattgcagccatcaataaggacattgaagagttaacgcaaattgcgacggataatccaactaacacggaaattgccgacaagcttgctgatgccaaggaccaattggcccaggctgagcaagataaggcggatgcccaagcagcaatggatgcgcttgatgatcaaacaacgttggccgaggtccaagaccaagttgatgccgccactgacgctgccaagagcgccgatggtgcgaatacgcaagcggatactgatttgaagcaagcacaggatgccgcagcagcagatttgctaactgaccaaacagctgcaaagacggctgttaaccaaacgatttcaggcattcaagatgatatcaatgccattaatgatgacatcgctgacttgaaggatttggtggctaagaatcctgacgatacgcaaatcgcggatgatttggctaaggcacaacaagatttgacggatgctaaggcagcgttgacgacggcgcaagatcaattgcaggagattgctgatgcaacgacacctgcagaagtggcggcggccgaagaaaaggcaacgacagctggtgcaactgctgacacggcccaaaaggatgccgctgctgcgttggtcgatgcccaagacaagcatgctgaaaacctagccaacgctaaggagacagcgacagatacgattaaccaagacattgcgtcaattacggataacatcacaaagattacggatgacatcacgcaattgacggatatcgcggctaagaatcctgatgatagtgaaattgcgcaaaagttggctgatgctaaggcacaattgacagatgcccaagcggctaaggctgacgcggagacgcaattggccgatgttgctaaccaaacaacgatggccgatgtgcaagacttggttgatcaagcagcaactgataaggcggccggtacgacggcgcaaacaaatgcggatcaagatttgacggacgcgcaaacgaagagtgctgaaaacttggcagcagctaaggaagcggccacggaccaaatcacggaacaattggtaacgattggcgacaatattttgcaaatcgagcaagatatcgctgatttggagcaaattgcgacggataatccaactaatgatcaaattgcccaagatttgacggatgcgcaagagcgtttgacggatgcacaagctgcccaaacagcagcgcaagacgcaaaggatgctatcgatagtcaaacaacgatggctgatgtggctgcccaagaagcaattgctgataaggcagttgcaaacgcagcgacggcacaaaagacggcggacaacgatttggctgatgcccaggcccaagcagccaaggatttggcagctgaccaagcagcagctaagacggccatcaatacgtcaatcgacaacatcacagatgacatcgtggctatcaacaaggacattgcggacttgaaggatttggtagcgaagaatccaggtgatactgagattgcggataagttggcggatgcacaaaaccaattgacgacagctgaagatgctttgtcagatgcgcaagaccaattggcagccgttaatgatgccaagattccggctgatgtggcaacagcacagtcaacagccgaaacagcagaagcgacggccgacacggccaagacgacggctgatcaagacgtcaaggacgcgcaaacgaagagtgacgaaaacttggcggcagctaaggatgcagctgacaagtcgattgcggataacattgcggccatcgaagactcattggcaaacatcacggatgatgtcgcaacattgacggatattgcagcgaagaatccggatgatgcattgattgccgacttgttggctgatgcgaaggcacaacaaacaacaactgaaaacaagttggctgatgcaaagcaacaagccgctgatgtcgcatcagctgaaacgctggctgacgttgctgacctagttgaagcggctacatctgatcaaacagatgcaacgacggcggagacgcaagcagataacgacgttaagagtgcccaaacgcaaagcaacgagaacttggctgcggccaaggcagctgctgatacgagtttggctgatgatattaagcaaattcagcaaaatatctcagacatcacagctgatattgcaaccttgcaagacttggctgacaagaaccctggtaataacacgattgccgacttgttagcggatgctaaaacgcaattgagcgagtctaatcaatcattggctgacgtgcaaaatacagctaaccaaattgcctcagctgcaacgttggctgatgttgctgatttggttgcctcagctgataagcaaacaacgctatcaaatggggatgcaacgcaagcacaaaatgatgttgataaggcgcaagctgaatcaaacaagcaattggcggacgcccaagataaggcaacgacaaatgcggataaggttatcgcgtcaattaaccaaaatattgccggtattgacgaagatattcgtcagttgcaacaacttgtgacggataatccaaacgatacggaaattgctgacaagttggcggatgcacaacaacaattggctgatgcaaacagttcattgtcagatgctgaagcacaaaaggatgcgattgccaatgccgaaacgttggctgatatcacagatattaacaatgcgttgagccatgatgatgcatctgctggcgtggacaaggaaacggctgaccaagatttggccgacgcccaagcaaaggctgccgagaatttggccgctgcaaagtcagctgctaagcaagatttgacggatgatatcgcagctatccaagatgatgtggatgagacacaacgtatcgttgaccgcttgtcagacattgctgcgaagaacccaggtgattcagaaatcggcgctgcgttgacgaatgcccaaaaccaattggacaaggctgagtcagcattggctgatgccaagaatcaattggcaacggttgatgatgcgaagacgctggcgcaagttgatgaaaagacggctgcaggggatgctgacgtggctgctgctgaagctgctcgtcaagctgccgatactgacttgcaaaatgctggtgcgaagtctgctgataacttgaataacgcgattgctgatgcgaataagcaagctgatgctaatttggctgctattcaagaagacatcgagcaaattaaggatgacattgcagcgttgtcaaagattgctgctgataatccaaatagcacgaagattgcagatttgttggctgatgccaataagcaattgactgaggcgcagggtcgttataaggatgcgcaagctgacaaggacgctctggctcaagccacaactttggctgaagtttctgatttgtctgatgacattgctgataagacaacggctgccgatgttgatcgtaagcaagctgaccaagatttggcgaatgctaaggcgacggcagcggacgacttggcggatgctaaggaagcggccaaggatgcaatccaacaacaattggaccgtgttgatgatgaaatcaagcaaattcagaaggatattgatgagttgacgcaattggcgaaggatcatccaaatacgcctgaggttcaacaggcattggatgatgctaagcaacaattggctgacgcaaaggatgccaaggacacgattgttgatcaattgattgatgttaaccaagctaagacagctgatgatgctaaggcaatcaatgatgtcgcccaagaagctggtgaaaaggcgaccgatgcggttaaggcggccgataaggatgtcgctgatgctaagaaggcggttgctgatgacatggccgatgccaagtctgaagcggaagatgctgttcgcgacaagattaacgagttgcgtgatgatgcttctcgtgtccaagacatcgtggatcaattgcaagatttggttaacaaccatcctggtaatcaagaccttgctgacaagctggctgaagccaaggatcaattgaacaaggtgcaatcagcccttgaagatgctcgtgctcagctggtagcaattgagacagcggaaacgccagctcaaattgacgcagcaacgaaccaaattggtgttgatcaagttgttggtaaccaagcaacgcaacgcgcagaacaactcttgcgtgaagcacaggatattgctaatggtctttcaacgacggcaacgattgtacaggcgcttggtagtggtcaatcagtaccacaaacagccatgttgccatacacggttactgaaacggttgttttgccaacccaagtttcgggtattgcgcaagcaactgaagcggtggcaacgcaagtcggtgagcaattgccagttgaaggtgtcgcggcttatgttggtcaacgtttgttggctgaaggtaaggcgacccgtggcgctcgtatccaagaccgactaattaagtcggatgatgaaacgaagactaatgatgctcgtagtggattctgggatcgtccatactatctaggcggacgatttagcaaggactggaacttacaaccatttacgcttgtaactgttttgttgttcagtatgttccttggatggttcttcttgccaacaaaaaagaaggaagatgaacaagattaaacgttgatatatcaacgtttcatacgaaaagcacacaatgaaaatgcattgtgtgctttttattttaaaaaaggggttgcaaagtgttcagaaggtatgtataataatttttgttgttgagcgagagatatcgcaaagcacaaaacataatggacgtttagctcagctgggagagcacctgccttacaagcagggggtcacaggtctttccgaccagttagccgcttaaacgtcactccaattttcggggttcagttcacgctaaaaattaatttagcgggtgctttttaaccgactaaaatcgaattagttgttaccttcaacgatttcagtcaattcttcgattgaagctgccttgtcagcaccttcagctgcgaagtcatctgcagaaactgcgtcttcaccttggttaccctcgatgatagcgtcagccatcttagcagtgatcaagcgaacggcacggatagcgtcgtcgtttgatgggatcttcacatcgatttggtcagggtcggcgttcgtgtcaaccatagccacgataggaatgttcaacttgtgtgcttcttgcacagccaattgttccttgtgaggatcaacgatgaacaacaagtcaggaatcttaggcatatctgcgataccacccaagaacttctccaacttctcgcgttgcttgttcaacaaagcaacttccttctttggcaaacgatcgaaagttccatcttctgccattgcgcgcaattccttcaagcgtgcaacacgcttttggatcgttgaccagttagtcaacgttccacccaaccaacggtggtttacgaagtacatgtttgcacgagttgcttcttcagcaattgcatcttgagcttgcttcttagtaccaacgaacaaaaccgtagcaccgttagcagctgcgtcgcgaacgtagttgtaagcttggtcaaccaacttcaccgtcttttgcaagtcgatgatgtagattccgttacgctccgtaaagatgtattctgacatctttgggttccaacgacgagtttggtgtccgaagtgaacaccagcttcaagcaattgcttcattgagataactgccatgagtatctgcctccaaatgtttttccacctagcctcgcatgtaattccgcgaccctttgcgggcacaccgtagaactattgagaactagtgagtaattttttatggtctaagaccaagaacaaatgatacatgattttgggtaagtagtcaactgctaatcccgttttgctggctcgaaatccgtcacaccatgttcttttaaaaatgccaccttatcactacgcttcaacttcttaaaagctgcttcagctttcagtgcgtctgacttattatcaaatgcctccgcgtacaacaacttcaaggggtggcgactagccggccgcgtgtacttggcccctttacccgcctcatgtgttgcgaagcgtttaccaacatcatccgtaaagccaccataaaaggtgttatcagcggtcagcaacacatacatatagtacggtttagtcattactcttgccttcgtagatgtcccaaacagccttcgtgtatgtatcatcatcattgtgcgtcacaattggtggcaaaatggtggcacctgttagtgcgccgtctttaatcgcatcaatcaacaagacgttggctggctcgccagcttttggatacacaaattgaatgcgcttaggtgccaaatgattcttctgcaatgactcaaaaatttcaaacaagcgatctggacggtgcaccatgaaaaagtgtgccttgttcttcagcaacttcttggccgtatacgttacaaggtccaaatcggccttaatttcgtgacgcgcaatcgcatagtgctcatcttcgtgcatcaccgtgttttcgttatcaaccgtaaaatatggtgggtttgatacaaccatatcggctgaacctggtcgaatatcttcgaaaatatcacgcatatctttattgataatcgtaattttatcagtcagattattcatttgaaccgagcgtgtcgccatatcagctaagcgttcctgaatttcaaccccaacgatttgaccggccaccttgtgggccataaacaatgacactgcaccgttaccagcacctaagtcaacattcaagccacgcccatttttacgaggttgggcaaagttcgccaacaaaacggcgtctaatgaaaaggaaaagacttccttgctctgaataatgtgtacttcatcgttataaagcatgtccacccgctcgtcgggtaatagtttcacgtccattacgttctcctgttagtttgccaagattgcctaacctgtgggataataaatcgttattattaggaggattaaccaaatgttctatacatttattcgttatgtcgctgccggagtggtatggctaattaacggccgttacacgttgacaggtcaagacaaactacctcaaggcaattatattttagttggcccacaccgtacttggtgggacccaattttcttcgctcttgctgcttggccacacaagtttagcttcatggctaagaaagagctcttcaagaatcctattttacgctggattttggttcacgccaatgctttttccgttgatcgtgaaaatccaggtccatcagcaattaagattccagtgaacaacctaaagaaaactgaacttggtgttatcatgttcccatcaggaagccgtcactcacaagaaatgaagggtggcgcaatgatgattgctaagttgtcaggcgccccacttgtgccaatggtctaccaaggtcccgttaagtttggcgacttgttcaagcgcaacaacgtgaagatggcatttggcgatccaatctacgttgacaagaagattaagttgactgatgaaacaatggccgagtttggtgatacattgactgaagctttcgataagattgacaagtcaatcgacccaacttgggtatacatcgaccctaagccaaagacagaacaaattgaatcaaagtaacgtaaaacgccggtcaaccaaatgaccggcgttttaattatgacttaaacttaatcgacaaaccaacacctgtgctgataatcatcgccaaaagcaatgacgtaagccaccaagatggctttgcgcttgtatcaggtaggttcacctctttatttagtgacaaggttggctgtgacgttttatcacccgttaacggtgacgtctcgggttgttctggattaattggtgaatcaggctcattcggctggttaggctcgattggcacaactgggtcaattggattcaagacgtttgtgaaattataaccgtcttgctttgttgtataacctgcgaccttttcttcacgaaccgtatagtcatatggtgtaccgttattatccgcttctggcaagttatcaaaatgatactgccattgcgttgctgcgcttacccgctgactatcaatcttttgaccattgcgatataaatcaatcgtaatcgcatctggtcgcgtgttcataatattattttggtcttcccacgtcttctgtccagaaaccgaaatggttcttggttggtgattaaacatggttaaatcaagcgtcacaagttgaccgtctactacggtaaacttgactggtgtttcatctagcacgtaacctgttggcgcttttgtctcaataaaggcgtagtcaccaggtcgcaagacacctgagtgaatcgtcccactctcatccgttgtcaaattttcttttacagttcgacccttggcatcaaccaatttaaagacagctcccgctaaaggattaccggttgcttcatcagtcttatgcaaaagtgctgagtcgatatacgtcgtaacatcattactaaagattgttgatccagcataggtgtaactagctttattaacaactttagcaacaccgttatcaccaaccagcttaacgttgaacactactttcgcgtgttgtccaggattcaaatcatgttgcaacacataactaacggttcgtgttgcttcatcatacgtcacatcagaataatcactattctcaacagttttactgaacgtcacaccttctggcaacggatccgaaaccacggtccccgctggaataacaccttctcggcttcctaaatccagcccatactgtaacgttgccgtttcagacgcaacttgtgttttatcaaccgtcttcagcaaatagttcttttgaaaactcgtatcagataaaatcagtggcacctctgcctcgtagagagcattaccattctcacgcatttcggcgtgattgtattccgtgccaaacttttccgaatcttgatactcatcatcaaccgaagcgccataagaaataacataactctcgtccgcttcaacacggccaaagtgcaccgataccgtcttatcagttacctggatatcgttagcaaactgatccgtgacgtactgcgcatgcttattaccttgttcatcaacaagtaacacgataaatcttcaagtgctcgatattagcatcgtttccggtggccgtcgggaaaatgctgtatgaatcagccagtgatagcccctttggcaattgatcaacaaccgtcaaatctgaataagtctgttcattataattaacaatcaaaacaaaattattatcactcggatttgttgtactcatcacatacttaaattcaccgttaacattagtaccaggtgcatttgtgtacttcgtgaacgcaggacgctccgattttgatggtactgtttcaaccgtagtctgatcggaacttagcgttgtcccgttaataattagcgcattgctgaagctaatttgctcaggcacagtgctgtgatcttcaaaatacgatgctcggaaacgaagtgtaaacgtatacccattggcagattgttgatcaatttgacttggatcataacttaccgtcaaaatgtaattaccctgaccatcgtcagttacggcattattaccgacataaaacggcttatcaatccgcaatccggtttgaagctgcttggcatctgccacaatcgttttcggaattttaacctgtatctcacccggtgtctttaacttccctgccgatcccgccagcgtaactgtcaaatcgacattgccgtttgactgaattggcgaattagccgaaatcgacacacccggatcatctccggcctttgccaaagcatgaacacccatcaatccggtcccacacgcaataactagcagcatcgctagcactgcattcagtacctttcgcattgcctcacctccactatttgaataacaaactaactttagcaaaagcaacgcgattggttcgacggaaatttttataaaataaaaagactacctcaaaagtagtcttttaaacaaattacttctttgaagaagcttgtgattgtgccttcatttgagccatcatttggttcaaacgtttttgtgaaggcttttgccccattgaagccatcattgacttcatcatctcttctgagataggtgggttgttcttcaagtacgtttgcattgagcgacgtgccaagaagaaccctgcaactgcacccaagactgcggcaaggatgacaatcaaaatccaaatactagtgctcatgatattactccattatgttattcgtatattattgtagcgaataaacgcccgtttgactaggttatcctgggtttcttcccaaaatattcactagttgtcacgcaatcccttatcacgttgaatatccttcaccttttcaggtgtgacttcattaccgttttcatcgaaaacttgcaacatctcaacttgtgaacggaaagcagccttgaagttatccaagaactccgtacgcaattctgcacgctctgctatttcgtcgtcagtcaatccttcaggcgtcttcgccttggctgccaattcattaatgcgggtacgcacagccatcatacgttctgtttctgccatggttttcaccacctttatctgcttttcatctattttaacacgaaaacgtaatcattcccgcctccactttatttccacccgaattaaaagtaaaatagatagtaataaattcgaattaggaggttatgccgcttatggccgaaaaagaaagtaatcaaattgcgatcctccgttttgtttacgaaaaacagctggaaaaaggctatccaccaaccgttcgtgaaatcggtgaaggtgttggtttatcatcgtcgtctaccgtgcacggccacttgagtcgtttacaaaagaaaggtttcattcacaaggacccagataaaccgcgtgcaatcgatgtcacgccagaaggtatcaaagcacttggcctccatgaacccaataagaccatgatgccgattatggatgaaaacgagcccatcacatctgatgaacatttgagtaatcatatcgtggattacttccctgtgccagatgatttgattcgttttgaaggtgacttgttcatgattcgcaatcgcggcaatgccatgattaacatcggtattctagatggcgattatatgattgtgcgtcgccagaacgacgctgacaacggggacatcgttgttgcaaggcccgacaacggccaaacacaaatcaaacgtttcttccgtgaggcctcacaatatcgcttacaaccagaaaatgacaaccacgaaccagttatcaccactggcattaccattttgggtaaagttgtggggttgtatcgcgactcaatatactaaaaacaagggtgcggacaactgcacccttgtttttagttatgtcggaaatctattatccttgaacaatttccaccattttctttaacttatctttcgtcttcttcgcaacaattgtctttctaaccattcccgctgtcgtaggattaaccggttcttcagactcgtaatctaaaaattgccaaccactatttttaattaatgaaagatgttttgtggcgtaataatcattaccaatgtttattgcaacccctggatgatttagaagtatgcccccaatcaaatgaaaatggaacctagtcgaaatccatgtttgtttttctttattaggcaatccttgatgccaaagatggaaaaaattgaagaacgagaatctttcgtctttattgattacatcgttgaaggcatccgaaaagtacggccaattgtcttctggaaccaaagcctctaatatgccaacagtctttccgacattttcttcagcatttaaaaaatcagttatttcttttacaatctgctgtcggtgcgtattgtctgaaatatcttgcaaatcaattaatatatccggattatcttctcgcgtatcaagctttagcgcctccaacattttagaaacatacacatcatccaattccagcgtagtgttcgctactttcgatgattcaacatcacgcacacctaagtaatcaaacacccccgttgtggactccagcattttttgcgtttcttctgctataggcgtaagaccaagacccgtcccataaactttcgtatctgtggctagttctttttttgcagcaaaaatcgggaaaaagtaatacgtattgacaaaatcaacattagaagttgtgaagtaccctccacccaaaagttgaatttgatctgctgacagaaacaagtctagcccttcccggttcctggggtcaccacgaagcaatacatcttttacaccttgaacatcatctaactttatttgtttgtgcgccaagaagtgaataacattccaaagtgtgtcaactatcgtaaggttgtcaaattctcccttaaacaaaaactgagatctcgatgctgcgggcacgtctagtataatttttgccgaaggattcttttgcctaaaaattgttaaccacgttctcacaatttgttcatccccaaaattggggaaccctgccgttgaaactaaatagtaaacctcactcatacacttcacaccctctaattaatgttttttccgtctgaaggccaattttatcaaaacattattacaatttatgctgtataaatatgacgcatgttactattcgaattagaatatttgtataaatataaaaagcaatgcaagtgtatgcctgcattgcttttaaactagatttcgtttttattagtaattcatcaatgccaacaactcgtaaccgtcaagacgatcacgaccgtgcaatgcattaagctcaatcaagaaagccaaaccaacgacttcaccgcctagagattcgaccaacttgattgtggcttcgatcgtaccaccagtggccaacaagtcgtccgtaattaaaaccttatcaccaggcttgattgcgtccttgtgcatttccaaagttgcttcaccatattctagcttgtagctttggctaataacttcgcgaggcaacttgcctggcttacgggctggaatcaatccaatgcccatttggtgggcaactggtgccccaaccaagaatccacgtgactctggtccaacgacaacattaacaccacgttccttggcgaattcagtaatttgacgcgttgcttccgcataagcggcaccatcggccaacaaaggcgtaatgtcgcggaacgtaaccccttcttctgggaagttagggattgaggcaacgtaatcatgcaaatctaacatctgcttagctctcctgcttacttaggttcgtgagcaatgattccaattcagaagttgaactgtaaatcaattgctcttcaagttgccgacgagccaggaattgctgataactagcagtttcctctaacgccattggcgctggctcaggtacggcatttaaaacaccatcaactattgtaacaaacttcgcgtccaaaaacacctgtaatatcaaggttaacatcgaacgttccatccccaagtgcgccaaaaccgcatcatattgggttctcagtgcaatatcttggaacgaacgggcaaacttgtacaccttcgcaaagtcggcttttgaagggactttttgcaaatatgccggtgttttcgcataaaagattggtgccaaacgacccgctggcacaaactttagcaagtcggccaattgtgacatatcctcaggtacatccacaaaggccattgtgccgacactggttcggttaaaggcatcttcccaatacaacgcttcagctggtgccttaattgttggcgctagttgttcataatgcttcttgttaaagaaaatatacgtggctgggttagcaaacgtctgggtcgtcaaacgcgttgtacgccagtctaacaatgatgagcccttagcttcgatatccgtgagcatcatttgatatgacacatccccacggaaactattctcactcatcgtcccaacaatgcgaattgactcaaaacggcccgccaggtcttcagccagtggtccacgaccaaacgcgaccactggcaatgtaccggcagctgtttcggctgtaaagcgcaagtgcttaccttcactcatcgtcttaacgttctggacgcctgccaaattaacggcgaacaatggttcaggattcccttcaccaaatggtgccagcacctgcaattgctcatagttttgccggttaaagtccttggctgttacttcagcagcgattcgaatttctggcaaaccagcttccgccaactgttgattggctgcctcttcgcgcaaaacatcacgtaccgcttgcaaattggccgttggaatcgtcataccagccgcgctcgcgtgaccaccaaacgcagtcaacagatcacggtggccatcaagtgccgcgaacaaatcaaaggcggccaccgaacgaccagaccccttcatttgaccatcttcgtcattcaagacaatcgctggcttgccagttgcttcaactaacttgctggcaacaatccctaaaacaccttcgtgccagccactgccagcaaccaccaatactggatttgctgcaagtgtggctgcttgagcaagtgcttcttccgaaatcgacgccaccaagtcttgacgctcacgattcaacttatcgatgcgcttagctagttcactggcttcctcaggatcatctgacaacaacagacgcacaccgtctgttgcatcagccatgcggcccaacgcgttcaaacgtggtccaatcgtgaaaccaatcgtcattgaatcaatgtcagcttgcgcagtaccggcaacttctaacaaagccgccaaaccagggcgtggatcttctttcaagtttgccaagcccatcgccacaatcgcacgattctcatcgaccaactccatgacgtcagccactgcacccaaggccgctaagtccatcacctcatcggctggctcttctagcaacgctgatgccaccttaaaggccacaccggcacctgaaagaccgccgaatgggtaattgccctccgggtgtcgtgggtgcacaacagcgacggcatctggcaattgttccggcaattcgtggtggtcggtcacaatgacatcaaccccattggccatcaaccagttcacttcttcgcgaccagagacaccgttatcgaccgtaatcaacaactgcatcccttcgctagccaagcgttgatattgtgccatatttggcccgtaaccgtcgttaaaacggttcggtacataataactcacgtcagcgcccatcaactcaagcgcccacgtcagaatcgctgtactggtaattccgtcgacgtcataatcgccgtagaccacaattttttcgccgttatcgatagctgtcatgatgcggtcaattgccacatccatgtcgtgcaacaaaaacggatcatatagcgcatccatccccggacgcaaaaaggcattggcactttcaacagtgtcataaccacgatgaactaagattttagcgaccaaatctgaaacaccgaatgtctcagcgatttctttggcagccccttcattggctacagctggaaaatcccattgatagcgtggtgatatcatcgtttggcctcctatccttctagttcttcatcatctactggtgttaatttgattggcttgctgttgctttgcttaccgaacggaatttcaaaaacatcaaagtcattcacaacccgcgtgttttcaaacgtcgtacgcgcttgataggccaactcattcgctgacttacccgcatagcgtgctgaaatgtgcgtcaatagcaaacgcccagcaccagcttcctttgccacatcagcagcctgcatgctcgttgagtggtagtgattacgggcttgcttaccttcacccttaccgtaagttgattcgtgaaccaaaacatcggcatcacgtcccaaaacaacagaattaggtgtcttacgtgtatcacctagaattgtcactgtacgacctttcttggccggtccaataacatcagtactcttaattgtgcgtccatcaggcaacgtgacgtccttaccaagcttcaactcaccataaagtggtccagcaggcacattcatctcgcgcaaccggtcaaccaacaactcgccggcgtggtcatgttccacaacacggtagccaaatgacaaaatcttgtggtccaaaggcaaagcggtcaccgtaaatttgtccgtgcgcaatacttcgccaccttcgttaggcaattccacaaacttaagtgggtatgtcaggtgcgtttgcgcaacacgcaaactcgtttcaacgaattgcttgataccatggggtccatagataaccaattcatcttcaccgccttggaatgagcgtgatgacaacaatcctggcaatccataaatgtggtcaccgtgcaagtgagtcacaaaaatcttatcaacctttcgtggtcgaattgttgaactcaacatttggatttgtgtaccttcaccggcatcaaacaaccaaacggaattaatttcttcaagcaggcgtagcgcgatactcgtcacattacgaaaacgcgctggaacgccggcaccagttcctaaaaactcgatttgcatggcttcggaactccttatctttcatctctaccaaataaaaaaccgccatactgacggtttaaagctaactattagtttaccatttttaacaagtgtttgacagtccgtgcccgttagaatttaacttcaagcggctttgacgcatctgtcaattgttggccatcctgataggttggtgcaaactgcaaggcaacactattcacggaaatggctagcgatttaggtaccagcaacacgacaaacgtttcctttgtctgcccggcttcaacgccattcgtaagcgtgtgatcgttatccaagccaccaccttgcactgaaacaatactgccatccgtaaatttagctgcgttaaccccatccgtaaccagtgttttagcggcattattggttaacgtatagcgaacaattaacgttgtataatcgccggtaatatcacgcgtattaaacgccatttgtgccatttgaattgcttcatcagtcgcaggtgtattcgccatttttctaatagaatcaaccttatatgacacttgaccattatccaattggcccgttactttcgactgtgccgccagctcagccttattgccttgttcgttaatggtgtattcaccgactttgctggctgcaccagaagagacatatgaactattcttcaaatctttttccggaattgaatagctactcttctttgcgaccttgccatcttgcaaaggtttcgtgaccaccgctttactagtttcaccctttgcttggccaccattagtgtcatgcgttagcaaaactgctgccgcaccaccaccgacaaccaaaacacctatcagcgatccgattaccgcctttttcatttcaaatacctcacctttaaaactttacctttaacggctgtgtcgcattaaccacttgaacaccccgtgaatcaaacaccgctgaaaattgtagcgccatttcatttactcgcttacccagcttcttcggtacaactgctgtgacggagccacttacgctgtcacccggcacaacacccatgcttaaaatttgaccattgttaatcaaccctgtcaaacgtgacattgtctcagcatgtctaaatgatgctgtcgtcacacctcgcgtggcgaccgtccgaagcgagttattcattagcacgtaagacatcgtaactgtgtaatacgtcgccggcagatcaggtacgttgtacaagcgacgtgcaacgtttaaagccttgtcgtcacgcgccttttctcggacaacagctacaccagtcaccgagtacgacatgtcgccatcttgcaaccgctcatcaaccgacttaagtttcactaatttttgttcgataccatcggcagtcagacgatattgtccaactcgactcaactgaccttcgccaacaaaatttgatgattctcgatccacatccgttgcctggccaccattaccagatgaagcttctgaagactttatcattgatttcgtctgtttagtcacgatgttttcagcaatcgtattttttcgatcctgattatgatccgagacataaaagaatatgccgacactcccaatcacaatcactagtaagctgaaaatcagccatcctaaacgtttctgcatgtctctctccaattaccccagtaccaattgttctgccacgacccgatagccaaacacggggtgcagttgttgtgcctcatcacgcacaattaggtttaaattattatcttctaaagcaatgacatccgacaacgtgacttgccggtcaacatcagttccaaacaccaattggtcagaatcaatgccaaccaatcgcaacggcacaatgttgtcatcaactctagctgccaacagccggtcaactggcataccagccgtcgacaatttcaaatctgctagcaacatttgaatcacctttttcctattagcctattttgccataaaaaaagatgacgaaccttaaaaggctgccatcttaacttaaaattttcgattaattaaccgaagaaccccttcttgtgctcaccgctcatcgcagcttggaaggcttcaagagccttcttttggtccttgttcaacttctgaggcacatcaacgtaaatcgttacaatgtgatcaccttgaccaccacgcataaatggcgcaccttgaccacggagacggaagttcgcttcggttggtgttccggctggaatcttcaacttcttcaagccgtttacggtcttaacctcaatttcaccaccaaggaccgccgtagcataatcaatcgcaacacgtgagtaaatcgtgccaccgtcgcgctcaaagccatcctttgaaggtgcaacacggaagaccacgaacaaatctccgtaaggaccgccgttgtaacctgcttcaccttgacctgacaaacgcatttgttgaccgttttcgacaccagctggcaccgtcaccttcaactccttgctctcttggccaccgttctccgttgaacgcgtgtatgaaatcgtcgtttccttaccaaaaacagcttcctcaaacgtcaagttcatgcgatattgcaaatcttgacccttgcgagggcgattaggatcttggaagccaccgccaaacatttggctaaagatgtcaccaaggtctgagaagtcgccgtattggccaccaccaaagccaccgaaaccgccttgaccgccaaagccaccagcttgaccatcggttgcaccgtattggtcgtacatggcacgcttttgctcatcacctagcgtctcataagcttcttgaatttccttgtacttcgcctcggcaccttcctcgtggttgatgtctgggtgatacttctttgatagcttacggtaagccttcttaatctcatcttgtgaagcgctcttatcaacgcccaaacgctcgtagaactctgtgttgttcatgaggccaatcctcccaattttctcaatatgtatcacaaagcgaggcgttgcggcctcgcttcgtgtcactcagtaaccataggggtagttaagagtgtgtttttagttactaaattacttcttgtcgtcagaaacgtcttcgaagtcaccgtcaaccgtgttgtcatcgtttgatgcagcaccatcagcagcttgagcaccttgctcaggagcagcttgttgatacaacttaactgccaattcttgggcaaccttctccaaagcttccttctttgtcttcatgtcatccaagttgtcagcttccttagcagccttcaactcagcaacagcgtcttcaactggcttcttgtcagtatcaggcaacttgtcgccaacttcttccaaagtcttttctgattggaagatcaattggtcaacatcattacgcaagtcaacttcttccttacgcttcttgtcggcctcttcgttagccttagcgtcattcatcatacgctcaatttcttcgtctgacaatgaacctgagctttggatcgtaatcttttgctccttgttcgttcccaaatccttagcagatacagaaacgataccgttacggtcgatgtcaaacttaacttcgatttgtggtacaccacgtggtgcagcaggaatatcagtcaattggaagcggcccaacgtcttgttgtcggcagccattgaacgctcaccttgcaaaacgtggatatcaacagctggttggttatcagcagccgttgagaatacttgtgactttgacgtaggaatcgtcgtgttgcggtcgatcaacttcgtgaacacaccacccatagtttcgatacccaatgacaatggcgtaacgtcaagcaaaacaacatccttaacgtcaccagtgataacaccaccttgtacggcagcacccaaagcaacagcttcgtcagggttgattgagtgatctggctccttaccagtcaaggccttaacagactcttgcacagcagggatacgcgttgaaccaccgttcaagataaccttgtcgatgtcgttcatcgtcaaaccagcgtccttcaaagcgttgcgaactggctcttcagcacgctttaccaagtcagccgtcaattggttgaattgggcacgcgtcaaagtcgtttgaatgtgcaaaggaccttcgttcgttgccgtgataaatggcaagtcgatttgtgcttcgttagctgatgacaacgtcttctttgccgtctctgcagcatccttcaaacgttgcaaggccaacttgtcagccttcaagtcaacaccgtgctcgttcttaaagttctcggccaaccagtcgataaccttttcatcgaagtcgtcaccaccaaggtgcgtgtcaccattcgttgacaaaacttcgaagacaccatcacccaactcaaggatagaaacgtcaaacgttccaccacccaagtcgtaaacaagcaccttttcgtcgttctccaacttgtccaaaccgtatgccaaagcggcagccgttggctcgttgatgatacgctcaacttccaatccagcaatctttccggcatccttcgtagcttgacgttgggcatcgttaaagtatgcaggaaccgtgataacagccttatcaactgtctcgcctaggtagtcttcagcgtacttcttgatgtattgcaagatcattgctgagatttcttgtggtgtgtagtccttaccgtctacagtcaccttgtagttggcatcacccatgtgtgacttgattgacaaaatcgtgtctgggtttgtgatggcttggcgctttgccgtgtcaccaacttgcacttcgccgttcttaaatgaaacagctgatggtgtcgtacgaccaccattaggattagtgataacctttggttgtccaccttccaaaacggcaacagctgagtttgtagttcccaaatcaattccaatgatctttgacataattactttacctcttattgatcagttttttgttttgttaaataaatgactagttgtttagttataaacagctaccattgctggacgaatcacacggtccgccaagacataacccttttgaagaacctgagcaattgtatctgacgggtgatcatcatcagccggtacagattgaattgcttggtggaagttagggtcaaacggttcaccttcggctccaacagccttgatgtcgttatcttccaaagcagatacaagcgtcttgtacaccatctcgactcccgtcttgatttgttgtgccgctgcatcatccgcttcaacttgcaacgcacgttccaaattatcaagtgctggcaaaactgactttgccaagttttggctagcatacttcactgccgttgcttgctcctttgcataacgtgtttgcatgttttgcatttctgcgtgagcacgcaagtacttgtcttctgcttcagcgattttttcttccgcttctgcaatcttcgtttctagcgcaacgattggatctacatccgccgttgcatcggtgtcaacatccggtgtctcaaccgtttcttctacaacttcttcttcaggagtttgcttatcctctgccatgctaacacctcttttctaacgataatattctaataactgtgttgataatgtactgcggtaggcgtctaccagattaacaacatccgcgtaacgcattgccgtcggtccaagcactgccagcgcaccgacaccatgttgtggcacgcggtatgtggctgaaatcaaactgtatattgacaacaaactattcccgttttcatccccaatttgaattaacaccccatcatttgcgttcccaattacctggcgcattgcacttggcgcatcaagtaattgcaataattgcttgatctcttgtagctctgtgtcgtccgtgtagtccaacacatttagtcggccaccgacaaacaccttatcgcgaattgagcgggccaaaacgtcaccgaacaattgcaagaatgcaactggggtgcgaattgttcgttccatcttcaatggtagatctcctgacaatgttcgcaacacatcaacaatcggttggttaaccaacgtttgattaatgtagcgcaccatgtcatccagaccacgtacatccattccctcgggtagtctaaaactctgacttgtcacctggccgtcgttcgtgacgataattgccatcacttgttgaccgtcgaccggtaccagccggaacccagacaatcgcgtgtcaactgattccggcttcaatgcaaccaccgtgtaacctgttatatttgctaattcagtcaccatcgtctgcatcaaatcgtcaatttgttgaaaattacgattgaaaacacgttcaagggattgttgagcaacctgggtcatgtgttcactacgcataatcttatctacatagtaacgataaccacgttgtgaaggtacccgtcccgacgatgtatgttccttttgcaacaaaccttgctcttccaatgaggccatctcattacgaaccgtggctgaactaactgccaaccctaatttttcaagcaacgtttttgatccaacagctttaccggtttttgcgtaatcttgaattattgcggctagaattaaccgctgccgttctgttaacatacgcttcacctctcttagcactctcaactacttcgtgctaacgattattataatacacgcctcatagacccttgtcaacaattttagcactctaaatttcagagtgctaaaaagcgccgcaaaaccttgcgacgcttacgtttctatttcttaattcttagcatgatctgaataaattcaatcgtcgattcaaacatgcggtgaacagccagcacaatcactgtattaaccacctttgccacttgggtactaaatacaaagaccacaattgtataaacaatgagtccaactgcagcttctaaggccgaaaacttcggatatggtcctggcacaccatgaataaccaaggtgattgccaaccacgccacagcccctgccacaatataccgccaaacaaaacgaatgaattgccaaggatttaatacgtgtcgcaacaccatcacttgcaacaatagcgccaccatttcactaattaacgccacccatgcagccatcagcataccaaagtgtggaatcaacaccaaactcaatatgacgttaagtgctgcaccgacctgaaccgggattgaaacattccggaagccacgatcagctgccatttgttggagtgccaaactgtatcgccacgacgctacaatgataataaaggctaaaatacgcaacacttcgcctacaccaacaaacgtcggtcccaaaaaccaatacaccgcctgtggtccaaccgttgcaacacccactgccacaatcacactgagtgccgaactatactctatggcctcataaaaggatttttcaacccctgctgaatcacccgcttgtctttgctcctgcaccttggtcatcattgccattgcaataccgagtacaaaagcaattcccaccttaattaacagttcagcactgtaatacagggccacttcatgagcgccacgagaaacaaataaaactgctttattcagatacaaagatagttggggcaaaagcgcgattgctagaaaaaatcccagcgctttgtaatgtagcttcacaggcaagtttgtgacattcactcgaacaagtacttttggcaaacgagcccatagtagcaaattagcaataatagttgtcattgctaacaaaattataaagtgtgttaaatctgagggacttttcacaaaaataatcaacggcacaaatctaagcatctggacaagcgcatcacgcctgactattactcgcgtcttattaattccattgtaaagccatgaaatatccaacatggcgcccacatagaatagcacttgcgctttgaacacactttcgaacggcaagttaagcccgtttattaacccccacgtcacgagcgcaagaatcgcgagcacgctgacttgtatcgaccacacgccccaaaaaaatgatgaattagtgcgtttatccggcgccatcttactcaattcgctttgtgcgtaaattcgtatcgccgtcgcaactacaccgatgcttagcataacgagtgcaaaggttcccgcttgcatccccaacgcttgtacgtgcaaaatatgcgcgacatacgtcaagacaaatagcggtactaactctgttgtcaggcgcatgaccgtttcttgtatataaacttttaataactgcataaaccccacgcccttgttgttcaataattgacttagacaatcatagcaaaaaatgaccctgcaaaaaagcggtaatgcgcaaccgcattaccgcttttgatgaaattagacaaaatcaatcaattgatctttaaacttcaagtacaagtgtgagccaataatggcaaacaaagctaattcaagccagaacatagccatcatttgaggagaatcccagaaccatcgttggtaaaggagcgtctcacgccatccattaacaatatagtagaacggattaaccttcgtactatagtaaatcatattgttaaagaatgatcccttggcaggctggaacaagatacctgacataaagaacgtcaaacgcaaaacttggcgaatcaacatgtcgtaatcaggaatcaaaatgttaattgttgctgagaaaattcccaagaagaacaacattatcaatgctgctgcaccgtagtaaaagatctgcaaccaatacaaacttgggtggaaatgtcccgtcaaagccataccaattgcagcaacaacagaaattgaagctacggccggaaagacttgcacgactcgaatcgatggcaaaattgacaccgggaacttaacgtttcgaaccatgaagatttgatcttgcattgagcgaattgtatctgaaaaaccttgattaaccaaataccaagccgaaaaaccaactgacatccaaatgaagtatggcattccttcaactggtgcgcgggtattaaatccaccaccgaagataacggcataaatcaacacctgaaacagcgggtcaagaatctcccacaacgtaccaaggtacttgtgagcgtttcgtgcttgtgtatcataaatcgctagacgcaccgtcataccaaggtgctcgatttgctcagcggcaagtccgaacaccgacttaattactgtccacattctaaaccataccacccttcacgtaagaataaattatgagtcccatcaatgcgaaaataatgattagtgaaccatacagtccaaaacggctaaacccttcaaaactgcggaacttcgtgatatctcgaacttccttctcagggtatcccttacgcactaaatcatctttaacgtcgtcgatagtgaaaattcgttgctgcaacttttgatcagctacataagcgtcacgttcttcaacactcattgcatccaacttatggataaacgcttcatactcatcagcgacggtctcagtatcgccaaaatcaagcatttcaccatactgaatccacattgccttattcgtaaattggcgaacttgcttgatgtcgtgcgaaacgaagaaaatagtcttgccatcagcaataaactctttaatcttgcccaaagctttcgttgcaaagttagaatcaccaactgacaaagcctcgtcaacaatcaaaatatctggattattgtgcgtcacaatcgagaaacctagctttgcacgcataccgtttgagtagtctttaactggctgatcaatgaattcacccaattcagaaaactcaatgatatctggcatcatctgattgatttctttgatgtttttacccatcataatctgcttcaatcgaatgttttcgcggccagtcagctcccaattaagcccttcattgatggcaacaacaccaattgttccctctaggtttagcgtacctgaagtttgcggaataaccccacttaaaatatttagcaaagtagactttccagaaccgttcgttccaacaattccgacgacgtctcccgcctcaacctcaaaagacaaaccgcgcaaagcccagaaatttgactccgcttgatttcctttaaaaatcgactttagtttttctgattggttcgcatacaaggaaaaattcttagtaattccctctgcacgcaccataacctgtttatctgtcatctttcatgtcctccaaggcatcataacctatccggttagttttcttccttcaagttcaagatttgatcccacatcttttcactcgtcaagtatggcaaatccttacgcatacgtgaacgcacacgaccatacgcaaatagcaagcgaataccgtcaaagaatccagctattagtcctccaaccgtcttcaaacggttgatttccgcaatgaatccctttccgttttcagggtttacatacaaaatcttacggaacccagaaatttgacgatatgccggaacacgcatatatggttggaaaataaccttatccttgcgaagtgggaagaacaatttattcaacgtaattcggcgccaaattgtagtcttcgaatcttcagccaatgaattagttcggaccaagtcatagtcatccaagttaatctcatgcaaagcattttcggcactagcctgcttaatcaaagccatgttattttgcatatctgcgtttgaaaccatccattcaggagtcatacgcatgaagtcgcgcaaagccatgcgatataccttagtaaatccataacgacccgccaaaacagactccaaaactaacttccaatagtacggaaccatacgagacggcttattgatgaataagctatgaacaagcaacttattgcgcaaatctaaatactcggtcattgctgcaaccttgtaatcaaagttttcagcaattgcagcaattccatttcccattaccatgtggaacttgtttagaaccccaaatgagacatcatctccgcgaacaaagtaaggtaatgttaggtgatcagtatacgcaattgggaatgcattgaaccaccatccgaagtactcgttcttctcttcatccaattcttgacctaatacatcaccagcatttgaggcgtttgtatcacggaacttagccaaccaagtcgctttgggatctagacgtgcacctcgttcaatcaacatatcaggtcgatcttcatagaacaaagctgcaccaacagcagtattatccttttctgcgtacgccaaaatttgatatgcacgcttaatactttcaatttcaagactcgcatcatcgtccatgaacaaaacgtgagttgcatccgtgtcattcttgtaatgcaagaaaccacgagtgaatccgcctgaaccacctgtattctcatttgggataatcgtaacgcccatggcttcttcttctgtgatattcttcgaattatcaacaacgataaaatcaattttatcctgccactctgcaatgtctaacaaaccatctttgatacgcttaatagctggcaaaacatatgctttacggttaaagtgagttactgaaatacccagctttgcatcccgacggtaatatgccttagtttcccatgtcatcttcgtgatttgaacatcacttttagcaacaagcttaacatagactaaacctgagtacgcaaacgtttcgttaagatccaaatcgtaaataattcgggcgtcgtctgtcaaatcaacagtaacaatacctttaaactctttgatattacggtttgaaaggtgccacaattcaacatccactgtaccagaaccagaaatggtaaactgcgcatcggacaagcctacgttttctcgccacaaaggaatagagaaggcattatagtatgtatcaaactggacatttgcaaacttcgtcatttctagtttgtcattaccaaagaaaacgtttccttcaacacgaaggtacttttcctttgatcccaaagtttgattacttgggtagataaaattttgtagaacttttgtcatattaattatccttgttttatatctcaaaggtgctcatgtttccatagactttaaaaaagcaccaaaattaagattaccacagtaacaacagtcacgcaatgcaagtcaatacaggcataaactattattaatggtcacttgaaaggtattcaatcttcggattaaagcgtcgaccatcaatgacccctcgaatcaaactactcaatctttctctccgacgagaaacgttcggcgtaatcaaaatctgaaacgcatccgccataatacgcaggttcgattttaaatgcccaatccaaccgcgtttccttccgtagtacattttgttccgatatgcgaaataataccgcggtatcctttcttcatcgtcggtaacaatatttgtcccgacatttttcgacattttgtgtacaacattggctttgggcacaaaataacccggagcaattcgctctgctcgttctgtatactctatatcatcaccccaaataaaaaattcagtaatcggcaaaccaattttttggataatatctcgagacatcagcaaagaaacaaatgttgcattagccactttaactgactgagtagcgtcttccggtactttccctagtccattttttaaagttaagttattcattaatgcccttgatccgtcaatccaacgaacatcagaggctaagaatccgtaggaaccaatagtatccgcaaagtcaatcaatgaagataacgtgctttcgtccggcaccgtatcatcatccatcaaccaaactgcatcatcttcagtatgctccatgaaatatctaattccccggttgaaccctccggcgccacctaaattttcagtcagtctaacatattctatcgacgaccccattgacagtaaaaagtcttgagttgctttatcactattattatcaacaacaataacgtggttaagccttgcttttgatgacaacaaggcagaaatcacttcttttagcatctcaactctgttataggtcaccaccactgcacttactttcattttgaactccattcaaaaagcaatatgattattcaagtgtaccatgtttttgctttcaataaaaaaaggcctaggcattttcttgccttgacctttattgcttctaatgttcctcgtcgtgagcaaagttgaagcttgatggaatcttaaattccttacgtacttcgttcaatgctgcgttgaagacttggtccatgtcaaagtaacggtattgtcccaaacgaccaccgaagatgaattggtccttgtgttggcgcgcttccttagcgtattccttgtacaagttcgtgttcttctcgtcgttaactgggtaatatgcttccttcgaacgatcccaagtttgtgggtattccttcgtaataatcgtcacaccatcgtctgacaaaccatcgaagtgcttccactccattacacgcgtgtatggcgtctcagcatccgtgtagttgataactgagttaccttggtagttgtctgattcgataacttcgtgctcgaagcgcaatgaacggtactccaactctccgaacttgtagtcgaagaattggtcgatcattcccgtgtacaagatacgtgggaactctgcaatgtactcatccttatgctcgaagaagtctgagttcaaacgaacatcgatcaaatcgttgtccaacatcttctcaaagatttgtgtgtatccaccaattggaataccttggtaacggtggttaaagtagttgttgtcgtagatgaaacgaactggcaaacgcttgatgatgaaggctggcaactcagtcgccttacggccccattgcttttcagtataacccttgatcaacttctcgtagatgtcagtaccaatcaatgagatagcttgctcttccaagttacgtggctcacggtcgcccaagtcagccaaagcggcgttcttttgttcttcgatcttagccttagcttctgcgggagtcttcgttccccacatctcgtagaacgtgttcatgttgaatggcaagttgtacaacgtacccttgtagtttgccacaacttggttttggtatccgttaaactcagcgaattgacggatgtagtcccaaacttccttgttatcagtgtggaagatgtgtgcaccgaagtcgtgaacggtaattccgtgctccgtgtgtgtgtacatgtttccagcaatgtgtggacgcttttcaataatcaatgagcgcttaccgcgcttggccgcctcgtaggcgaaaattgaaccaaatggtccagcaccaacaataaggtagtcgtagttcttatcattcaaagtcatttttgatgatttcctttcagaatataaaaaatcttctgaaactactttaccatagtttcagaagattttggatataaagtggctcctcaattttaaaagtgcactttcttagatcctgattttataaactttcgtttaaggaaatggtaccccttgttcaaccaatttgtccgttcggtagatactaatggcacttcaacaacctttttcgcattagtgattaaccaaatatccattaatcgttctgctaaaaaccccaacgaacgcctatcctggccagagtaagtgtcaacatgcaccatctcatcgacttttccaaggacatcaaacaaaaaatcagtatacgcttgaaaatccgcctgacgcataatgctcatattaaagagatgagcttttgtcgactttgcaactttttcaaatgcatcaacgtataatggataatcactttcaatcactgacttcattgcataatatggatcagaaatgtgtgcattcaaataatgagcctcttgattctcaatgtaataatttcgagctttcggaacaatcacatcggcttgtgccaaaagcttctcaatttgaggctttgtaagaacatcctccaggttttggctccggcgcaacgctaaataccgccgataatgcatcaaccctataacatcctcatcttgcagattttttttagcccaatacaacgcagttaactcgttataaaattgattttgattagatatattgtcaccctctgcatctgagtgggtaccaggaaaaactcttccaaggttacttgcgccaactgtcattgggtagtaaatgtctaactttggaaaagcaatatttggcttgtgagtggcaactaaaatcttcatctaactcattcctcttctcgtgcaataaaaatcggtcgtcgtttaacttctaaataaatacttgaaacatatcgaccaactatcccaagacttagcaattgaatgccgccgacaaacagaataatcaccactagtgagggccaaccgtcgaccgaagagcttgtcacaagcaacttcctgatgattatagccgcaccaccaataaatgaagccaaaaacgatatcattcctagaaaagataccaatgctagcggtacttgagagaaagcaacaataccacttactgaatacttcaacaggttccaaaatgaccaatgtgttttccctgccacacgatgcacattttcatacggaatatacttttgcttgaatcctacccatgcaaataatccttttgaaaaacgattatattctgtcatttctgttaaagaatccaccatttttctagacatcactctaaaatcacgagcaccatcaactatttttgtatccgaaatcatattaatcaatttgtaaaaaagtcgactaaaaaagctccgtattttcggttctccctcacgtgcaacgcgccggctaccaacggcatcccactcacgtgatacgacaccagcaagcatttccggcaataattctggtggatcttgtaaatccacgtccataatggcaacaaaatcaccgcttgcccgtttcaaaccagcgtacatggcggcttccttcccaaaattttttgaaaaggatatgtaatgaaccgctgatttttgtttgtgccacgacttcaatacttttaacgtattatcagttgaaccatcatctacaaaccaatactcaacggccacatgtccgaagtgttcagtatgcacagcctcaacgtgattaataaatgtatcgattacatcatcttcgttccagaccggaacaacaatagatagcaactgtgtcgattctgccatttacattgcacctttcccgtcgaatatagcgatgattgttaaaaatataaccttaaaatcaaaccaaagagacgcattacgaacgtactctagttctaaatcggctctttgtggatattgaatcatgctccgcccagttgcttgccataatcccatagctcctggctgcacagaaagaaattcatcaacatgattaccatattcaacaagctctctttccactactggtctcggaccaataatgctcatatctcctcgtaagatgttgaaaaactgaggtaattcatcaatagatgtctttcgaataaatgcgccaaaaggggttattctaggatcctcgttcgtcggcaatttgtacccattttgaacaaacttttggtatagcgcttcatcttcccgaagaacttgatcagcgccaacaaccattgaacgaaacttgtatatttcaaaaggctcatgatttagtccaatacgcacttgtttgtagaacacaggccccttattacgaccgaaaaaataaaaggcagtgatcacaataaaaagaggcataaacactatcaacgcgaatagagaagccgaaatatctaagaagcgtttagaaaatcgatacgctcgttgattatgatttgattttcctgttcgcattatcagttccttttccaaaattacaaatacttagcgtcctcttcaggatcttgactggtcaaaatctttgggccgtcttcggtaattgcgatggtgtgttcatattgtgcagaccatgagccatcagccgttgttacagtccaaccatcatcttcagaagtatcgaccttccaaccacccaagttcaccattggttcaatggtaattgtcatacccggcttcaagcgaagtccgtgtccagccacaccatacgcaggtacagctggctcttcatgcatcgtaggctgaataccgtgcccaatatactcacggacgtttccatatccatgttcatcttcaacgtatgcatttatggcagccccgatatcgccaatacgatttccaacaacagcttgatcgatacctaagtacagtgccctctttgttacttccatcaagttacgtacttcttcagaaacttcgccaactgcatacgtccaggctgaatcagaataataaccatccaaatccacgaccgtatctactttgactaaatccccttctttaaggaaaagtgctttccgtggaaatccgtgtgcaacttcgttatttactgacaccgtcgttgcgtactcaaatccctcaaatccgatttgagcggctcgggcgccgtggctttcaatatagttgcgtccaaactcttcaatgtcccatgtagaaatgccgggcttaataatatcacgaaggcctttgtgcatccccgcaataatcgcacctgattcacgcattccttcaatttctcgttctgactttaaagtaatcattttaaacttcctctcctattttatgcctttgtcagctttatactgactggttacatccaacgatgtaacattagctcgttggattaatctggcaatttgttttactgtcaattttttagcttgagactctagtcccgcagaaatcatattctttctcgcttcttcaatctcttgtctagaaattgtaatttgaggggcgtcaacagtgtgggtatcacctactatctcgactttagtagctgaaactgttactttgtctccatgaattgtaaccttaggtaaacttgtgtcgtgatttttaggagaattaatcgaattccatgccaatcctgctataacagccatagctgcaattgcaataacacttccaaccaaaaacctaatttttgtgcgcattaaaatactccacaagtgtttgtccagattgtcttgcttgcaaaatcatcttggcaatgtcaccattcgacattgcgtttgaagcattttgatcaacgccagctaattgttgacgaccgtcagcaatttcttgtgctgtgacagtttcatcattcacaaccttatcacccgattctgacccgtttgtcacatcgcgatattcaccaatttgtgaattagcagcatttgattcatccgcaatcgtctcatttttagaaccacttgcgtttgcctcgctaatggcagaaacaactgagctactagattccgtactgtccattgatttgcttttcttcacttctgaagttgataaagacatctttttatttgttttctcattcgtagtcgagtgagaagaagagtcgttatggctaaatacaccaatgattcccagtgcaattactatgacaagtaaaatcgatccaataccgacaacaacctttcgcatgttaattctccttttttaagctattacgattttatcacactttgactcacctgcgccctgtgtatacagacttcagccggaacaaactgaacaaaaaaaacacatgtattaattccgcacaggcggtcattaatacatgtgtttcaaaaatataaattatgccacgcctattttttccttaaatcgcttagtgactcgagatgccgcaaattcgtaaacgtagtatagtatcgatccaaacgccatggttatgacagcgtataacaacaccactagtgggagcgctaatatcagccaatggttggctattccgaaagattcggagaactcaatgtatatcttagctgaaattctatagaacattccataaggcgtagccgtgtggaacatgtaaacaagcacagtagctggcgctatgaaattcacgaacttacttgtaaaattcaatcgcatgaacaatgtgaaaattacaaaagaaaatatataaatagggaatccaacataataccctaccgcaggattagcgattcttggtgcaacgtgtaaaacgcgtacaagaaattcaaaactaccaatgaaatatgctggatataaagcaagaaatgacaacaaagctttatttgaaaagttttgtaatggattaaattttcttgcaaacgctcctaataaatatccaatgaatacaagtggaaagtttacaccgtcacggacagtgagcagaggcacataattaattattgtcgatgcaaataccacaacaccaagcagataaaagaaagcgcttctagttttcaaattattcaaaaagttatttaaaggctttaaaaaaatcaacaatacaaaataagcactaagataccagtatccaccagcgaagccaaataccgtattcaaatctgtaaaaatattatctggcaaaatcgaatccaaattaacaaggttaagcttattaattacagctaaagctaacgcaatcaccgttgtaactacaactccgttgtagagtgccaaccccgcaaatttaacagccgaatcactcgcccttttcaaagcaggttgatcattttttgatgaaatcaagaaatatcccgagatcattgcaaatagcgtaactccaccattaccgaaaaaatccataatgaatctcattgcaccgactacctctggattagtcgccaatggggatcctttaggggttgtaactatatcaataacactgtgaaacataataatcatcagcattgcaactactcttagtgcttcaaaattactttttcttatttttttattttccatctttaatattgcacgaacaaatcgtccctactccttttttgtagtttcaaaagcatgataccagaacccaacgtcaataagctccctaccaaagcaacccgaacaacatcttgacttgagattagagtcattttcttttgactatacaaatagtacatgaatctaacatcaacctttttaacatcgttaagcaatactgcagttgattcatcgtctggacggtaagcaccactttgaagataatagaatatcgttaaaggctgatctgatgtgtttttaaccagaacttcatatcctttcctactcttcgagagtggcatttgaatagaaccgttattaacaaacgctttctttttactcgaattacgacccgtatccaaattcttaaaatctataaatttcttggtatccggagttatcaacgggttaaagaaaatatactcattattttttataggtttctttattttgaaactcaattcatcaccaggtttcagcttaatttcattagattccatatatggtgtcataggtgacccgtatgtcttaccttgtaaaattctgtattggtcagtaaacggttgcaatcctcggtgcaacccaaatccaaccaaaacagacattgccaaaagacctatcaatttcatacccgtatataatctaactggcacgcgtacttccgctaacgcagacaaaccataagcacccataatcagcaaaaacggaagtgttatttgttcatacctagcttccacttcccaaaataaaatatggaaagctgaaatgccaagcatagatataattgaaaacataacaccttcgtcaaacacgcccttcctccaataaattagtgcacctaccaaagaaaagacgatgacacttacataaacgaattgcgacaaattaacaggcaaaaaataagctttgtcagcataaaatggttctccagaagttcttacagtattaatagaacttgagtccattgcccctcgagagtactgaagtatcaatttatcgaaggcgtgtgaaatcagccccttaattcctaacacatttatgcgacgcttaatctcctggatacctaaatcttcttttgtagactgatctttcaacgaagtgaacgcaaatgcatcatcaccgtctatttgaccactcgtattgggatttaatcccatcatgatccaattagttctaggtatgactagttcattcttagtttcatatccatacattctctcaattttgctttgactacccgtcaccacactaaagagcaaaacaactagcccaatacctacaattttccttttccaatctaaacgaggagtaactaacactagaattaaaaatgctataaaaattattaacgaattttgtttaaccacataagccacaccaaacaagaaacctagcaatgcaaactgcgttagattatgcgcaaacttgtttgtaaaaataatggataatatgattaacaacataataattacaagcggatcggtatatgttggtaacacaagcatatacaccggaaaggacgttgcaaccaaaatagaaaatcctgttgcaagcaacttatttcttttgcgtataaccaacgtcaacaataagaatgaagcaattagcaaaatactttgcaaaatatgtgtcgatattgcccaatagtctcgcgggatatgcaaaatttcaaacacccaataaaaccacgaataaataattggggttgaaacattgttagggtagtaagagaaataattcatccatttcggggtcgaatcatcaagcagcctatacgcctgaatttgtattctagcttcatctgtgaacggcattatttctaggcgtaaagctacatatagttgtccaatagccagaatagtaaacggaataactatcgaccatatgctatctaacaatttggtacttcgaaccaacttaattagcgctgctaataagatgaaagctgcgatacttcccgcaacaattgcactcttaccagcgtattccccgatattagcaaccgtaattgtcgatatactaaagatagaagtgtacaatacggcaccgctaaaaattataaataatatcaatataaatctacgtacaaaactcatatctcacctttttccttaaaaaaagccgacgtaaaagcgtcgacccttctcagttattatttttctgtatattcatctagttcgatgaaaaagcgtgggcgtcgcttaacttcgaaaaatactttaccaagatactcgcctaaaacaccgagcgaaattaattgcgcaccgccgacaaaccaaactgacaccatcaaagatgaccagccggttgtagtctttcccatagcattttgaatgaaagtcataattatcagcccaattgcaaccatcacactaataacccccaaccataggattgctctaagtggtacagttgaaaacgatgtgattccatccattgcaaacttaatcatcttgttaagtggatattttgattctccagcctctcgttctttacgagcataataaacgttagttgatttataaccaaccaacggaattattccgcgaagaaacaagtttcgctctggaaattccaatactgcatctgcagctctcctactcaatagtctgaaatctgcgtgattgggaatagttttcgcccccattattgacatcgtcttataaaatgccatcgcagtagagcgcttaaatgcggaatcagtatcgcgattgtttctaaccccgtataccacttcatatccttcgttaaacttgtcaaccatttcttcaattgcgtagatatcatcttgcaaatcggcgtcgatggtcacaattgcgtctgcatcttttgtaatttccagtccggcaatcaaagcattttggtgcccagaattcctagaaaaagaaataccagtaatgtgtctatctgccttctgtgaatctaaaatttcttgccatgtgttatctcgagaaccatcattgacaaaaaggattcgacttgaatcagaaatttttttctttccaatcatggtgttcaaaacacctaacatagccggcaccgtaattggcagcattgcctcctcgttataggcaggtacggcaattacaagtttcgtattttccaattgtcttctccgttcaaaattaggttaatacaaaaattgtacattgaattaacacaactgtccagatttcagccaatgttggatcaagttaattttgccctcgtcgccgctacattcactatcactgatttattcttcaacaattcatgtggattttttaatctgcgtttcacgtttgcgattttaaatcttgcaaaaaatggtcctttcaattcgaacgcaattgaaaggaccatttttatattacatatcatttagactgatccagtcataaaaacaatctgtatattttttgttatagacgtctaacgtcccgactgtaatttgctatttttcagaatagtagcgaatatccacgccgagtaaaaaattataaatgctgtcgaaaaaaacatcagcattctattaggtattgtaggaagcactcctccaaatctccccaaaacaaccgtttcattcaaaaacatcaaaaagatcaatattaatagtgaaattttttcgaaaattgaaaatgaatattttgcggcgactagtaagatgataaatgcgaacgaagggattgcgtatcgctcatgctgacttgtagttaacacaaacactgcacccaaatacccaaatccaaccaaattaatatttttcttccgaatcaacagtacactcgatattatcaccaaagctcctaagatcaaataattaaggtcacttattgtaaaactcctaaatattgcagtatcagtagttaagtttggcaccttaagtgaaactatctgccaaatattaaagcttgataacgcaagttgcgtatatgatcctgcgcctgataggtaagttctcactggcagtgttacatcattcataataatcatcggcatccaaatcgttagaattgttagtgctccagtcagtagtgacaagaataactttcgtatatcccgccattctattacaagcagtgcgacaagaaaaataggcagaagataaaccgcttgcaattttgttactacggcaattcccatccaaaaactacctaaaataggattctttttctgatttaagtaataaaatgcaaggaaagcaagcaccaccaaaacaatgtctgattgcccccacatagtcgtattaactataaaaaccggatttaacaatatgccataaagcataaaccccggagaaacaacttttttcaaatatccccatatcgcaaaagcgaaggttacaaatattgaaggcatttttaatgctaaattagttaggttgtcaaagttcaaaaatgcaaagacatgtgactcgacaaacactttgtaaaaaagagcatacaatgtaggcattacaggtggataatccaccttaggcacaatacttctatcgtacaaattaaaatgatgctctataatctgtctcgcccaaggcacattaaagttctgcaagtcgaccgggcttttgtaaaacagcgcaactatgatgtataaaaagaaagccacagttaaaattaaaaaatgttcagaaaccagcacttttttcattgttatcccatcctttccctattttctttcgcccataatataaaatctaccaactacgtgcatggagatcgttttatcaatttcaaggatttcttttccttgttggattgggactatcgcaaccaacccatcctttttaattttttcaacaatctcatgattttccaaatcgtaataacgtttgttaattcgagacacatttgaaaacgcgcttcttgatataagcgaatccgaataaaaaagtttgggatttagtgggtcataaaacatttgataaatatatggattatttgttcctgaaaagtatgtctcacccttttgctgagcaagatatgacttcaaatataatggcgtaacaatatttccatcatcattcttcaaagtgcttccttgatatgcagatacaaacataacactttgaattaaaagaatgatgcttagtatctttgcaaactgttgtccaacgtttgattcagcaactaccgcaaagccaatgccttctaaaattaataacgttggaattaaggaaaattgatgtgtcaatgacggagtaattagcaccgacaatggaacggccgataaaaacataacaatcagaatagcgtactcactatccctccatttttttatggcccataaaaagccgaccgcagaaaacataattagggttccaaaaaatgaacttattcctggaatagagttccatatgtgattatcaaacccctgataaatcatactcatattctgaagcatattagagataatatcacgaataccaccatggaccaatgaggcatcagatctcaactcaaataattgtggtatcgaaaaaaacaaaaaatgttttatcggtacatgcaagtagtttctggctacaaacgccaacagtggacttacaaaaattgctagcataacaaaactaacaagagcttgcttaaacgaaatcacgtgtcgttttagcagtaaccccaccacacctaaaaccaagaatggaagtacaaaccaaacagaactgtacgtatatgccatagcgccaaatactagcactagaccaattaatgaggcgcgctttcctgcttcgctttgtgtgttcaataaaaacagagacacgtcaaacagcagtatgaataaatatggcaataaatttgattcaactgccgtccttgaaatcataatcataagtggtgacaaaaacaccgccaccatcgtaagacttattttccaacgactccattgtgcctttctaaaagaaaaataactaaacactgccacaagtgtacttataattatcattggaagtcgataggaaaaaacagacaatcccattattttaatgaaaggcacagcaattaaaggatatagaacgttcatgcccgatccccacgcaataaggtacacaggattgtggttaccccacatatcagttccataatttgcaagaccccacgaattatacccacccattgcctcatctgagaataaccctggagttttactgatgtgccaaattcgcacaaataaaataccaaccaacagcaagattatccaaattttccaaacaattgctttatactttgacattttgccttcctttttctattttttcaattttatcatctaatttttgactatcaactcgcataatccagtctttacataatttgattatttcaataaaaaaaggggtcactccccttttttcttagctattatctctttaaagcatttaggtctaaccaaaatactttgccatcgtttgcacgaacataaccatatttgcttaagctagtgcttgcagttttcaatacttgtaccgtttgaccataatattgtgcgcttgacatgttaggtcgcatcgagttggcattaaccatgtatggtccacttgtgtaaattccatcgtttttcgacacaactgttgcattgtatgaaactgtcgtttcattctcaagcggcaaatagttcaactggacaatagcagcttgatcaatccacaaccatgctccgttcaaatatacatttacatataccgaacgtgaggtcttcacaacgctacgtgcattagtcacaactccattaaattgatttccctgagcagcgggtgaaacagactgcgcggttgtgttgtacggatccttgtatacaccatcaattctattgctttgattaattcttacaggataatccacagtagcgctagaaacaatagcatcaaatgtatatcgagttaacgcatttaaatcaatccaaacatgcttgccatcactcaatgtggcgtaaccgtaggttcccaactgtgttcttgccgtcttcgttacagtcaccgtttgaccgtaaagagtggcggttgaataattaggttttacagttgatgaactggtattgtatggtccatcaagaaatacaccatcattatttgacgttaccttagcaacaaagtttacattttgttgttccaaaattggtagatatacgctcttattaacagctgcctgatctatccaaacccatcgacctccaagcaaaacatttacgtacgtcgaacgatttgtcaccgccgtagctcgggcctcagtctgttcaccattataattctttccttgatcaattggtgtaatcgaatcaaatgacgtattgtatggtgcagtgtagatgccatcgctttgcttgtcttgcacaatgcttgcattatacttcgtttgagattgtgatttcacaacatcaagattaattttcgaaattgctttcaaatcaacccaatatgattgatttgacgtcgttgtcacgtatgcataagttccaagaggcgtacgtccagtcttagttacgtgaactttttggccaacatagcttccactagatgctaaaggggtaactgtattcgcacttgtgtaatatggtccaccagaatacattccgtcattctttgacgttatttcagcaacataatccgtgttcttaacatctgaaaccgtgtagtagttcgtctttttaacagccgcttgatctatccatacccacttaccgtctagcaaaacatttacatatgttgatcggttcgttttcaccgtgcttcgcacagtcgtcaacaagttattatactgcttccctgttgtaattggcagctgtgcattcaccgttgtattgtacggatccgtatatacgccgtcattacgattagactgagcgacttgggccgcgtaacttgttgagtctcgtgaaatgatagcatcttgtacaaaggctacgccacctttgtcaatccaaaagttcttgccgttatccataaaaatgtgaacatacgttccatgtttaatagcggcttcctctttaacacgcccagattggttattatatttttgagcactctcgttcggcttagctgtagagctactcgtattgtatggaccatcgtaataaacgccatcattgcgagatgcttgatttacaattttagctgtataatcgtatcccgttttatacgttgccgaatcataagattgatcgaattcgtccaatccatacgtttgaatcaagttaattaactttgaaccataatgtgggtccgttgcatatcgacctgttaaataatttgcagcatctgcataattggcagcattttcacgccaagtcccagcataataacgaggattccatgacgccccgttacgcaggagagctgcattgtcatttaaggattcataaggtgatggatattttttaaattgagctaccgtgtaatacaattcgccattagtagtgtattcagccgttagcatatccaccgactgtccattatacgagccctttattccaaaataattatttgcttttgtagaaagcgtactctgcccccaggcactctcaagtgaagcctgagccatttgtactgaagaatacaaattatattgcttagtcactttttgtgagtccgcactgatatgcgaaataaagtctgtagcggttgaagcttccgcgtttcctacacctatcccaaaagctgctgcaaaccctgcgacaacaagtgacgcttgtagagcattatttttcataaaacattaacaacctctcgttaatttcgtcttaaagcgttaaggtctaaccaaaatactttgccatcgtttgcacgaacataaccatatttgcttaagctagtgcttgcagttttcaatacttgtaccgtttgaccataatattgtgcgcttgacatgttaggtcgcatcgagttggcattaaccatgtatggtccacttgtgtaaattccatcgtttttcgacacaactgttgcattgtatgaaactgtcgtttcattctcaagcggcaaatagttcaactggacaatagcagcttgatcaatccacaaccatgctccgttcaaatatacatttacatataccgaacgtgaggtcttcacaacgctacgtgcattagtcacaactccattaaattgatttccctgagcagcgggtgaaacagactgcgcggttgtgttgtacggatccttgtatacaccatcaattctattgctttgattaattcttacaggataatccacagtagcgctagaaacaatagcatcaaatgtatatcgagttaacgcatttaaatcaatccaaacatgcttgccatcactcaatgtggcgtaaccgtaggttcccaactgtgttcttgccgtcttcgttacagtcaccgtttgaccgtaaagagtggcggttgaataattaggttttacagttgatgaactggtattgtatggtccatcaagaaatacaccatcattatttgacgttaccttagcaacaaagtttacattttgttgttccaaaattggtagatatacgctcttattaacagctgcctgatctatccaaacccatcgacctccaagcaaaacatttacgtacgtcgaacgatttgtcaccgccgtagctcgggcctcagtctgttcaccattataattctttccttgatcaattggtgtaatcgaatcaaatgacgtattgtatggtgcagtgtagatgccatcgctttgcttgtcttgcacaatgcttgcattatacttcgtttgagattgtgatttcacaacatcaagattaattttcgaaattgctttcaaatcaacccaatatgattgatttgacgtcgttgtcacgtatgcataagttccaagaggcgtacgtccagtcttagttacgtgaactttttggccaacatagcttccactagatgctaaaggggtaactgtattcgcacttgtgtaatatggtccaccagaatacattccgtcattctttgacgttatttcagcaacataatccgtgttcttaacatctgaaaccgtgtagtagttcgtctttttaacagccgcttgatctatccatacccacttaccgtctagcaaaacatttacatatgttgatcggttcgttttcaccgtgcttcgcacagtcgtcaacaagttattatactgcttccctgttgtaattggcagctgtgcattcaccgttgtattgtacggatccgtatatacgccgtcattacgattagactgagcgacttgggccgcgtaacttgttgagtctcgtgaaatgatagcatcttgtacaaaggctacgccacctttgtcaatccaaaagttcttgccgttatccataaaaatgtgaacatacgttccatgtttaatagcggcttcctctttaacacgcccagattggttattatatttttgagcactctcgttcggcttagctgtagagctactcgtattgtatggaccatcgtaataaacgccatcattgcgagatgcttgatttacaattttagctgtataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaataaacgccatcattgcgagatgcttgatttacaattttagctgtataatcataaccactttgtcttgacagaatatcatcatattctcttgaataaatataattaaccagccaagcaaaattgtccattgtatacgcagtaccgaaataatttgaagcttgtgctgcccaatagccggttggatcagtatgggtcgtttcatgccacatattagaaatcatagcatgggaaaaaagtgtgctccctagctgtggtttaataccatactgtcgcatcttttgtgcagcgatggacgcaatattaaacgtttgcttcgcccattggtcttttccatttaagcgaacttgctcatattgtatataccgttggtttccagtgtacgcaacaccccatgccaaataatcagtattagcgattgtatcgattcgattatcagaaacccaaccgtgtgtaaaagcattgtcccaattattgatcatgtaattttcttcattgttcatcgccacatcagaagatgaccattgatcaccctcggttccagattcgtggacaacaaacccttcaggcttacctacaccgttacgataggcatagtgtgggaaaacactattaattttgttagtttcgttagccttcccccaggccccacttttaattttattttcaatgtatgaattaacgctatttccgtctgatgcacttgcctcattggtcaatccaaagacaccaatacttaaagcagctgcaaacaaaaaatacgctttgtttcgcctcatcctatttactcctctatcacaacaatcatattcctatactaccataaatgaccacattcaacctttaaagtccttgtacagaatgttatcaatacagcgtcattgatattaatcttattttttattttgatttacattattgaacattttacgaatagatatagaacattctctttaccacagctttcgccttccacaattagtcctatataagaaaaacatagaaaaaggaagactgactccacgtcagtcttccttttttaaaaattacacatatattccgaacgattattttatttccaggtcctgttttgccctaaaaataataaacttactcaatgcataattagacacaatcacaaagacgttttggatgatgttccaaagcatgtcgttttgatgtaacaaattaacaccaaaccacatgattgcagatccaacaacacctgtcaccaatcgagaagcataaaactttacaatctcactcacatactcgttgacagaatcagcgtgactattaaaaacccacgtacgattcgttagataagcaaccaacaccgaaacaaaccaagctaaccagtacgatacttgaacaggcatatcagtcatacgaaataatgcatagaacacgatgttaacaactgtcgttaaaacaccaaagactaagtacaaaatttgagaacggaacttgactagcaagtccttaaccgtttcgatcatgaaaacatccactttctttttattcactcaaattattgtaccacactgttgcaaccctaagcgttcactatctggcgattgtcaccttgcatcacaacacgatctaattgtccaatcaatgctggcacaattaccgatgctcgacgatgtacatatgccagcagtaatgtacatgcctccgctgtcacacgcgggtttaatccagtcactgtcgtaattttgtcgagacgatattgaatcgtacgacgatgaacatggagtgcgtcactcaacgcgcacatcgactgaccgaacgttgcatacaaccataacgtcaacatgacctcatcatccaaatgatcatgaatcagctgctcggtttctggataagcaacccccgcatcaataataatggccaaattcatcatgttctcatagaacatcgtccgcatctcatcgactgttggatgggtcatagcgagcgcgaaaatcccctctttcacactttcttgaatatcatgatgtggcatccccacccctgcgagtgcccgttttggcaacctcggcaagaaatcggccacgtcatctacttgcaagacatatacccgtcgcaagtaatccaattcaaatgccaggcgttcatctggaagttgctgcttatcgccctcaacaacaaccgcagcatacttttcattgaaatcgaccccgtatgcgcgtgccttattcacgaacgacttatctgcgatgatgtcgttctcttgtaaagccaaccagttttgcataaatgtctgaagcatttgtttgtcctcccttaattcatgaaactcttcatttcctacatcttgtaatataccgactatcggacattaaattaaccggttaatttttttgataaactaatcacggcaaatcggctgggtcatgcaacgcggtccgccacggccacgtgagagttcactcgaccgtacttcatgcacgataatgccatgttcccgtagtaaatcgttactaacatgattgcgatcatacgtgacaaccacgcctggtgcgatagttaacgtattcgagccatcgttccattgttcacgtgacacacggactggatcacctgcaccagtcaaaattaaatcaagatcgacttcccctgttatttcacgcaacgtggcaattaagtcagtacggcggccaagcacaacttcaccggatgactttttgcgtgccagcaccatttctaatgtgttgccgtcagctaacacacccggatacatcgtgaattggttggtattcaccatcgtaaagaccgtatccaaatgcatcgtggcatggctatgtggaatctgcatcatcaagaccgtatcaattcgactgtctgctgacttgaataacgtttccgctaatgctgtcactgcggcttgttccgtccgttcggataatccaaccgctaatgtatgctcattcaaaatcaaggcgtcgccaccttctaggcacgtctcgacctcacgtgatcgccagatattaacgtgacccacaaaccgcggatggtgcgtcatcaccaattctgttaataatgattctacttgtcgaacaggataggtcatccgattaatgtttaacccattaccaatcacagactgtgggtcacgtgtgaagtacgcatttggcaatggttgcattaagaaccgtcgctgaggtggctggtttaagccattatcaaattcgtcgacacgcacgcctgcatacagcttcgcaaccaggtccgtcacattaaacccgcgcaagtagcccattaacgccgcaaattccggtgtccccggctgatgaccttgttctgcaatgaaccgcgctataaattgccctctgacgtccgaatcagctagcacatctgcaaccagttgctcaatatacaaaatctcaaccccttgttcacgcagtgttgtcgcaaattcgtcatgctcaacttgtgcaattttaagatacggcgtgtcgtcaaacaacagctcatgcatcgtttccggtgtgatgttttccaactcggcacccggtcgttttaataataccgtccttaaacggccgatttcagaattcacttgtaaggctggttcgatcttgattagtcctccgtctcaaatagttctgcatgagccaacacgcgcataaaatgacggcccgtccgtaattcttccccaaggttgcgcgcattctcaaccatgcgattgacttgttgtgacgttaacgctttaaccgttgtgcctaattcttcaatttggttcaacacaatgccaaaacgatattgtttaataacatccgcaacagcagaaccacgccaggtaattaacggcatccccaagcttaggtaaaacgacgacttatacgggtagttgtactgcgtataccgcccgagctgtgacaacatcggtaaactgtcgccatcccaaatcaagccaaaccccgtttcattggtggcgcatttaattcactactatcaagttatctaatgtacgtattaattgcaagtaataacacttggctaacgatattgacgccacaaattgtcaaacaggctaatataacggtctaccagcgtattcggccccagcaacacctcatagtttgtgtagtaggcgtacaactcacgaatcgcatccactggattatcagacaaacgccaataaatttcgtaagaagccatacgccaccgccaagccatgtaacggcttgattcttcacgtttcggattagcatcaatcgcattgggcaccaacgttctcacacgtgcccaatcaccttcaaacaaggcgcggaagatagcaaattcaaccgcatcaatcaagcggtccgtatacacccgggtatgattggctgcattaccatcatgtctaattcggcgtaaccactcccccaactcctcaggttctgtcacatccattaacccgattttaaccaaacgatattcattctcatgccattcctcaatacggcgcaacaaatcggcgacgtctttcgcatgaaccttggcgtcttcggaggcaatccaagttgtatcgtgttgaaattggacaattgtttcgagttcgtacgccccttccaaatcacggatatggccagattgcgcatacttctgccgcaattcttccgctgtctcaaccagcgtatgttgttggactccgtacaaattgtaacggacatccagtctcttatccggcaacattgttaacaacgaatccagatctcccgtttccaagcccccgatgcgcattaaatctagcatgtcgtcaactatcaaaaattgtgaatcatcatacaatcgatacatttttgactttgagaaacctaaagccgttaaccggttaattgaaatccccttatcacgcactgtctgatgaatcagttcaccaaacgtttggctgattggcttaaaggataattgatcatacatgacgtcatcaactgggcttagtgattgggcatgcaattggctaatcttatcttgcatttttcgccaagcatccgttagtgaaacgctcacaaagttcatttccagtgtctcaacgcccatctcacgcactgcgagcaaaaacgtcgccatcatcgcctccgtgaccgtcgaattcgtcttcaaaaatgtcgcaattagatgcccgtaacgcttcagcaccaacaattcgacattcgaatcctgcactgggtgatttttaattgccgtcaaaatcagccatacattcgctacttttggtactcgtggtttaataatcagcaactgaatcgctgtcatatgaatcatcaaactcgtttcaaacaaactgcgtggcatataatcacgaaacacttggacactcgatgaactttgatacaacgtcaaaaagcgcttcggtgttatatcaacgccaatcaacgacgttacgcgcatttcaaataacgaaaaagatttcagtcgacgaaaatcatcgtatagcgctttaacatcatccccagaatccgccccttgtcgacgggccaaaatgatgttgataacctgcatccctaacggaaaacgttgttcatcatacgccgctatcacccgctcacgctcatgaatcaagtcggcatccgacattttcgctaattcaccaatatttagttgataaggcttctcagcaacaccctccatcaactcagaaaacgaaattgaaaacagtgtttcgatatgccacagttccactgctgttagtgacgcttcgccgcggataaaccgatagtactgcgaacgagacacgcccgctgcttcaatttcatcaattgtaatatttttctcggcgcgaatctcattgatgcgtaccgccaaattttgtagccccatgatttttcttcccgtcactttcactatgtcaatcatacgataagaaaacggataatttatgaacagattccctaatcagctatgcaaaccggttttttagtgtaaaatgagaatatcttaataatagaaacgaggaattcttatgactctcgcaaattttgacgttctgtcacaaaagtacgctgacttaattacatcagttggtgtgaatgtccaaaagggccaagacattgttatcaacgctgatgttgagcaggtgccattggtacacaaaatcgtggactcagcttatgctcgtggcgcaaacaatgtcatgattgagtggcaagacattcacatccaacgtgaattcttgaagcatgccagtgaggattctctaaagaacatccctgcatgggtgtcagtgcgcgccgaagaattgatgggcaagcacacaacgcgtatctcattgatttctgctgatccagacggtcttggtacagttgacggcgaccgtgtgtcagcctaccaacaagcttatcaacgtgctaaccaagctgttcgcaaggcaacgatgaacaacgacgtatcatggctggttgtggctgcttctggtcaagcctgggctgaaaaggtcttccctgaattatctggtgaagctgcaactgaccgtttgtgggaagaaatcttcaagattacccgtgttggtgttgaaaatgatgttatcgccgactggatggcccacgtcaacaagttgaaggaaaaggctcaatggttgaacgactcgaacttcaaggagctccactataagtcagctgtgactgatttgacggttggtttggctgaggaccacttgtgggaagctgctgactcaatcgacaaggctggtaacatgttcgtcgccaacatgccaactgaagaagtcttcacatctcctgactaccgcaacattcacggtaccgtgacatcaacgaagcctttgtcatacgctggtgtcttgattaacgacatcaagttgacgtttgagaacggtcacgttgttgaagcccacgcctcaactggtgaagctgtgttgcaacagttgatcaagaccgacgaaggtgcttcatcacttggcgaagtgtcattggtcccagatccatcacccatctcacaatcagggattgttttctacaacacattgattgacgagaacgcctcagatcacttggcccttggtgctgcttaccccttcaatttgaagggtggtacacaaatggacgttgaagctcgcaaggcaaagggacaaaacgattcacttgttcacgttgatttcatgatgggatcagctgacatggatatcgatggtattacatttgatggtcaagtcgtaccggtcttccgcaatggagattgggcataataataattttttaaggcattcacgttttcgtggatgcttttttgtcatgaacaaaaaaagaggttgcaaaggaacaattcctttacaacctcaattatggttaatgattagtttgactcaccaacaaatgttccagttgcttgatcgtaaccgaatccaacactcgtcgtgcttgccttcaaaatccagttcttgtgagcaggtgcgccccacatgttcgtctcgttgtaccaagcgtcaattgcaccggcaccagcgccgaattggatagcaattacttctgggccgtaagattggctccagtgtgctgcatcaacagtaccagccaattgttgtgcacgtgattgtgccttagccgacaaaccagcatccaacgttacaggtgccaaaccatttgcatgacggtaagcgttcaattggttaagtgcgtcagcgtatgcgccagtagcaactgatactgaatagttatcttgcgctggtgtgttaaccgttgcagtttggtcagcagcaggtgcgttcgtttgtgaatcatctgatgcgacagttgctcgggcagcttgtgcggcggctactgaagtggctgcagctgattctgcttgtgcttcttgagcagcagcaactgaggcggcgtatgctgaatcagcggcagcctgtgatgcggcggctactgaatcagcagcggcttctgatgcggctgcagctgactcgtcggcagcttgtgatgcagcagtatcggcatctgaatcaaccattgcatctgatgatacaggcacaataaattggccgttaacagattgaccggtcacgataacttcagggttagcaatgctgtattgtgctgagaaatcttcaactgacatgtgcaatgcagttgccaatgcccagacagtgtcaccttcttggaacgtgtagttgtgaacgtcaccagcttgttgcaattctgctgcgacttcatcaactgactttgcttgccacgtatcagctgatgctgattggtttccggcgaacataacaccagcggctacagcagtaactgctgcaacaaccaattgcttacctgacttatacatcttgtagtgtttcttcaattccatggttattaattccccttaaatctacaattgaatcaaatacatttttatcgttatctccaacgtcttcttagtatagcaaatcatcttaacaaattcattacatcttcaagaaaaaaccaatgtctttttgacattggtttacaaaaataattcatttagttgcattctgcagacgttttaatacctttgttgctaatgtaatattggcatccgcttttttaattgaacatttcaattgcagggtctgatttcgcatatcaaacgtcattggagtcccttttagaagctgctgaatgcgtcgaatatcagcatcacataaccgctcttgccctttggcattcaacaaatcttcaatgaagtaaccaccatccgtgatagccacccgctcgccaaataaactaacagtttgatagacatatagcggcactgcctcgccggtattgtctagaacatcggtctcaatcttaatcatctctgccataaatctcatcctctgtcccccagggtaacaagggataacgaaatctaacagctgaattttttaacgctatttaaaattacgtggaaaagatgctggcaatggcgcaccaattgatttcacttcatttgagaatggcaaaggtatcttaattgaagccgcatgtaacaataatccgccctcataatcatcagttggattataaagcggatccccaactaatgggtggccaatcgattgcatgtgtaatctaatttgatgagtgcgccccgtttccaagtccagacgaacgagcgtattttggtacaccgtgtgcaccttcgcccaatgagtcaccgcaggaactgcgttaggaccatctacacggcgcgtacggctatcatcagggttttccccaatcgttgccgtaatcacccctgaaggctcattaatcgcaccacgaacccaggctaagtatgtgcgacgaattgttttgtcacgcagcatctggttcagcatcggcaccacgtacgggttcttggcaataatcagcgcacccgttgtgtcaccgtccaagcgatgtaccatgtaagcagcctttccttgcgcttgcaagtacgactgggcgaaattcatcatcgtgccatcttcaccaggtgagtttgggtgcgtcttcacccctttgattttgttgacgaccattaaatcctcattctcaaacaagacgtcaactggccggctatcgtccattacgtaatttgaagttgccacctcaaaatcatttggcaaccacgtcatcgtcaaaatatcccctggctttagaattgttgatgtcggttggtaagtgccgttcaacaaaatacgacgttccatgcggaaattgccacgaatgcgacgtggtaccagccatcgggttaattgttctttaattgaaattgccggttgatcagacggcaagacaatctgcttgatccaagaatccatgggcaacctccttttgatatgtatacaaaaaggcaacctgttttaccaggttgcctttaagccgttattacaacttagtaacgttagcagcttgcaagccacggtcaccttgttgaacttcgaatgatacagcttgtccttcttccaatgacttgaagccgtcaccttggatagctgagaagtgaacgaatacatcgtcacctgactcacgtgaaaggaaaccgaatcccttgtctgcgttaaaccactttactgttccttgttccatgtctgaaacctcctggcacattgccaaattttctaataatccaaaacgaaaatgccagatatttcggtgaaacataaaacaaaatcttttaaactatgtgattagtatagcacgcgtttcctgataaagatatagtgagtttcgaccaattattttttaatttcacaaacccttgctactgttggtccaacagcatatgtttcatgtgaacgaatgttgcttcaagtgtctgtttgaggtgctgatcatatatttcgtagtaaacccggttacccacttcttcacgcgtcaccacttgttgtttcaacaataccgctaaatgctttgacacatttggctgtgaaatgcctgtctgttcaaccaactcgctcacatggaccggaccaggatgcgtcaccatataatccagcaattgcacccggctttcattgcttagcactttgtaaaaagcagccacggcactgattaactgttgttcctgtgtcatcttaattcctcattaaatgctattgcagttgatttccgtgtgtagttcggtctgaatcgtcgtatgcgcgataccgtagtcgtttttcagtgttcgcgtaatctcatctaggtctacgtcgctaaagttctcctggacccccaaatgcgccgttaacgccgcctcggtggttgagatgccccaaatgtgcaaatcgtggactgattttaccgctggatggttgtctaggtatgattcaatccccgcttcatcaataccagctggcacaccgttaaggagcaaattcaacgactgcttaaagacgtcccaggaactaatgacgatgataatgccgataaggactgaaacaatggggtcaatccaattccagcctgtaaatgcaatcaatacacccgagaccaccacgccgactgacacaccagcatcagccaacaagtggatgtaagcacccttagcgttcaaatcgtgctcctgttgaccgctctttgcaaagaagtacgctgataggaaattgataacgataccaaccaaggccacccaaatgatgatgtcaccgtccacgtggcttttcccgttgagcaacttcacaatggcctcaaaccaaataatgcccaccgcaattaacaatagaatggcattcaccgcgctcgccaagatggtcgtgttgtggaagccatatgtgcgcttacgtgttgcctttaatccgaacacaagtactgcgagccacgacagaatcaatgacgcgacgtcactgacactgtgtaaagcgtccgcaaacaaggccgttgatccagctaacttagcaaaaatcatttcaccgatgataaatgccaaattaagtccgataccaattaaatatggcgcttgcttgttttgttcaaattcgtgatgatgatgttcgtgccccatgacatgttcccccgtaatcctaaactaatctatatgccaattatggcatatagattgtgagaattcaaactaaagggcgtaaaaaaatcgcacccagtcgaaaaccagatgcgatttgaatgatctattgtattgggtaaaatcttaccaccaaccgttagccaaacggaattggatggcaccatcgattgaaccgtaacgtgaaacggcgtagttaaccaaaccagcagtttgttgtgcaactgaaccagttccccaactttccttagtttgacccaatccacggtaaccgtttggtgaaacggcgttagggttaccacctgattcaggcataacgattgcgttccacaatgctgaagtaccaccagcagcgataaattggtcgtaaactgaacctgatccggctgccgttgaaacagcaactggtgcagcagtttgttgtgccgttgcggctgcttgtgaagcagcggcctttgatgcggcagctgaagatgcagaagcctctgaggcagcggcttctgatgtggctacgcttgaagctgcagcagctaatgaagcagcttctgatgcggcagctgaagctgcagttgctgcggctgagttagctgatgaagcagcagctgaatccaagtcagcttggttaacttctgctgaagttggtacttcgatttgttggtcaacgaaaatcatgttggcgtctgagatcttgttagtcttaaccaagtcctcaaccgtcatgttaaacttgtcggccaattctgacaaagtatcaccgttttgtacagtgtatgttgatgcggcgtgaacaacttgttgtcctgctaccaatactgatgccaaaccggcaaccgtcaatgctgtttctttcatcttgttcatatctgttataacgctcctacggattgtttttcatgtgcgaacactattgctcaagcacttctcttaatgaggcttacctcgcctcaaccacaagacatagtttaccaagctgacaaggcttaaaattacagaataattacatttgatgtcgaaaccgaccaaacgacccgattttttcgttacattatcgtcacataggggctgttacacgtgtaaacccgcaccatttaaggttttttgctgatgtatttaaccggttaagtaacgcgttttttgtaacgaaactcataaaataaacgccaagaaacggttgtttctcggcgtttaacgttttttgtcatattagcgttacgttgaaaagtaatggttttagaattttcgtaaccaaacttcatcaattccgtgcccaattgtcttgtgtagaatcaaatcggcacgttcgcgagttggcaaaatgtagtcaactaagttaggcaaattaacggtttcccacactttcttcgcagcatcaatcgccgtttggcgcggtacttgcgtccatgcgtagaagaaattgtcaggatcatcagcttcagccgtttgttgcaacaatgcttcaaagcgatccaaataccagtgttcaatcaattctgtctctgcgtcaacataaattgacaagtcaaagaagtccgacaagtaaactggtgagttcggggccgcttgcaaagtattgataccttcaacaatgaagatttcaggtcgctcgaatgtgtcaaactcatctactagtacatcggaaatgtcgtgtgagtactttggcgaacggacaacttcctcaccatccttcaccgcattcatgaattctagcaatgctggcatgtcatacgactctgggaaccccttacggtcaaacagcccttgcgccttcaattcgtcatttggcaacaagaaaccgtccgtcgtcgtcaaggcaacgttatgctcgccatattccgcttgcaacataaattgcaacaaacgagctgtcgttgacttaccaacggccacagaaccggcaataccaataacaaatgggcttggctttgtaacacgccccaaaaagcgttggcgttcttcacggtcacgcaagtattgcgcatgacgtagcttaatgtagtgaaccaatgggtcataaaacattgcaacgtcagccattgaaatttggtcattaaacgccttaatctcacccaaaacagatggcgtaacgtgtgaaacgtcacgatccactggtggctcaactaaaactgaccaatcatcgcgattaaataccgcatagttaagtggtgcctgactcatagtcaattaccccatttcgtaaagttgtgaatccacgtttgccaacaatggcgttagcttgttaatcgcaagaaccgtcaattggtgcatagcacgtgatgcaatggtgtaaaccagttgacgctcgtcatcaccgtgatataccccttctgaggcatcccacataatgacagcatcaaattctagtcccttagccaagtatgcaggcacaatgatggttcctggtaccaagcgttggttttcagtacgaataattgtgacatcggcttggtcacgcaaagcagcataagcagcttctgcgtcagccaatgtcttagtgatgattgctgtcgtctcttcagctgcatcattagctgccaattgtgacaacgtggccgcaatcattgcgtcttgatctggcaataccttaaccagtggcttgtcaccttcacgttcgaaggcatcgatttgcgcaccgttaatcaagatcgcctttgagtagtcagtaatttgttgcgttgaacggtatgtttgcgtcaattgcacatattcagacttctctggatcaaataagtgtgacaactcttcttgcaagctaacggcattttcctttgtaaagatggcttggttcaagtcacccaacatcgtaaagcgcgctcgtgggaagctaaacttcaagaaggccaattggaatggcgtgtagtcttgaatttcatcaatgaagacaaagcggatatcacgctcaccacggctacccttaatcaagtcaaacaacaacataaatggtgtcatatcagccattggcaattcaccagtcttcatcttgttgattgtgttctcaacagacttttgccaatcatccaacgtaatgccgtatgcagacaagtccatcaactttggcaccgtacgcaagaagtgaatgaattgattattaatgttaatgaaacggttgcggttaacacccttagcaatcggtgccaaagcattcgtcacaataatcttggccaagaactttgtctcttcttcatcagacttaaactcgcgtgggttgtcccccaacattgagtcgtattgttccttcgtcaagttttggatttcagcctcaacccagtccgcttgcatttctgtcccgatacgaccttgcaacatcttcatcaaacgttccttggttgcttggagacggttacccaacttgtagttctcgttgaatgagtaataaatctcttcaatcttggcctttgaaatgatttcttgaccacggaacttaattggacgcacctggatgtcggccctgttcaaaccgtcagcgtatgcattcatcgcgttgaagtagtcactggtacccttcatgttgatgatagccttttgagcgccttctggttgcgcttcgaaacgctcttgtagtgtctcaagctgcaacttaggcaaacgacgtgatgcatattggtagtacgtcatttgcaccatgttttgctcacccaattcaggcaacacttggtcgatatagtcattaaacaattggtttggtgagaacatcaccacttgaccagacgtcaagtgaccacggtaacggtatagcaagtacgccacgcgttgtagcacggcagatgtcttaccagaaccagcggctccttgcacgaacaacaaatcagctgccgtgttacggatgatcttgttttgttccttttgaatcgtcgtaacgattgacttcatcttcgtcgttgattcaccagaaacggcgttcaacaacatttggtcaccaaccgcttcgtctgtgtcaaaaattgtgacaatcttaccgtcttcaatttggaattgacgcttcaagtgaacccttgcctcttgcttaccatccggcgtctcatacgttacttgacccaagccagcgtcatagtaaatagaagaaattggtgcacgccagtcataaatcaagaaattgtccggtgaatctgagaatgatgccaatccaatataaattggctcaaacgtctcagaaccgttttcttgcacatcaatacgggcaaagtatggacgagcttgcaagcggtccaataccacggcttggtgttcaactgagttcatggccaattcgcgttcttgcaacatttgttgttgttggcgaacagacatggccgtttcgaacaagctaccataagtaaatgacttgaagcggacgtcgttccatccagcttcaacatcagcttgcttttgctcgttgttttgtcgatctaaatcattttttacctttgcgtcttgaatcttttccaagaccacatccaagcgttgttgctcggcttcgtatggttccatactgggtcccctccagctaaaattagtgattccatggtactacactttaaggttatttaccagagtgtttttaatggtttggtttgtgggtcacggtttgtgtcgtcgcttgatagtcatagataaaggtttccattatatatagtagaaacatctataaaataaaaattgcttgccctacatctctgttagacaagcaatttagaattttcgttagtattaatcttcttgtgcgtaatcagtaacgatcaagtgctccaagaagtcgcgtgcgtctgtttcgtcggtggtgccggctgcgatttctgcttcgacagctgccttaatcttttcggtaactgctgcactttccatatcagctgcaatgacatgaacacggtggaaactgtcagaccaataaacctcagttggtccccaagtgttcaaatccaacttctttacccaatcttgaacttcttgctttgtgtatgccatgataaacacctccaactactcatacgtagcgctttttttatttcttttttattacatgattagtatagaacaaccgaaatctaatggcgaaaataaggtatccaaatttgcgtcaaaaaataaacaacttgaatctattttttcagacgccagatatatatgattttttgcataaattcagtggatattcaaaacggcaaagtccccgttatggagactttgccgtttgtttttaaagattaatcttcttcgattgccaattcgatgtcttctacgtcatccgctgaattgtcttcagcagcgtcgtctgaaccatcgtggcttccgatgtatgcttcacgaacttgtgcgtagatatcatcgtaaatatccttgtgttctgggtcttccaaccagcgaataacgttgacctttccttgaccgatcttctcgccgttgtatgagaaccatgatcctgacttcacgataatgtccttatcagcagccaaatcgatcatttcaccagtctttgaaattcccttaccaaacaagatttcaacttccacttcacggaatggtgctgcaaccttgttcttcacaaccttgatacgggtaacgttaccaactgacttcacatcgtcaccgtcagccttggtagcatcgataccacccttacgacgaacgtccaaacgtactgatgagtagaacttcaatgcacgtccaccaggtgtcgtttctgggttaccaaacatgataccaatcttttcacgcaattggttgataaagattgcagtcgtaccagtcttcaagatagcacctgacatcttacgcaaagcttgtgacatcatacgggcttgcaaaccgacagttgagtcaccaatttcaccgtcgatttcggccttaggcgtcaaagcagcaactgagtcgacaacaaccatgtcgatggcacctgatgtaatcaaggcatccgcaatggccaatccttgttcaccagtatctggttgtgatagcaacaattcgtcaacatcaacacccaatgccttggcgtattcaacgtccatagcattttccgcgtcaatataagcaacgattccgccgttacgttgtgcttcagcaaccgcgtgcaaagccaacgtcgtcttacctgatgattcaggtccgtagatttcgatgatacgtcccttagggtaaccaccaattccaagggccacgtccaacttcaatgatccagttgacgttgattggaccttcgtgaattggctatcaccaagcttcataactgaacccttaccaaaagacttttcaatcttcttcaaggcttcgttcaacgcagcttgacgctcctttgggtccgcaatctttccttcaagcttcttatttgggttaatgttctttcctgatgccatttttatcggcctccacttgttaacttaaacttaatatacacctagtgtaacctaattcaatttagaattcaattctttttcgtgctaattcgcgatttgtttgattttgtctgccaataagtcaaatgctgccgcaactgattgttgacgaacttgctgacgattgccatcaaatttaaacttcgttaccactactgtaccatctggagccgcaatcccaataaacaccgtaccggctgggtgaccttctaacgcatctgggccagccacaccagtgaaactcacaccccacgcggtcttcagttcacgttttgccccgctcgccatgctctcggcaacttcagctgacacaacacccactttatcaatcaaatcggccggcacgccaaccaattgcgtctttgcagccgcagcgtaggtcacaaatgcacctggcaacacagctgaaatgcctggcacctctgctaacgtactgacaaacaatccggccgtcaacgactcggccgatgtaatgctctcgtgtcgcgcaatcaaggcttggccaacttcaatatttttcattctgcacccctttcaataataaagacgcagtaatcgctaatttttccaattttcgtttgattcaattgtataacaaaagaggtagtccaacacaacaagtgtcaaactacctcttcattcaattttttacttgaaaccgtcagagaaaacgtcgcggttcttgtagaaataatcaattcctgagtagattgttgcaagcaaggcaatccaaatcataatcattgcaaatgggatgttgaacatcgcaaagacaatgtcgtgtagcaagaagaatgagatagcaaccatttgtgatgctgtcttaatcttacctggcattgctgctgccaacaccttaccattgttttcaacaatcaacgtacgcaaaccagtgatggccaactcgcgaataacgatgatggcaaccatccaagctggcacccaaccgaattgaacgaagaaaatcaacgccgtcataaccaacaacttgtcagccaatggatcagcaaactttccaaagttcgtcaccaacttgtacttgcgcgcaatctttccgtccgcaaggtccgtcaatgaagcaacaataaagataattgctgcaactaggtgtgtgactggcaaaactgccccagccacttgcaacgttccccaatcaagtggcaacgcaagtaccaacatgaaaacaggaatcaaaatcatacggaaaaccgtcaacttattaggcaaattcattctttatctaccccactaagtttagcgttggaacgtcatgtttgcgttccaaacgatggcgttgttgttcatcaagttaacgtctgaaccatccaaagacatcttcgtaaccgttgcgttaccgattgaaacgctgataccagttactgaagcaggaatcttaacatcttggttaccgttagcttgcaacgtaccgttccacaaaacagtgccggctgcatccttaacttgaatccatgatgctcccgttgacttcaagttcaacgtcatgtccttatcagctggtgccttaacagcagcgtacgttaccgtgttaccagttgccgcacccgttccaaggtcaaccttgttatcatccttcttctctgatgattccttctttgaagactccttcttagaagatgacttctttgattcgtcagtcgttgactttgactctgaagatgatgaaacagatgacacctttgaagttgtcactgaaacagatgattcgttcttgctttgttgatttgctgaaccagcaaatgaggcaacaacagcccagataacggcgatgattgcaatcacagcaacaccaatcaaaatctttggcatcatttgacgtgtcttatcagcagccgtttcttcaaccttgtgcatccccgcgcgagtcacgttatctgcatcgacgcgagcaccgctcaaatcaggttcaaccgtttctgtggtgatgtcatggttcttcataaaatcagcaacatcaagtccaactgcattagcatattgacgcacgaatgcacgctcgtaaaatgcccctggcaattgatcaaattggccattttcaattgcagctaggtagcgcttttgaatctttgtcgtttgttgaatatcgtcaagggatagccccttatcaagacgagccttttgtagctcttgtccgatgacgctgttgcgttcttcgttcattagtctctcatccttaactattttttatcagtataattgcatatatctatactaccacatattatcgacattcggacgcgcaataacggtcgaaaggtcactaatttcggcatgcataagtatgtcataaacgctttgcacatcaaggctctgcaagacattaatttcatcgcgcaatgttgcaaaatcaaaggtcttcccttcaaatcgcgtgacaatttcttcaagttgattgaacttgctaatcaagcgacccaaggcgtcttttttcaccaattcaaaatcggcagataatgctttaaagcgctcagccaagttcgctaattcatctgaaacggcatcaatcaattcatcagcttcaggtgtttccgctgcaatggtcaagaaggccacgcctcgttcccagtcaaattcggcgctgaatgtatcatcaatcatccccgagtcataccacatcatataagttggtgaaaactcgccaaacaccaaatcaactgccaagctaccggcgatggcaatgcgtaaagcatccatccccgttggcatcgtcgccccatcgtaccaacgttggccgatagcgatttttgtgcgcacgatatccatatcaacttcaagcggttctgtaataactggcgccaatgtcttagttggcactgtaatattcgcgctagcttgacgtgaactaattggtgcatccatcacaagttgacgaacagcatccacatcaaaagcacccgcaacgacaatgtccatattttccggacggtagaacgcatcaaaggcagcctgcaaatcagccggcgtgacgctgtgcactgattcagtcgtaccagcaatatcgtcagccatcggatcaccagggaacaattgacctaaaattagtcgatacaagcgggcattcgtatcatcttgatacatatccacttcttgtgaaatgatatcgcgctcacgcgcaacggaactctcttcgaaataaggctcttgtgtgaaatgcaacaattctgagaaagccgcatattcattagcaggggctgtcatgaagtagcttgtgcgagtctgcgtcgtgaacgcatttgcattcgcacccagttcactcatacgtgaaaaggcatcataaccaggttgcgcaaacaacttgtgttccaaaaagtgtgcgagaccagctggttgcttaaccaattggccatcctgcataaacgtctgatcacgcgcaccaaaatcaaccgttaccatccccacaaattggtgaaaatcaggccgtggcaaaatatgcaatcgtgccccatttggcaatgtttcatgacgctcattaggcgcaaaacgactcaatgcatcaaccattatgccttacctcctaccaattcataatgcagttgtttcgtgactgcttgggccacttgttggacctgttctgccgtcactgaatcaaccgctgccagccactcctcaggtgtcgtgtgataaccaatcaattcttgattctgcacacgctccgtaatgcgaccaggttggtcaagcgaaaccacataatcagccttcatcaaacccttaatcatgtttagttcatcatcgccaactagttctgtttgaaggcgcgtcaattcagcatcaatccgctcctcagcctctactagcttggcgtgatcaacacccgactccaccatcaacaaacctgtatagggattgtaatctgaataaattgagtaagataaaccggctgtttcacggacattcataaacaaacgtgaaacagcaaggccaccaaacaatgcattaaagacgaaaccttggaaacggtctgtctgttctagcttcaattgataagccaaaattagacgagcttggttcaccttatcaagctccaccgtacgctttacagctgggaataagtcttgttcataataaggattcccagcgatggcacgtggttccaacggcaattgcgccactgcttgttcaaccgttgcagtgtccacatcacccaatacgataatatccacacggtcgtgcgccatagtgtcttgccaagcatcccacgcctcttttggtgagaccttttcaaggattttggtcgtgccataggctggcacagcttgcactggatcggtgaaataagcattaattgcttggcgtgccgcgtagaacggcttctcttcttgtagcccagcgatttcatctaaggcaatttcacgctgacgttcaaaaacagttggatcaaagccttgttcagcatcacccaatggattgcacatcatctcgcgaataaacgcaaagccatcgcgcaacaaactctgtgaatccgttgcaaaatcatcatgcaccaacgtcattcgcaaacgtagtgtgtgcaatgctcccgtcttcagtacatctgtcccaaacgatgccccgtatagatcactcaacacacgcgccaacgcagtctgtgagggatatttttgtgaagctgtttcaagcatgttacttgccaacacgcggccacccaatgaggccacgtcatgttggcgagtaaagttaattaaaattcttgtcgttgcaaattgctgagttggcaaaatatgcagaaaaacgccaggttgaacggttactgtagtcactgacataccttcttttccaaactaaaagcgcgctggtaatgaacgcgcttgttttttattgtcgtacaattcgagtctgcgaactcgtcatagtaacgaatattttgtgcagaaactaatactataagtataaacttctgcgtcctattttaccaactcaatttccttggtcgtcagcttcttccgatgacgttacagtcactggatttaaacgcatatattcagatacaaacataaagacgctcactgctgccatacccactaataagacaacaacactccatgtattcaacacgggcgctgtatagtgcaataggtacaaaacaaacagaatacccgtcaggttgtaccacacccatcggacccatttattatgccaaatcatcatgatactctccctgaatcatttagtttgtgaaatatttaatatgtttatatttacaaataaaaaagcgcaaactgaactgaaccccgaaaattggagtgacgtttaagcggctaactggtcggaaagagcttagcttgatgaccctacacatttgtttcatcgaaacgatattcagttttcaatgacctacgtcgttgcctcatcagacaacttatatatcttaacagttgatgaaacgaatgtcaacaacttgtttgaagataattttttgaagtgtgtcacgcggataactcgtaccccgtaacaacttaatctatattacagatacagttaccaattgtcaacactttcttcaaactttgttgcatatatttcgcacaaaaaagagcgatgcccaaatctaggcatcgctccttaattattaattgttattaacgcattgttgggaacaacaaaacgtctcgaatcgtatctgtatcagtcaacaacataaccaaacgatcgattccgattcccaatccaccagtaggtggcataccgtattccaaagcctcgataaagtcttcgtcaataccttccgcctcatcgttaccagcggcacgttctgcagcttgtgcttcaaaacgctcacgttggtcaattgggtcgttcaattcagtaaaggcattaccatattcagcaccgacgatgaacaattcgaagcgatccgtaaagcggtcgtcttcttcgttcttcttggccaatggtgacacatccactgggtgtccgtaaacgaatgtaggttgaatcaacgtatcctcaacaaacgtctcgaagaactcgttgatgatgtgaccaacaccccagtattgttcatacttaacacccttttcgtcagcgatagcacgtgcttcttccaacgtcattggttgccagaagtctacgccagtctcttccttgatcaaatcaaccatgtgcttacgagcaaatggctttgccaagtcgatatcgtgaccttggtacgtaatcttcaagtcatcagttacagcggctgcagcggccttgatgatgttctcagtttctaccatgacatcttcaaagttccagtatgcagcatacgtttcgataaccgtgaattcagggttgtgcttagggtccattccttcgttacggaagacacgaccaatttcataaacacgttccatgccaccaacaatcaaacgcttcaagtgcaactccaatgcgatacgcatgtacaagtcgatatccaaagcgttgtggtgtgtgataaatggtcgagctgacgcaccaccagcttcgttttgaagcattggcgtctcaacttcaataaagccttcgccatccaagtagtgacgaatagccgtaatgatctttgaacgcttaacaaagcgatcgaatgaatcgtcgttagcaatcaagtccaagtaacgttgacggtacttcgtctccacgtcagtcaaaccgtggtacttgtctggcaatggacgcaaagcctttgacaagtgtgtgattgacgtgacgttgattgacaactcaccagcacgcgtcttcataaccgtaccagtgaaaccaaggatatctcccaagtcagccttcttcaacaactcgtattgctcttcacctacaactggcttttgtacaaagacttggacacgtcctgaacggtccttaatatccgcaaaactaatctttcctgaacgacgcttcgtcatcatacgaccagcgatagttacttcgatagcttgctcttccaaatcttctgcagttgcgttgtcatacaactcgtgcaattctgcagccgtgtgtgaacgctcaaagcggtgtccgaatggatccatgccagcttcgcgcatttcagccatcttgtcacggcgtgcgatcatttggtcattcaatgacacttcttggtcagccattatgttgcctctttttctttcaataatttgtgttggtatttctaccacagatacttattagtttgccaatattggccactttttgcaagtgcctcgcccaaaattacaatccttcggcatccttagctgcaataatacctgccaactctgcttcatcgaattgaatcttcttgcccgtaaagcgatcaaccacttcgacaccgtggtcttcatcaagcatttcgtgcaaatccttcattggcaaagtagccaacatgcgctcatactcgcgctttgaaatttcagggtaaagagatacttcggtcgtcgtcaattgcttaacgttatccttaccaaacaagttagccaacaaatccattggggcgtgaccttcaagcagttgtgatgagatagctggtacatgggccaacttctcttccaaagccgtaatgtcctcatcagctgcatctggcaacgctgaaatcatgaacccaccagcggcagcaactgtaccatcaggatcaaccaagactgaaaccgcaacggcagaagggatttgttctgacttggccatgtagtaagtcaaatcatccccaatctcaccagttaccaattgtacttgacccgtaaacggctcaccttcaccaaaatccttggtcactgacaagaacccgttgttaccaacagctccagcaacgtcttgttgtcccatcgccgtcaatggcaattcaacagttggattcgtcacgtaaccacgcacttcaccttgtgctgatgcttcaacaacaatcttacccactggaccgttaccgtccatgacaaccgccaagcgttcttcacccttcaagacagcgtttgaaaccatcaaagaacccaacaatgcacgaccaagaaccgtcgtacccaattgtgatgcttcgtggaacgttgcaacttcacgcatcatttctgttgcgtcgatggcaatcgcacggaagtttccgtcagtcgtcaccgcacgtacaagtgtatctgtcatcttttcatgcctcttatttttcgtatatttctgtctaccagtttaacacattcaccatatagaaaagagacgtgaacgattactcattcacgtctctaatagtcattattcttgatcaagcttacgtggttgcaaaacttcaaccttaacagctggttgtgcatcctcatcggccgtcaacttgctgttggcagcttccttagcttcatcatatgacattggcgtttcaacattcttttcaaccttggtcgtctctggcatcttaccagtttcgaacaagctcaagatttgcttctcatccaacgtctcgtactccaacaaagccttcgcaattgctgcgtgcttgtccttgtactcttcgatgatttcgtgcgccttgttgtaaccctcagtcgtaatacgacgaacttcttcgtcaatcaaacgagctgtctcgtcagagtaggcagctgactcaccgtatgaacgacccaagaatggttgaccaccattctcaagttgtaccataccaagcttgtctgacataccatattccgtaaccattgagcgggcaatgttagttgcttgctcaaagtcgtttgaggcacctgatgattgttggtcgaagatgatttcttcggccgcacgtccacccatcaaaccagcaatttgatccatggcgtccgtcttgttcatcaacatttggtcttcacgtggcaacatgattgcatatccgccggcgcgtccacgtggcacaatcgttaccttgtggacaacacgagcttcattcaaaaccaaaccaacgatggcgtgaccagcttcgtggtaagcaaccgtctcacgttccttagcagaaacaacacggtccttcttagctggtcccgcaataacacggtcctcagcttcatccacgtccttggcgtaaatcgtatcgtggttttgacgagcagccaacaaggccgcttcgttcaataagttttccaagtcggctccgacgaaaccaggtgtttgcttagcaatttccttcaaatccacgtcgtcagccaatggcttgttcttagcgtggacgtgcaagattgcctcacgacccttaacgtctggacgaccaaccaaaatctttcggtcgaaacgacctggacgaagcaaagctgggtccaagacatctgaacggttagtagcggccattacaatgacaccttcgctacctgagaacccgtccatttcaaccaacatttggttcaacgtttgctcacgctcatcgtgaccaccgcccatgccggcgccacgttgacgaccgaccgcatcaatttcatcgataaagatgattgatggcgcagccttcttagcgttatcaaacaaatcacggacacggctggcaccgacaccgacgaacatctccacaaagtcagaacctgaaattgagaagaatggtacgccagcttcaccggcaacggcacgggccaacaatgtcttacctgttcctggaggcccctcaagaagaacaccagatgggatacgagctcccaacttcaagaacttcttaggatccttcaagaattcaacaacttcaaccaattcttgcttttcttcttcagcaccagcaacgtccgcaaagcgaaccttgttctctgaaggatcagctggcttagcctttgacttaccgaagcccatcatgttgccacgaccgccttgtccgccttggctcatgccacccatcatcaagtagaacacaccaatcatcaacaagattggcaagaatgaaatggccatgttaccccagaagtttgaagcttctggctttgttgtgatttcagtcttcgtcttatccgcagccttttgcaagctctccataattggatcgttgctaatgacttgggtttcgaatcctgtcaccttatttgaagcaccaccaactagtgagacaagagaatcatcctttgaactcttatccgtttgtgccttacgatattcacccttaacgtcataaacaccagcgccaggttgaatcgtgatggttttaatcttcttgtcgcgcaattccgtcatgaatgtcgacgtagagatagtcttcgtactagtcgtttgagaaggaccggctacccagtaaatcaaacccataataccgaggactacgattacgtagaacaaactattccggacaaaattgccgtttcgttgattcttcatctattcctcctacagatagttactactaccttcgttgcatcattattatgtttccgagacagaaattagtgctcaggcgtgatgtcgattgtatcgaccttgtccgcgtgggcaggatcataaacttcacgcttcaagacaccaacatatggcaagttacggtacagttgcttgtaatccaaaccgtacccaactacgaacgcctttggaacatcgaaaccgatgtaatcaaccgttgcttcaacaacacggccttccttcttatcaagcaagctggcaaccttaactgacttcgcaccacgttccatcaacaagtcgatcatgaacttcaatgaacgaccagtgtcgacgatgtcttccataatgatgatatcgcgacctgaaatgtcggtttgcaaatcagtgaccatttgaacttcacctgatgaagcaacgccaccgttataactagaaacgtcgataaattcaacttcagcgtattgcatgtgacgcataacgtcgaccgtccaaagtacggcacccttcaaaactgacaaaatgattggtgtacgtccttcgtaatcggcagccagttgcttaccaacacgctctgctgcttcggcaatatcagcttcgctataaagcacacgctcgatatcgttattcatgtcccattggttcatgtcttttcaatctcctaaatcttaattcccctatcgttacatagcattaagaataccatgtttgatggtaaatgtttagtgctacacctaaaagaaatgtgaacgctttattcttttcgtgaaagcaataagtggttttcgaaacgttctaactgcaagccattcccaaggtcaatgaaacctcggttaacattcggattgcgcattaactgaattgcttgtgttaactgactatcttttacagcaaaaacgtgttttttagtcaaccacgtctgcaaaaccagcaacaagaccgcctcgtcgacgcgccaatccaagcgaccatcttctaacgccttcacgtgcacattaatcgaaccactcgccagcttctgtaatgccgcaagttgatcagcgaatgcaatgacgtgatcctttgtttgctcgttaatttcttctagtgccggcacaacagtatgtcgcatacgattgcgggcaaacgtttcatccgcatttgtatagtcttcaacccattcaactaacggttcgttgaccaactgacccagcatcgctttatcaagttgcaacaccggacgaatcaaatcaatgtcaccctgcaactgttgctttttggccatccccaacaactgcgtcaaacgactgccgcgtgccaacttgtacaaaattgtttcgacctgatcacccttatggtgggccgtgacaattgcgttcgcaccaacttcacgtgcgatggcgaccaatgcctcgtaacgcttttcgcgtgccaattcttcaacaccagccgtcggcaccgtatcccaagtgagctggcgaatcgtcgcgcttgccaaattaggcgtttgcgcaaatacgcgttcgactaaggcttgctcggcatccgcatccgtacgcaattgatgattgatgtatgccgcactcacaattggttgaatatcagccggcaatgaattgtccgttagccaacgcaaaacatgcagtgagtcttgaccacccgaaactgccaccaacacatggtcacgtttatcaaataatctttcttcccgaatcattcgcgttaaattagctcgcacaactttatcttgcatgattctctcccgttatttaatacttgccattattatatcgctaatcgaaaaataaaaggacaatcagtcgtctgattgtcccttttgttgattattatttattcacccggtaagttgaagacaacttcaccgtctttactgtacatgtacttttcacgaatcagcttttccagatacgaattatcgcccaagtctttaacttcttgtttgaggttcgcgttagttttgttagccttatctaggtttgacttcgctgtctcaagactctgagaagccgcctcgtacttaacgtactgcgtatggtaattaaccatcgcgaaaatcgtgacaacgaccatcaccgcgactaatacaacacggcgacgtaagtgcactacttgatggtaacgcatcttgcgctcttcaagatttaattggttggcgctcttagcgttcagcggcgtgatatttgattgtttgttaactgccatcattccgctgacctccccgagataatttgagcggacactctaatttagacctacaccattaaccaattctcctatgctcttactgtacagtagacaccggataatcttaagcaggattacctttccttaaccttttcgtatcaaaacctaacggatagttatccacaagcacctttcaccacatttttataacatttactaaaaaaagacgccctattttgggcgtcttttcatcttacttaattttcttcgttactgaagtcttgctcgtatgattctgacacaatgctatacatgtgttctgcttgttccttacgcacaacttcggccgtactttcaaccttaagtacagatgtcttgtttccaaaacgaatcgtcaactcgtcacccgtcttaacgtcattggaagacttcgctgtcttaccattgatatcaatacgaccttgatcggcgatttccttagcaaccgtacggcgcttaatgatacgtgaaaccttcaaatacttatccaaacgcattattttcttcctcgatttataaactgataaatttggcgacctttaggcaaagcatcccactctgcctcttccagtagtgctgtccaccacaacattaaaacaaaggcagtcgcaccgacacccactccaacgactgtcgtcaaaacactcgccaggcgcgtcgcaccaaataggctatgccctagtatatacgcaagacgggccaaaatgccaaccgcgagtaaaattgcaatcaatttgcgccaccatttctttggcacccaacttatccacaggcttttaggcaagcgaacgagcgtaaatattaagaatgggagcaatgcgccaaccgttgccagcgacgcaccagcgataccaaaaattggtaccaaccagatgttaagccccgctttcactaacatggttagtaagacaaaccagcccaagccacgcgtcttatcaaaactttgcaaaacacttgtcgacacaacaatcagtgtcgccggcacaatgctaatcgtgaacagcgccagtgcgtcactgccagctgatgaaccaaacaacaattgattaaccgatggcataatggccaccaatccaaccgtcgcaacaccagaaagcaaaatagaaagtcgcatcgtcaattggaaatcattacgcaacgcttgttcatcacgtcgaatgacatgctggcgcaaggccggcaacaatgatgtgccaagaccagttgccaagaccatccccaattgaaccaacggttgaccacgatcataaatccccttagtgaactcagcctggtgtgctgttaatccggcgtcttgtagcaataactttgttgagaacgaatcaaccagttgcaacaaaaccaacaatgccgctagcatcgctaacaacccaccttcgcgccacaaacgaccaaataaatggcgccagcttaatgttttcttctgcttgactgtctcatcaatcggcagtgaccaaatgtgacgtagcgacgttgctaagaataacgttgcggctagtccggcaatcgttgcaccaaaggttgcccactcaccaatccgatagacggaccagtcggcgtgaacaccccaccaggccaccccgataataatcgccacccggacaatttgttcaatcacttgtgacattgctgtcggcaccatgttcaattgtccttgcgcataaccacgtccgattgccaaaaatggcatgaaccagaacatccaggcaacagcgcgtacaactgggtacaatttcaaatcgccacccatcagcaatgacaagggcgccgcaccgccatacacaatcgtgaataacacggcgctaatgccaactagcgaccaaaacaaacgtcgtgccaccagttgttgatgcatttcatccggttgctctgtaatgatttttgaaataaacaatggccaaccactcaaggctagcaccataccgataccgtagattgggtagacctgctgataaacatagaaaccagtattaccgactaggttttggaacggcacgcgatacaccgcgctcagcaccttggcgattaagcctgacaccgctaaaacaccggcaccggccatcaaattctgacttgttttaggcattggcaactccttcttcaggagctagcgtgttaaacaccgtcaacaagcctgttagccattcttcagccgtttgatttggttgaattggcacttcagccttaactggatctggcacgacaacctggccacgcaccttggctagtgccaacgcttgggtaaactgttgcgccgtaaactttgaacgggcatcgaacgtcacaaccaaaatgttttgacgcttaaagtcacgacgaatcgttgcaataccaacgcggtcagctgccgccttaagacgtccaaccaacaataaacgttgcgcagcttctggcaactcgccaaagcgatccaacaaatcatcttcaatttcttcgaactcagcggatgtcttagccttacgaatacgttgatacaaatcaatcttttgtggaccatctgctacatagtctgccggcaagtacgcttcaacttgcacatcaagttcagcatcgaacgtttgcttacgcttaccttgcttttcagcaacggcttcattcaacatttgcgtgtacaaatcatatccaaccgcgttaatgaagccgtgttgtgattgacccagtaggtcacccgcaccacgaatcgacaaatcacgcatcgcaatcttaaaaccagaacctagctccgtgaaatcacgaatggccgtcaaacgcttttcgctttcctcgttcaacgaacgcgttcccggatacgtaaagtacgcataggcaatattgtttgaacgtccaacgcgaccacgcaactgataaagttgtgccagacccatgtgatcagcattttcaacaaacagcgtattcgcatttggaatgtccacacctgtttcgataatggttgtcgtcaccagaacgtcgtattcacggttaatgaaatcaaccagaataccttccatttgggcctcggtcatttgaccgtggatataaccaacccgcgcatccggtaccaaggactcaatcatcgccgtgacttgttcaatatcttccacacggttgtggagataatacgtttggccgccacgcgccatttctcgttcaatcgcgcttgccgtcacacgcccattttgttccataacatacgtttgaattggataacggttggccggcggtgtttcaataacagacaaatcgcgaacgccgaccatcgccatgttcaaagtacgtgggattggcgtggcagttagcgtcaagacgtcaacattcgtttgcaatgccttcaaacgttccttgtgtttcacaccaaaacgttgttcctcgtcgataatcaacaaacccaagtcaccaaactcaatatccttagacaaaatacggtgcgtaccgaccacgacatcaattgtgtggttcttcagcccttcctttgtttcgtccatttgtttcttagtttggaaacgagacatgatggccacattaacaccaaacccatcaaaacgactcaacattgattcatagtgttgctgggccaaaatcgtcgttggcaccagcatcgcaacttgcttaccatcgtgcaccgccttaaaggctgcgcgcaaggcaacttccgtcttaccaaagccaacatccccgaccaacaagcgatccatcggacgtgacttctccatatcagccttgatttccttcgttgatcgaatttgatcaggggtttcagggtatgggaaagcatcttcaaaggcgcgaataacatcatcatctggcgcgaaggcatacccttgcttcaactcacgctcggcatatagctggagcaattcatccgcaatgtcttcaaccttcttagcaaccttggccttagccttctgccattccgtgccacccaacttattaatcttaggggccttctcagccgcgccgacatacttttgtaccaagtccaattgcgtgaccggaatgaaaatcttcgcatccttttggtaggcaatcgtgatgtagtcctgcttaacgccacggttttcaatcgtttgcatgccttcatagacaccgacaccgtggttcacgtgaaccacatagtcaccgggctttagttcgttataactcttaatacgttccgcgtttgatagcgtttggcgcttaggagccttcttgcgaacttgctggaacaattcacgttccgtcaacacaatcaacttttgggctggcaattcaaaaccagcactcagtggcatggtcgtcacttgggttcgcccgggcgccaaagcatccggcgccacctcattgattttgacaccgaaatcagccaacgtttgcaccaacttagcttgtcgctcggttgtattcgtcaaaaagataatggtttcacccgacttctgccagcgtgctacttcactcttcaacattggcatttggccaaaaaattgttgcgctggacgtaccgtcaaattcgtcaaacttgtctgacgcaattgaccaattccacgttgcaatggcgagaataccaaactagcttgttgcacatcacgcgccaaatctgccaattgccaacctaaatcagggtctggcaagacgcgttgctcggccatctcatccgtccaccaattttggttatccaacgtgatttgatcggcgttttccaacgcacgtggataatcatcaaacaccgcgataccatcagcaggcaaataatctaacagactcactgcgtcagggtaaaggatgtgcaaatattgacgaatttctggcaacaaaccaccctggctcatcattgacaataatgggctcatcgcttcagtcaaatgacgcttatcagcgccgtccaacttatcgcgggcttcggtcatggcaacttccaaatttgtcgtggctgttgctaaatcatccgcatcaattaccaaatctgttgctggcaaaatcgtgatgctgtccaggttttctaggctgcgttgcgtttctgcgtcaaaactacgtagtgaatccaatgccgtatcaaagaagtccaaacgcaccggattgtcggcatccaatggataaatatcaacaattgaaccacgcacagcaaattcacccggttgttcaactgatccattacgctgatatcccatctgaaccaacttcgcctgcaactcagctaattcatagtcatggttaaaatcaagcgtaatcgcagcatccgcaaacgccttaactggtggcaagtatcgcatgacacccgcaacgccagtcacaaccactgcctgtggatccgttagcaataggtgcaacgcttgcacccgagccaatcgcgtatctaatgatgtcacggccacttctgcagataacgtttcctcagctgggaaaaccgcgacgtgttcatcacccaacatggcggccaaatcttcagctaattgatccgcgtgaaactggctatcaccaaccacaaccattgggcgttgggtttcttgttgcaatgccgccaaatacaccgtgcgcgcggtgccggaaatcccggtcatcaaatgacggccaccttttttcagaccagatgcgagttgttgaaactcagcatcttgctgaagtagacctgtaatttccatgctgtacctcttagttaaacttgttcatcaatgttggcatgtcagccccagatgcgaacgcctcaaagatgtcgagtgacttatcaataccaccaagcatctcaggctcttcatccttaccaaacttgcccaagacaaagtccacaacggccttttgtacgtgagcagggtgcccgataccaaacttcaaacgattgaaagtttgcgtatccaagtgttgcgcaatactcttaatcccattgtgaccaccggctgaacccttttgacgcaaacgcaaacggccaagatccatatccatatcatcttgtacaaccagcaagtcagcgatgtccaaatcgtagtaatccatcaatggacgcactgcacgacccgaatcattcatgtaagtcgttggctttaccaacaaaaccttctcgccatcaatacgcacatcagctacaaatgcgttatgtgccccatcttgcttaaaggatgcactgtacttatctgccaacgcatcaactgtcataaagccaatgttgtgacgcgtacggtcatattccttaccaatatttcccaaaccaacaatcatcttcatcagtatcatctcctatttgaaacgcgcgctaaacgcacgaaaggggcagagccacaatgaccctaccctgttaatgccttattaatactaatattttaccctatttctcggattagtgggcaaaaaataccgttgagataatatacaaaacagcgatgtgcgttgggtaaaagatgtagaagaaccacttgtctttacgcccttgcttgccgttatacaacgcaagcaacggtgtggcaaaaatcatcatccattggtaatcgctaaagccgtgcatggctgattgccacaacaagaacaagctaaagatgacgaaaatcgtcaaaccaatccaacgcttatcgcggaaaatatggaacactagtccaagcaaaatccaaccaataccaccttcaactgtaagtgcagttgggataacgcttgaactcaagataatcaaaaacatgttttggcttgctgatgcggcattcaataatgtcaacgccagaactggtccgaacaccaagaaggccaagcccaacagtccccatgcaaagcgcttaggttcttgctttgggtgcttcaaactatcccaagtccacatggcaataatcgttaagaacagcgtcccgaaaattgaattaatcatcaccacatgatcatttggcaaagcttgttgcaagatcataatcaccacattggtaatccagaaaccaatcaacagattacgcaaataaccaacccgactgtgcgtgtagtggaacccttccgctgccaagaacaagaagattggcgctacaatacgtcccaacatattcaaccagtctggtgcaccaacataactaaacatctcgtgcgtgtggtcagcgaccatcaacacaattccaatcattttaagcgtaaaactcgtcaacccatacttctcttgtaacttatcaagcatcacaatctctccgtatacctttatttgaacaatactatacattgtataatatgtggtggctaggatttaggcttgtttattttttccattaaattgaaattttaaaattagggtcggtggccggcttcgacacaaacaacaaaagaggtgcaacgccagaacgttacacctcttctaattattgttgcttaataatagctaacccagtcttgcgactaaattgcatcatttcgtgttgcccatccttgtggaaggcgtaaataagtgtatctgaatcaatcgcgtggcattcaaaccaatccgctgattgccaccacgttggtcgtgattgtaacaagcgttggaatttgttgaaaatctcaccgcgtggctcgtcccaagggaagtaaccacggttttccggatccttaccacccgtcatccccatctcatcaccgtagtaaacacatggtacaccaggcatcgtcaaccacaattccaaggcgcgcttcaacttctcttcgtcttcacccatttcagtgaacaaacgctttgtgtcgtgtgttcccatgttcgtaaacgccccgaaaaaggcattctttgggtagttagactccaaggtcatcaaaacggtcgtaaagacacgtgcatcgatttcttctagcatgaaatccaaaatcaggtttcgcaaaggatagtgcatggttgcttgcaacccaccaccgagcaagtattgacggcgctggtcgtacgcaaccttattcgatgcatcttcccaaacttctccaatcaacacttgttctttactcatctgatcacgaataccagcaatgaaatcatccggcagctcgtcggccacgtccaaacgccagccatcaacgccaaagttattccagtggttaatcaccgagtccttatcaccgtaaataaacttacgataactcgcttcacttttattaatcaccggtaaatccttcacaccccaccatgagttgtactcatctgggaaatccgtgaaatcaaaccaatgataatactttgatgatgggccttgatatgcccccggctccttgaagtgaccgtccttattaaagtaacgcgaatattggccaacgtggttaaacacaccatccaaaataatgtgcatgccacgcttgtgcgcctcatctaacaaaaacttgaaatcatcctcgtcacctaagataggatctagcgccagatagtctgatgtgtcataacggtgatttgaattagcttcaaaaatcgggctcagataaatagcgttacatcccaattccagaatgtaatctagcttttctgcaatcccttggaagttaccaccaaagaattcccaacgggcaatctcaccttgcttatcacgcacatagaatggcgtatcacgcttattcgcataaatgaacgaatttggctttggattgttaacgtgcatgtctttgtttccgttgttaaaacggtcaacgaagatgtgatagaaacgcgcctcctgataccattctggcaactcttccaactcggccatcaccgtaatttgaaagtcaggaattgatgcgtgatgcataccataaacttcagctgccccacccaagttatttccttgggcagccaaccagtactggttatacccatcaatcacttcaaaacgatagtaaagcaaaccggcatgggctgctgaaatttcaacaacccagttatcctcgtcttcttcatgcaaatcgtaccaagtgaccttacccgtttcgtcatcgtaaacacgtagtcgtacttcttcagcatgtccttgcgtgtgcaacgtgatagtttcaccgacaataactgctccaaacggatcgcggtttgcgaccaaaaatgaatcaaactccatcgtggtcacaccttacttgctttcttgttgtgcaagcgccttgtgtggaatattccaaatttcatcagcatactcagcaactgtgtagtcagctgagaactctccgcttgctgcaatgttcgccaacgccttacgcgtccatgccgtcttgttttggtagtcttgtcccaaacgcgtttgcgttgcaacgtatgaagcataatctcccaagacaaagtactcatcattatcacgaatcaatgaatcaaacacagcacgcccttcttcttcgatattcggaatcgtaccgtcaatcaacgcatccaagacacggtgcaaaactgggttgttgtcgtaaataccttgagcagaataatcgtgcttctcatagtgtgagtaaaccgtatccgtatccataccgaaggcgtaggcattttcctcaccagccgcgcgaatgatttcaatgttagccccgtccatcgttgccaattgcaaggcaccgttggccatcaacttcatatttgatgttccagatgcttccttaccagctgttgaaatctgttcagacacatcagctgccggaataatcaattcagcaagtgataccccgtagtttggaataaagacaacttgcatcttttggttaaccgctgcatcgttgttgaccatgttggcaacttcattaatcaccttaatgatttgcttggcatagtagtatgacggcgctgccttagcagcaaagatatgaactcgtggcgcgacgtaagcattcttgtcatgcttcaacgccaagtaatccgtcaaaatgccgagcaagtgaagcaattgacgcttgtaggcgtgcaaacgcttgatttgcacatcaaagatggcatccgtgttcaactctaagcccatgttacgcttaacccattcggccaagcgcaccttgttctcatgctttacatcctgcaactctgccaagaagtcctcgtcctttgcgaacttgttcaacttggtaatgtcctttggtaatgaacgccaactctcgccaatcttcgtatcaatcaaagctgacaaagattcgttcgctgcatgcatgtaacgacggtgcgtaataccattcgtcttgtttgagaacttttcaggccacaacgtgtagaaatcatgcaacaccttgtccttcaacaactcactgtgcaatggtgccacaccattaatggcgtgtgatccaatcgctgccaaacgggccatgtgaacttgaccgtcttgcaatggcgacgtacgccaagcgaaatcttccccgtgttcgctagcaactgccaagcggtgacgacgatcaatttcttgaatcaattggaacaaacgtggcaattccgcttggaataggccttgtgaccagcgttccaatgcttcagccaacaacgtgtggttcgtgtaactgaccgtacgcgtcgtgatgccccatgcttcttcccagctcaaaccatgttcatccagcaagatacgcatcatttctggaatcacaaccgttgggtgggtgtcattaatgtggatggctacttggaatggcaatgaatgtagtgaatacccatctgccaagtggtgcttaataatgttttgcacaccagctgaactgaagaagtactcttgacgcaaacgcaagcgacgaccttcttcattcgagtcatcaggatataattcgcctgaaatactttccagaacactacgttcagaaaccgagacttgcaccccttccggcacttcagcagaccataggcgaagcgtgttaacgacatcattgttggccccaatcatccccgtatcataaggcacagccaaaacatcaacaccgccttggtaaaccggacgcaatccttctggcgtttcagccatgtagacgctgccgccatagtgtacgacttgtgcttcactgtcttggcgaacttcccaaatattatcgttcttcaaccaatcatctgggtattccacttggtagccattcacaaatgcttggcggaacaagccgtaacggtaacgaatcccgtttccgtttccagcaagctcgatacttggcatggcatccataaagtctgacgccaaacggcccaaaccaccatttcccaaaccttgatcaacttccgcttccaacaaggcgttgaaatcaacacccaaatcttgcatcacttcttctgcttccgtcaacaatcctaggtttagcaggttcgcacgcaaataacgacctggcaaaaattcaatcgagaagtagtacacctgctttgcgccggtgtctcggtagttttcctttgtacgacgccacttgctagcaatcaacttcttggccaccgtgcccaaagcttgatagcgttgcaaatcggtcgcatctgccaaactgactgcgaaagtcccctccaattcagctagaaaactgtctttcagcatagttaccttatcgctttgttgcatacactcacctcaataatctttatagttgttcatagagttcgcgataggcgttggctgattgtgtccatgacacatcaactgccatcgcttgttcttgcaaactgcgccatgcttctggcttgttcaagaacgtttgttgcgcgtaatccatcatccaaccaagggtgctagcatcaaattgcttgaacccgaatccggttccctctcctgaaacctcgttatacggcaccactgtgtcacacaagccaccaacctcgtgtaccaatggcaacgtgccatacaattgcgccatcatttgtgaaataccacatggctcaaacgcacttggcattaggaacatatccgctgccgcatacatgcgttgtgccaaatgcacatcaaaatcaatgatgacacgtaattgatctgggtagtgcgctgccaagttcgtcaactggccttccagttcaggaatccctgttcccaaaataacgacttgtgcgtcgtgcgttgccaagaaatatggcaaggcttcggctagcaaatgcactcccttttgtggcgtcaaacgtgacaccatgaccatcaaaggaccggctgcgtgtggcaagccgaattcgtcttgcaacgcgtgcttatccttttccttaccactcatatcagttgcatcatagttaaatggcaaatctggatcagtggctgggttgtaacgttctgtatcaaccccatttacgattcctgatagtttaccttcgtacatgcgcaaaaccggatcaaggtgctcaccaaattcaggcgtcttaatctcttcggcatacgttggactaactgtgttaatacggtcggcgaataccattgccgtcttcaaccagttgctaccatccccaaagcgagcttctccactcgcgtacaaattccaatccaaatcgaagaacgtttgcaacgtttcaggcgcataagccccttggaattgcatgttgtgaatcgtcaacaatgtcttgatttgttgtagcggttgttgccaggcataacgcgtcttcaacaaagctggaatcattgctgtgtgccagtcattggcgtgcaagacatctggaataaagtcgatttcttgcatcatttcaataacagcaagttagaagaatgcaaaacgttcaccgtcattccagtgttcgtaaagcttcttccctgaaaaatatgattggttatcgataaagtagtagataacaccattcaagcgcatcgtcttcacgccagcatattcctcatgattgttaatccacactgtaaaccagtgcaaatccatcaattggtcgcggtacttttctggaaaaatttcatggtagtacggtgcaaccacacgcacatcttcgccttgcgcatttagcgcgttaggcaaagcaccggccacatccccgaggcctcccgttttgtaaaacggcactacttcacttgcagcaaacagtactttcattagacagtcacctgcttcttggctgcacgcacaactgcttccttgccaacaatgattggcatttctggcgtaccgtgcaacacaacacccggctcaatcacagcgtccttgtccatgatgacatatgacaaatcagcaccagcgccaatcttgccaccttgcaaaataactgagtgacgcaccttggcatcttctgctacttcaactgttcggaaaacaactgaatctgacacagaaccagcaaacgtgccacccgttccaaacaatgaacggtgcacttcagctgatggcatgaagtgcgctggcgcctcgttctttgacttcgtgtgaactgggcgctccatcaacaagctacggtagttgtcaaaatccaacagcgccttgtttgcttcgaagtaactcttcacatcgtgcactggcaagtgaacaccttcgtgcacaacaacgttagcaccaaagtcgctcatcaattgacgcgtcaaaccttgaacattcttacccgtcgcatgttcgatttcacgatcagcagccacttgcaaaatgtttgaatcaacaatgcttgcttgcaaataaaccaatacttgctcttcagatgaacgacgcacgttttcggctggctcaaagttacgagccaatccttcatcagtcaacgtaagcacttgcatacctggcaccaaatcagccacgtccatccaacgcgcaacaaccgtaactggttgtgcttgttcttcgtggttcgccacaattgacttcaaatccaagttcgccacttctgacgttcccaagattgccgtgtatggtgtcttggcgtgattaataaagcgacggatgtcctttaataaaccacgatctgactgaaatgtcataaataaaccaccgcccaagcgatccatttgccattcacgtcccgtacgaacgtggtccaaaattgattggcaacggtctggcatggccatcattgtctttgtgacacccgcgttgcttgcggctgatagcgggaaatcaaccaatcggaacttaccaccgaatggcacgcttcccaatggacgatcaaccgtcaattgccccaaagtatggcagtgcgcttcattcaaatcgagaatgacacttaattgattacgcattcgacaataccccctcatttacttgcgtctctgcataatattcatcgcaaccaacaactgcgatatcatcaggcgttccaacaatcacggcacctggtgccaccacagcaccttcaccaacgattgcgtatgacacagctgcgcctgcgccaatctttgctcccggcataatcacactgtgatcaaccactgcatgatcttctaccgtcacaccagttgaaatcaggctgtgtgagacacggcccgcaacgtacacggcatcaaccatcaaactgtcgtgaatttgtgcttcttgtgccacgtacattgggttttggttcgtgctgtgtgagtagatacgccaagcacggtctgacaggtccaactcattgtcgcgttccaacaactccatgtttgcttgccacaatgattgaatcgtaccaacgtcgcgccagtagttacggaaagcaaaggcgtaaaccttttcgtcatttgccaagtaagctggaatgacgttcttaccgaagtcgaccatgtcctcaccttgctcatacccctctaccaagtactcgcgtagcttcttccagttaaagacgtagattcccattgacgccaagtttgactttgggttagctggcttctcttcaaattccacaatcttgttgtcgttgtccgtgttcatgattccgaaacgcgatgcttcgtccattggcaccggcataactgagactgtcaaatcagctcccgtctccttgtgcgcgtcaatcatgtcggtgtaatccatcttgtaaatgtggtcacctgacaaaatcatcacgtattcaggatcttggcggtcgatgtacccaatgttttggtaaatggcgtgggccgttccctcaaagaacttgtttccttcaccgtctgagtacggttgcaaaattgatacgccgccatccatcacatttagtccccagtctgagccgttcccaatgtgttggttcaattcgtatggttcatattgtgtgattaccccaactgacgtcacgtttgagttcgccaagttactcaacgtaaagtcaataatgcggtagcgtccgccgaatggcactgctggcttagccaagttcttcgtcaacttgcctagtcgtgttccttgtccccctgcgaggatcaaagccgttactttatccttcatttttctttccccgtgtttgcttcttttgcttaataatcaatgccccagtcgcaggcaaaataactgaaatttcataatggtcaccggccaagaaggcttcgtgctccgttggaatgtgcttccaagtaccaccgaagtcactgttttccgtgtttaggagcacttcgtacttaccggccttaggcacgataacgcggtaatcattcttttgtaccggcaatgtattcatcgccatgatgagtgtgtcgttggctttcttaccacgacgcataaacgccatggtgccacgatacccttcgtcggtttgtgagaaatcaaccccttcaggtacaaaatcttgttcccacaaagcgtgttggtcacggtacaacttgttaagttcggccgtgaagtgttgcatgctacggtttagaccgtcttcaaggtcgcgccattccaatggttcttcatcgcgccattccaagaattggccccattcactccccataaagcgcaacttcttacctggatgcatcatcatccaaaccatcattgtgcgtaggttcgcgaattggttataacgatcaccgaacatcttgtgcatcaaactcttcttaccgtgaactacttcatcgtgtgagagtggcaacgtaaattgctcatcaaatgtgtacatgaagctaaacgttaagttgttaaatgcacctggtcggtaaaggtaatccagttcaaagaaatcaagcgtgtcatgcatccagcccatgttccacttgaagtcaaatcccaatccctcaggtgacgtcaccccagggtaggcagtcgcttcttcagcgaacatcaacgctgctggcacgcgatcatgaataatcgcattcaacttttgcaagaatgcaattcctgcatagtcataagctgtgccatcttcgttgcgccagtcttccttacctgcatcttggttgatgtagatgatatttgacacaccatccacacgtaacccgtcaaagtgcacatcctctagccagaacaatgcggctgagattaagaaactttgtacttgtgactttcccaagtcaaagttccaagtgccccaacgcacattctcagcaatcgtacggtcaccagattcaaacgttggcgtaccgtcaaactggtagagtgcatcgtaattcttgatgaaatgacctggcacaaagtccaaaatcacaccaatattggctttgtgtgcttcatccacaaaatattgcaaatcttgcaagcgtcccattcgtgatgtcgctgcgaagaatccgtacgtttggtagccccatgacatatccaacaaatgctccgtgattggcaacatttcaatgtgggtgtagcccatctccttaacgtacggaatcaattgatctgccagttcacgatatgacatgtatgacccatccatgtgacgacgccatgatgtcatgtgcatttcgtagatattgaccggttggttcaacttgtcgcgtcgaccttggcgaccacgatataagccatcatgccacttgtacgaatccgtgtttacaatcgccgcaatacccggcttcttttcgtattcatgcgcgaatggatccgtgcgtaacagcacttcaccatcacgtgtcttaatggcgtatttgtaataatcaccctcgtccaatacgtcagtcgtaacttcccaaacacccgtctcctctaacggggtcatagcaaagtcgtcgtgaatcgcccaatcacagtgtgccgacactaagtgaatttcttcggcgtgcggcgcccaaacacggaaagttaattcctgtccgttgcgtgttacacccaaaaatttatctgcgcgatatgactgaccagtattgaacaagtatgcagcttgtaagctttcgttcagtacatgtggtttcagcataatcatggtccctctttcttttccctgcaaaactgttcgtttcagagattgtcttttaatcatatgctagagatatgaaatccatatctgagaaaatatgttgttttttcacacttccgctcggacagttgctgaatttgttattttttgagcaaagtttttgaaaaaattttgaacacgcaaaaacgcccgctcagcaacctagccgagcgggcgtttctcaaagtatttaattcgtaagattttttatatctcggtttatgcttcagcaatatcttgcatcatgctgtagtggcgacggtgactgacatagtaaatcaccattgcaatgacagacacaacgaagacactaaacagtacctcaacttgtggcattgctgatccaccaatcatgattgtctcacgcaaaccatcgaccgtataagtcattggcaagtatgggtgcaaccactcaaagaaggcattagacaattgaattgggtatgttcctgctgatccactcaattggaagaccaatagcaccatggcagcaaacgcaccagccttatcgaaccacatgtagatagccgttactagcgcagcgtccatcaatgaaatcaatatcataaagccatacgtttgtaatggatgaattgggtctagtcccaaaatactaatactcaaaccatacaaaacagtcgctgccataacggtgataccgaacaacataaccatctttgatcccatccaggcagccaaagaactaatcttcgtgcgtggtgaaatcatatcaagcatcaagttcaatgccatcataccgacgaacatcgcaactgagaacatgtatggcaccataccagttccgttattagcaacgtggtccttttcggtttgcttagctgttgccggtgcagcaatttgcttgaacgtcttgttagttgcctttgtatcgttaacttgcttagctgcagaacccatcttatcagccaatgtttggttaccagcttgtaccttggccaaagctggactcaattgttcagccccagtcgtcaattggttagcaccgccattaagtttgcgagcaccatcagccaattgaccagcaccactattcaactcgccacgcttgctgtttagcgtatccagaccagtcgttaattgacttgaaccggccaacaattgactagcgccattcgataggtcaccagtcttgccgttcaacgtgtttagcccatcactcacttgcgttgatccgtttgtcaaagcgctaacaccagttgatacagctgtcgtaccattctgcaagtcagctgacttgccattcaagttttccaagccagtcgtcaattcatgcatcttttcatcaactgtgttgattgcggttggcaccgcctttagttgttccaactgatcgttaacattattcaaatcagttttattgaccgtatccactagttggttaatttgatcgccatgagcctcattaaacgtgtttatctgagctgaaagtgtggcgatgtcctgaacgattggttcgatttgttttgacgtctcactgttcgctgcgtccttagtcaaagacaaggcaatttttgccttttgctccggcgttacctgtacaccagcatccgcaaaagccttatcaatatttgccggcatcgccgcggcatcagcttcacttgccttgttcaaattatctaggtgagactgaacagtctgcaactgtgttttaagctgattctgagaaggcatatccttagtaatatcttgtaacgtttccacttgcgtttgtaacgtcgaaattttgccctctaaatcttggttcttcaattgttgattcaactgatcaacgccatttgtaatctgctcactaccagttgtcgcttggctcacaccggccgtatattgttgtacaccaccagacaaggctggcacttggctattcaattgacctagtcctgccgttacctgattacttccgtttgataattgtccaacaccacttaccaacgctggcacttggccgttcaattgacctagtcctgccgtcaatcgttggctacctgcatcagcttgcgccaccccgtcaacgtattgtgacaagccttgcgtcaacgtttgggcaccgtcgttaaattgcaacgtacttgcagataacgtctgcaacccactcgtcaattggtcagaacctgacttgatttgggttgtcccatcagccaattgcttgttagcatccgcagccgtgttcatccccttgccaactttcttcatctcaccaaaaatcgtcttggcataagtcttcgtgacttgctttgaaatttgttggctgatttccttagcgcctgattctgacaacttaccggcgatgaagctgtgacctgaactcgtctcataatcaagcttcatttgctttggatctttatccaagagcgtcgttgcgtccttagaaaaatcgcttggaatcgtgatgactgtgtagtacttgccatccttcaagccggccttagcttctttttctgaaggaaaatggaaatccatgtccttcgacttgcgtagctccttttcaaggtcatcgccgactgcaagcttctgcccttcataagtgactgacttatccttattaataatggctactggtaagttcttcacctgaccatatggatcccataatgagctcaaaaaggttaccgcgtatatcgatggtacgaagaacaatacgacgataaccaacatgaagaacttgtgcttcttcaaatattcccattctgctttaaacacagtggctacctccctttttggttttaattccttttattgaacaacctgttgaataattaatttacttgtattatattaagtcttataaaaggtgagtacaatacacagttttgaacagtgtgttcaataaatggaggggaacatgaaacaggcagaacgaaatgcacaaacacagcaactcattaaagaagctttcattcatttgattaatgaaaaaggctttaatagtttaactgtttcagacatcacgcgtgaagctggcgtgagtcgtggtaccttctacgtccactacaccgataagtttgaactgctaactaaaattgaagatgaactgattgataatatcgccgcagccttaacagctaacctagctgaaccgctgtctaatcacacgccggaagatttctccggtgcgccttacaaagtattcaaccaggcacttggatacgttaatcaagagcgtgatacaatgcgcgctttattatcaccaaatgggcatccccaattcttcaaccgcatcaaagaattggttgatcacctatttactcgccagctaacccaaaatcatggtcgcttttcaagtgaactccccatcgattacaccaaagaaattgccctcaatagcattttaaatatcgtacgtcactggcttgataaagatgagccagagtcgcccgaggaattggctgaaatcttgatgaagagtcgcttcatggctcctcacgaactaattactttcaactaatttaaccagtctaaaacaaaaaaccagccacgattggctggttttttgttttacatataatttgattttgataagtcttccaacgactccaagtggaaccccttgcgtgacagcaccttgataatctttgacaacgttccttcattaactgagtcaggcaacgtaaacaaaatacgcaccgtacgtgggttgttatcaggattcaacgtcattgatgatgaaatttgcgtataacgcgtaataatcttggcagccttttccaagctaccgcgttcaccatccgtcacaagcgtcaatgtgtagcgtccatcgtctgtttgccatgaatcagacatcaacttcatcatacgactgtgcgtcataatccccatgaaatgattatccttatccaaaacagagatgaatggcaaatcacgaagcgtaaagaacatctcgaagaacgttgcttcaaccccaacgaacttcgtcatgttacgcatgtaagttgtcaccggcagattcatatctccgccatcaacttggtgtcggtagatgtgcatcttatagatcgcaccacggaacaattgaccactctcatccaagattggaattgcacggaaatttgagttattaaagatgtccaaggcatcttgcaacgtcgcattttcgctgaccgtcgtcaatacgtcacgggacttaattaaagttgctagcatttgtgccgactcccactttctagtttctaatctaattataataacacgattacagtactaccgcacctttttgtggaaagtatcacgaattcttctaaaataatgagaatcacctttgaactggaagttagtagccctacaccaccaactaaaaaagacagcaccaaatcagtactgtcttcctatctattacaacttttcagctggttccaacgtgaaaccgtgccatggttgaatcaatgacaacaatgccatgtcctcggggtggatgtggccaaccacattgatgcggccgtcgtttggcaaatcgcgtagcgcaatctgcaactcacccttgtattgtccatagtcgttgttgtcgataataacatccccacgcgtgacatcaactgtgttgaacgccgggaaatcttcagccttgtacttcacacgcgtttgcgttgagcgtagtacatagtcagaacgatcaccacgatacatttgtggttggtcatacaacacttgctttgaaaccttagataccaaaggttcctccacaacacgtagcccaaccatcgtgcgattgaatgcctcagccgctgcttgcaaatcagcatcatccgcaaatgcatccgcaatcaatacgtcatccaccaatccattaaagcgcaattcttgcacttgtgttgcgattggcaagttacggtgatcttccattgagaccaacccatcactcactggccatggaccaaatgagccacttggcgcgtttacaaacgccgctgtgcgcaacccgtagcgacggtattgcattgacgtttctgcaaagtagtcacgtcccaatcccgtaaaacgttgtgggtagaaattgtgtgagccaatcaagttatcacggttaacgccaaaatccataatcaaatcgatatagtgttgaccacgtgacatgttcaacccaatcttcaacccatacggattatgcgtcatctgcgcttcttcagcacccgtgaaaccaaaatccaaacgaagtccccaagcacccatttctgagaataggcgcaaatccgtgtagcttgttccgagttgttcaaataattccggattgatatccaaaatcgtcttcatccccaattcgtttccgcgcataatgacttgcttgtattgatccaacaaatccgtcatatctggcgtcaactctaacaatgatgtgaaaatgcgggtgtagccgtagctggccgccttttcgatgtatgcaatgttatccgccacgctggcacgtgatggatacactgaaatacctaattcccccattgattaggcctccgttaccttctcttgaaacgccacttcttctggcgtttcgtctgcaacttgttgcccttcaagtacttgacgttgacggtcaaccaacttgaagaatgggatgtatagcaacgtatcaagtacgaacaaaacaatttgcaaaaccgcacctgagatgtgtgaaccagtcgccaagaatccagaaatgattggtggcatcgtccaaggaatcacgacaccaaccgttgcgtgaacaatccctgttgccatcgtaacatatgcgatgatggcattgataactggtacaaaaataaatggaatcaacaagtaaacgttcaagacaactggtgttccgaacatcgttggctcgttaatgttgaacaaaccaggtggcgtgatcaacttagccaacgtcttgaattccttactcttagccgtcaaaatcatggcagcaaccaaaccaattgttgccccaccaccaccaaggtaaacgaacaaatccataaatggttgcgttacaatgtgtggcatcgttgcatcagcgttttgtgagtataccttagcgttttcagccatcaatcctagccagattggtgacatgatagcaccggtaacgttaccaccgtgcacaccgatgaaccagaacaatgacgtcacgattgaaacgacaatcgcgccggccaatgaaccaccaaaggctgacaatggaccacccaataccaattgcaagataccgtggattgatgccattggcgtagctgccaaaccggcgtagatagccccccaaagcaagacgataaccgctcccggaatcaaggctgcaaatgagtttgcaacagccggcggcacaccgtcaggcatcttaatgcgaatatccttcttcataaaccaagcaaagatgaccgttgaaaccaaggcaatcaagattgaggcaaacaatcctgcagctcccatataagtcaatgggaaaccttccccagccttagccataattgttggcgttgaaatgacgtaaccagacaaggcaatgatacctgctgatacaccatcaaccttcaattcttgtgcgtaacggtaagcaataccaaataccgctaccaaccccatcaaaccgaacgttccgttggtaatcttaaccaaccagtcaaacgttccgttatcaattaaccaagtcttgaacgaatcaattgagaacccgttggcaatcaacatcgtcaaagatcctacaataaccaatggcatcgcatacgcaattccatcacgaacggcattcaatgccttattggcagccaattttgaaccaattggcatcaaataacgttccagcaactctgtcactttcttcatggtgacatcccccttttcctttatgcgcccattttatcgaatgaaaacggatacaaaaggaataaattgtgaatatgtctagacatacaaaaacagctagccaaatggctagctgtcttgaaaaactattttcctgtcttcgtctttgtgaaaccaaagagccaaatcaaactcaacccagcaaataccgtgctgaaccagaacaaatgacccaacccagttgctgtttgatgcgcaatttctgcaggcgttgtactagttgtcttaataaacaaggcggcgactgccgttccaaccgctccagcaaattgctgaatcgtattgaaaatggcgttaacgtcaccagaaacctcacgaggaacttcagcaacaccagccgtcattgacgtgttgaatgctaagttacggcctaacgtgaacaaggcgtacatcaccgtcaaaccaattgacgtaattgatggtgccatgattgaaaagataaccatgaccacgaagaaactaattgaaccaatcgtcaatggctttgtcgccccggcgcggtcataaaatgcaccgtacattggtgatgaaattgatcccaacaatgaacctggcatcaacaccgcaccagcgaccatcgtcgttgcacccagcgtcaattgcgcatattgtggaattgcgaagttcacagccaagttaattgcttgtgacgttgcataaattaacaacgcaaagaccatccccttgctcttgaatactgacaagttcaacaacttctttgttgacttaccggcaatacgaataaatagcaccatggccacaacagcaatcactgccaacacaataatcgtggctgaaatcttaccagattccaattcaccaagtgccaacaaagccgtcgtcaatgacacacccaaaacgatgaattgccaccaatcaaagctagcctcttcagcttggtgttcacttggcaatgtgcgccatcccaacaccaaactaatcagcataattggtaatacgatgacgaaaattgcacgccaaccgagccaataggtcaccaaacccccataaactggtccaagtgcgggcgctagtgacaaaatcaaaccaccaaagcccatgtacttgccaatttgcattggtggaatactcatcaagatcacgttaaagaccaatggcaaagcaattccagttccaaccgccatgattagacgaccaaacaacaacggccagaaacttggggcaaaaatggaaataatatcaccgattacaaatgaaatcataccccaaataaaaatcttacgcggactcatcacagcctttagataggctgatgtcgtcatcatcaacgccacaatcaacaaataagctgttgttagccattgcactgtccccattggaacaccaaattgcttaattaaatccggaaatgtcacgttcattgacgtttccgtcaaaataccgacaaacccaagaatcgctgtcgcaacaatcgaccaaacgactcgtggtgaaactttttctgtcattttctcactccttttttgaacacttgtactattgaagcataaaaacaaattcttcgtaagtaaaattttccttaagttctaatcccaacaaaaaagctcggaacactacgttccgagctatatattttattcactaacaacgattgcttcaccagcttgtagggcattcatattgactgatggattgagtgcctgaagttgtgccaatgttaaaccatgttgcttcgcaattgaataagctgttgcgccttgaggaacggtaatcgtcgtccctgttgcggctgaactgcttgactcagcttcggtttcactagcggtcacttcagctgaactagtgcctgattccgcttcattaccagtttgcgcctctgattccgttgttgaaccatcctcacttgctgatttttcttgatcgctcgaactgcttgaggccaccttagctgtttttgtcgtttctcgttgtgccccaccagttatactattcatcaaaactggtagcgtgaaaccgacaacaaacaaaacaatgtaacccaaaattacgagtagccaaaactttaatcgtcgtggttgctttgtttccatggttaatatttccttattctacttaattcttaaattcagattatcacttagtttatgaaaaaagaacagttcgttgttggcaacaatgtttttttaaacactttggcctttttgtgaaccgacaacagaaaagaggacgacacatcactgtatcgtcccccctcatttttaattacttagctgaacgacggaatgccaacaactcgtgtgagatttcagcagttgcgccgtaaacttgcttgtagatagcgtggatttctgcgtaacgtgcagcgcgatctgcatctggcaagtattccttgtcaaatgagttccatgcagcagcagcgtcttgaacagtgtcgaaccaacccaaaccagtagcagctaagattgcagcacccattccaggtccttgctcgttcttcaatgaaacaactttcttgttgaagatgtcagcttggatttgcaaccacaatggtgacttagcaccaccaccgatggcaacaacagtatcgaagtcagtaccagcttcttcgtagatatcaaagatgtccttgaatgagaagataattccttccaaaactgaacgaacgaagtcagacttcttgtgcgttccgtcgataccagtccatgaagcacggatgtcaccgtcagcgtatggcgtacgctcacctaccaagtatggcgtgaacaacaaaccgttagcaccaaccgttgacttaccagctgattcaaccattgccgtgaagtcttcatcagcagcaaacgtcttcttgaaccatgacaaagcgtatccagcggccaaagtaacacccattgagtagaacttgccagggatagcgtggttaaagaagtgaaccttacccttgtaatcagcatctgcgttgtcttcgtacttcaaaacaacacctgacgtaccgattgatgacatcaccatgttaggttgcaagattgcagatccgatggcaccagcagcgttgtcggctgcaccaccgaataccttagtatcagtcgtcaaacctgagaaggcagcatactttggtgagatagtaccagcgaattctggtccttcgataatctcagggaagaattctggcttcaaaccaaaggcttcttgaacttcctttgaccaagtgcggttagcaacgtccattgcaaccgtaccagcggcgtcagaaatttccatcgccaacttaccagtcatacggtaacgcacgtaatccttaggcgttacgaatgaagcagcttgtgagaagatttctggctcgttttccttaacccacaagatctttggcaaagtaaatccttccaaagccttgttacgcgtgatatcgatgaattcttgacccatcttctcagcgatttccttagtttgtggcgtagtacgtgtgtcgttccacaagattgctggacgcaaaacttggttgttgtcatccaacaaaaccaaaccgtgcatttgacctgagtatgaaataccagcaatgtcttcaggcttgatgccgtcatccaaaatcaaacgtacgatggctacagtcgtaccgttaacccaatcttctgggttttgctcgctgtatcctggctttggttgtgatagtgggtaatcatatgattgttgtgcaacgatgtttccttgacgatcaacagctgagatcttaactgatgacgttcctaggtcaacacccaatacgacttcgctcatgtttatgtcctctttctttgttatgtatacaacgagggctgggctaatttaatggcccagccctcgtcgccgtagggattggccctactgttatgtttgttgcaatgtgagcgtgagataggcactcacatcgcttttgttgagattatttttgagattttttgagattgagagatgctacatcgaccattatttcaaaaggagtcgacgtggcggtgctaattttgcattagcgtaagccttttcttaccaggaacctattcggttgggattactttgagaaagttgaacccaaaactgagtagatgtagttgttcaacgtagccttgatagcttccaaacgtcctgattggatcgttgagaagatctcgtcgttcgtcttgttcaagatgtaagcttcgaagttagcgaatgaagccttgtcgttttcgaagtcagcaccgatacctgaatcgaatgatgagtaacgctccttgtagatgttctccaagaagttgtcttcgatcatcttcatagcaacacggaatccagcagcgtaaacgtccataccggccatgtgtgcgtagaacaagtcatccatcttgaatgaagcacggcgaacctttgagtcaaagttcaaaccaccagttggcaatccaccgttcttgatgaactcgtacataaccaaagtagcttcgtagatgtcgttagggaattcgtcgatgtcccaaccagtttgcttgtcacccatgttggcgtccaatgaacccaacataccagcttcacgtgcaaaacgtgcttcgtgctcgtaagtgtgaccagccaagtaagcgtggttaccttccaagttcaacttgaagtcgttttccaaaccgtacgtcttcaagaaggcgatagtagtttgtacgtcagtgtcgtattggtgagcagttggctcctttggcttaggctccaacaagaattgaccagtgtagccaatttcgttagcgtacaacttagccaacttgaagaacttagcgatgtggtccaactcacgcttcgtgtcagtgttcaacaatgactcgtaaccttcacgaccaccccagaatacgtatgattctgagttcaaacgcttagcgatttccaatgagtgcttaacttgtgctgctgcgtaagcaaatacgtcagcaaatggcgtagtagctccaccagccatgaaacgcttgttagtaaacaatgatgaagtgttccacaacaacttcttgccagtttccttcatcttttcttcgatgcggtcaacaacggcgtccaagttagcgttcgtctctgccaaagtgttaccttcaggagccaagtcacgatcgtggaatgcgaagtattcaacacccaacttgtccatgaactcgaacatgtagtcaaccttagcgattgcgtggtccaagtcagtcatgtcgtcaacaccgttaacgtcccatggacgctcggcagtaccttcaccaaatgggtcaaccatgcgttggtccatcgtgtgccagtaagcaactgagaacttcatccagtccttcatcgtcttagtctcaccgttgatagtgaaaacctcttctgggttgtagaagttgtatccctttgatgcttcaaagttcaatccctttgctccgccgataaattctaccttaggaaagtcgaacaattctgacattatgtcatcctccaaaattcttaaatcatctgttttaatcatcaaagccggttggctttggttagttggtttaagcaatcaactaacttacgagatttattatagggtacctattcacagaatgcaagcgtttgtatgtgattaatttcgcaattcgttcaaaaacatagaaaaaacgcctaaacataggcgtttagacgtttaaaattataaaaactctaatttttgaatacgctttcattagcgcatttgtgcaatttttacaaccaattagactcggctgcgtcttcatcttcgagcgcgaagtttaactcgtaacccatcatatccagcaaagtacgcgttaccaaggcaacaccaccagaaagcgtggcacggttaactgacttcttagcaaagtacaaaggcgtttccgattcaggttcgatcttgcgatacgtctctaataggtaatcaagcaactcaggtgtaccagcaatgaagcgcgaatgaacaaacactgcttccggcgctgcgtactgtgccaagttataaattgtgcgacagattgcatggacccattcatcaatcaatgattttgcatccgcatcgccacccatatataaggaaagaaaatcttcgcgagtaatttcttcttggccttttaatgaagctaagcgactaagcatcgcatcttcagcgtataaatcttctatatgaatagtatcgtcaaaatcacccttagccagttgatcgttgttcaatacaacctgacgaccaatttctcccgcttcaccatgtagcccacggaacaaacgaccattttggataattccagcaccgataccgttgtggatattaacaacagtaaagttttggaatatttcgtctgaatcatagtcatgatagtcacgcaagtagatggcagccaagttggcttcgttttctaatataacaggtatgtgtagtgcctcttccaaatccttggccaagtcttcatttactaattccgtatggaacggcgtgtagcgtaccttgttatcttcgacaacaccgtggatggcaaccccaatcccgattaatccatgatccgtttgcatatcacctaactgtgcaatatatgaaagcatcgcacgcttgtaatcagcatagcgcatcccaagcacagtcatttggccacgagaaataacttcaccagtaatacgggccaccaagtagcgtagatgattgcgtcccaagtcaaatgaaacaatgtagccatagtgacgattaaagcgaatcaattttggcttacgtccaccagcctttgaaacggttccttcacctaattcttctatatatccatccgcttcgacgtcacgataaatcgtcgtgaccgtcgatttatgtaaagcaatctgttctgcaatttcactacgcgacgtttgctgcgcattaaacaacgcttgcagcatcagtttacggttcgtatcacgcatcgcatcttggtctactttagaaaccattctttctcctccatattataggtagttattttatttttggcctatccctatcaccaaattaatcttcatttcacactcaagtattcattctaccgaaaaagcggtcgtttgtacggttaatttcttaatatgtccgaattatgtagacattcccaataccgggacggataaatgaacaaaagtggcatagtttgtgaatattttatcacacagttagttgcgttgctaaactaaccatgttattattactatgcaaaaggaaatgataacgttttcaaggaaaagctcacgattacacatattttcatttccccttttgacaaacatctctctcacacatttttaaggagttattcgttatggatgcaaacgtaaagaacgacgagtttgcaaagctttcaatgatggatcgaatctcttacggtttgggtgatttcgctcaaaacttgattttcggtactgtcggcggattcttgctattctatttgacaactgttgacggtttgtcttcagctactggtgcaatcattttcacgattgttcgttgggttaatgttttctgggatccttgggttggtacgacggttgaccgtcgtaacccaaagggtggcaagtacctaccatacatccgaaacttcggtatcccattggttatcttggctgcaatgctattcttgccagttggacaatggttcccagcacttaaggtgccatatgccttcttgtcatacttggcaacggctatgatttactcattcgttaacatcccatacggttcattgaacgcttcattgacgcgtgataacgatgaaatcgctaagttgacgacggttcgtatgatgttggctaacacggccaacttgttggtttacacattcttccctatcttcgtgcaattggctacgtcagttggtcgcgaatcaaaggatatcggaatgtttggtattcacttgaacttgggtaactatgcttcaccacaatcagctggttcatggtttaaggtttatgccgtatacatgattatcggattcttgtctttgatggttacttactcaaagacaaaggaacgcgttttgccagacaagtcagaaccacaagttaagttctcagacttgtttgctgaattgaagcgtaacaagcctttgcaaattttgggtggattcttcttggttggatttacgttcaacttccttggatcaactgcatggccattcttcttgcaatacaacatcggccactcagaatggaacggttcaatctcattgattggttcaattcctggaatccttttggtttcactttggcccgtattccgcaagatgttcggtaagaagggattcttctacttcttccttatcttgttctcagctggatcacttgttttgtggtggtggactaagaacccagacaacatcgccttcggttacattggtcgtttcctacaacaatggggattgacttcagcaactggattcatgtgggctttggttcctgaagttgtttcatacggtgagtacacgtcaggtaagcgtgttgctggtatcatcaacgccgtgatgggattgttcttcaagattggtttggctttgggtggtatcttgccagccttcatcaactcattcactggattcaacggaacaaaggcaacgcaatctgcttcagctttgatgggattgcaatggtcacttgtttggttgccaattatcatggctgtcttggctgctatcattatcaagatttacccattgactgacgataaggtctttgagatgaaccgcgaaattgaagcacgtcgtaacaagtaatttgtaaaaacatttcacgaaaagccgttaacctcagggttaacggcttttttggtacttatgccattcttgtgaatattttttcaagtggttggttgtctaaacaaactaactgtgttatattatgtgtacacagtaaatggtaacgttttcacggagttgttcagacattaacattatcgttaaagtccgctgtataaaagggttaatcagtgattgaaacttttatacagcgcatctcacgaactgcgttgctgcccgactctcacacgtatcgggacacatacacactatatctcacaaggagcatctcacaatgcaaattcaaaatcctgtattgcctggattcaactcagatccatcaatcatccgtgttgaagacacgtactacattgcaacgtcaactttcgaatggtacccaggtgtacgtattcacgcatcaaaggacatggttcactggaacttggtaactaacgttcttgatcgtctagaattgttggacatgaaaggtaacccttcatcaggtggtatctgggccccagacttgtcatacgcagacggcaagttctggttgatctacactgacgttaagatcactgacggtgccttcaaggatatgacgaactacttgacgactgccgagaacatcgaaggtccttggtcagcacctatccgtgttaacggagttggtttcgacgcttcattgttccacgatgaagacggtcgcaagtacttggtacaacaaacttgggatcaccgtgaataccaccacccatttgatggtattacgttgactgaatttgatactgatacgatgaagttgaagccagaaacggctcgcacgatcttcgaaggaactgacgttaagttggttgaaggtcctcacttgtacaagatcaacggtgaatactacctattcgctgctgaaggtggaactgtcttcactcaccaagaagttgttgctcgttcaaagagcttggatgagaagtcattcgttgttgagcctgatggcccattcttgacgaacttcgacacgccatacacttacttgcaaaagcaaggtcacggtgctttggtcgacacaccaggtggtgagtggtactacgcatcattgactgctcgtccatggaaccacgagactgagtcatcaactgacccacgtggatggtcaactttgggacgtgagacgtcaatccaaaaggttgaatgggacgaagctggttggccacgcgttgttggtggacacggtgggcaaacgttcgttgaagctcctaaggatgctatcttgactgaagctcctgcagaccactcacaacacgatgagtttactgacgctaagttggacatgaactggaacacgttgcgtgtaccattctcagaagagttcggttcaactggtgacggttcattgaagttgatcggtcgcggatcattggttaactaccacgacttgtcattgattgctcgtcgttggcaagcattctacttcgatgctgaaactaaggttaagttcaacccattctcataccaatcaatggctggtttgacgatctactacaaccactcacactggtcatggatcttcattacgaagaacgacgaaggtcaaagcgtaatcgaagttgccgagaacaagggtggacaacgtaacggaacttacacgtcatacttgaaggacgatgctatcgttatccctgaaggtactgaatacgtatggttcaagacgaaggttcgtaaggaatcatacacgtacgagtactcattcaacggtactgactggactgaagtaccagttatattggacgccgcagtcttgtcagatgactacgttgtacaatcatacggtggattcttcacgggtgcttacgttggtttggcagctgtcgactactcaggttacgacactactgctgaattcgactacttcgactacaaggagcttggcgacaagcaacttgaagacggatcatactcatgggaagcttcagagtcacgcttcggctaatatctgaataaccaaaacgcctaacagattttctgttaggcgtttttttgcacccttttccttcatcagacacattgtgtgtcgtatttcgcacacttttttgtgaaaataataacaatcactattaacaattccttttagtaagcgtatagttgtttatgttgattgagttgttaccgttttcataaatagtgaaaaaagtaacgttaatctagaaattatcttttagaaagcgagtatgcaaatcatgcgtaaaatctcacctcgtttaatttattttttcggagccctaggtggtctcctattcggttatgacaccggggttatctcaggtgccattctctacgtgcaacgtacccttggcctaaacgccttggaagaaggaatcgtcgtctcatcagttttgcttggcgctatgattggtgccatgtcaatcggccctctgtcagatcgcttcggtcgtaagaagatggtcatggttgcagctttgattttcttcattggatcgctaggttcagccttttcacctgaatttggtgttttggttgctagccgtgtcgttcttggtgttgccgttggtggtgcctcagcccttgtaccaacctacttagccgaagttgcgcctgctaaaatgcgcggttcactaacctcacttaaccaattgatggttatgacgggtatcttgatggcgtacttggttaaccttggtttctctggcctagcacataccgtgtcatggcgctggatgcttgggttcgcagccctaccatcagcaatcctattcatcggtggtgttttcttgcctgagtcacctcgttacctaggtcgtattaagaaattcgatgaagcgttgcaagttttgaacatgcttcgcacgcctgaagaggctaaggctgaattggctgaaatggaaaacgctaaagacgtcaagcttggcggcttcaaggaattgttctcaaagttcgttcgtcccgccttaattatcggtgtcggtatggctatattccaacaattcatgggtatcaataccgttttgtactatgccccaactatttttaagaccattggcatgggcgatagcgcctcactgatgggaactgttggtcttggaacggtcaacgtcttgatcactgcctgggccgttcgcgtgatggaaactcgcggtcgcaaggaatggttgttgattggtggtttcggtatggccgtttcattgattgccttgtctatcctaactagcctatcagttacaggcatcatgtcatacgttacaatcgttgccatggccttctacctcatcttcttctgtgcaacttggggcccaatcatgtggacaatgattggtgaggtcttcccattgtctgtccgcggtgtcggagttggtttctcatcattgattaactggggggcaaacctacttgtatcattgatgttccccgttttgttggaacacttctcaatgccgattatcttcggtgcctttgctgttatgtgtgtccttggttcactattcgttaagcacttcgtcttcgaaacacgtggtcgttcgcttgaagaaattgaaagcatgcttcaccaacgcgcgaaggattctgcaaccggtgctgtgccacacggtgcgatgattcaacattaattactatgaacaaaaccggtatcagaactaactgataccggtttattttgttaaaataaatactatcagtgtcgaaaggagtaaccgaatttgaaaaaagcactaaatgccatcttcaataaccgctatgtgaaaaccatcattgacgtttcgatgcgtgtcgatatcgtaacggctagttcttcggttgcttactttggcctattgtcgattttcccagcgattatcattatcgcgaccttattaccctactttggactaactatcacgacagcccttagttatgtgcaatgggccgtgccaaaatctgtttatggtttcgtgcgcccaattatcgagtcaattctcggacataatggcgttggtgtattgtctgcatccatcgtgattacactttggtcactttcacgtgtcgttgcttcaatccgcactgcccaaaatggcatctatggcgtgcagccaaagaatattgccatcatcgaccgcttcatttcaatggcctggatgattctagttcttggtattatgggcattctcatcttgattgcttccgttggatcgaacgttcttgaagcattgccaatcagcagtcacatcgtccgccaaatcgagtccgccaagttaccagttgttgctactggattgttcattggcgccgctctcttcaattgggtactaccggtcaaaaagccccgtttacagtgggctttgactggtaccaccatccaagttgccctcgttttgtggttaacgaagattttcgggtggtacgtgaacctggcctcacaggcttacaccttttatcaagcccttagttcggcaatcatcgttttgctttggattaatttcattgccatggctgcgttgattggtacaattgtcacagcaagtttagaggaacttttcccctcaaaacgtgataagaaagccattttgaagcacttcagtagaaaaattatccgaaataatggaaaaagttaagagttatttattgtataattcatttttgcgcgttattataatatttgttaaagaggaaaacgtttccatttaacatttgagacagcaacttactcatatcgccgagtctaaccagctcggcatgtaggtctaaccaacctacaacctactccttaagaatacctatttaccatggattaaccacctatggtaacgatgcgcctaaccaacgtatcgttaggaaaagagtcgtcttcggactagactccgaaaccgcctatgcctaaccaacataggcggttttgttttgcgcttttttccagtaaaatcaagacaagaataaaacactttggggaagtgcgaaaccatgaacacttatgaacaacgcgttctacagacctgtgcgcaggctggacgcatcttactagaaagcggtgcggagacgcctcgtatcgaagaaacagtagaaattatcggcaagacggccggtgttagcgtatcctgctacgtgacactgacggctgtcttcgtatcgctcgctgatcagccaaccactcaactaaccaagacaaagcttgggagctttaacttgcaaaaagttgatgaaattaatcatctctcacgccaattcgtggctggtgacgttgatttcgatgacgtcacgcgacaagttaacgccatcgatgaatacgcgattgatttcaactggcccactaagattatcggcgctggcttagtatccgtcgcaccaatgttggttttcaaagcaaactggctcgatttatccctcgccttcttcgttggtattgccggctacctagttgcacagtacgttggacgtaaagcaaccgctacaccttatgccaaggaagttgccggtggctttacaatttcgctattggcgtggctgttagtcgccggtcacctgggcacaaatgccgagaacatcatcgtaagctccgtcatgccgttggttcctggcgttgccttaacgaattcattacgcgaaattatggctggtcatatgatttccggtacagttcgagcattggacgctttgttgattgcagctgccatcggcggtggcgtcgtcttagctgctaccctagtccactttggcacgacattataggaggtaatcaaaatgcaattaatcatccattttctgattagcttcgtttcgacagtcgggttcggcatcatcacgaacatcccccgtcgtgctttaccagttgccggtctaaccggcgccttagcttggagtggctacattgcctacggttacgcacaagacaacgtctttatcgctaatatgattgcagccattattattggtttgcttgggaatattttcgccgttaagtaccgtgtaccggtcaacatgatttacattcccagcctggtttcactagtgcccggtggcactatctacttagcgatgaagaacttttcgttagggcattacgcattggcacaagagggcgttatcaccacgcttaccatcgccgtcgctttagcggtcggctttgtgctatctgaagtcgtggtccgccaagttaaacgttatcatcatcactaaaaaaacgccttggacttaaaaatccaaggcgttttaatttactattttagtgcattgtaagcatgccagctgttcccaaggccaatacaacgataccaacaacgattcggtagtatccaaagaccttaaagtcattattcttgatgtagttcatcataaccttaatcgcgaagtaagccacgatccatgaaacgatgaatccaactgccataacaccagcttgtgcgccagtgaagctaccaccatcaaggaggtacttaccaactttcaaaatcgtcacaccaaacataactggaatactcataaagaatgagaactcagcagccacgaatcgtgacgctcccaaaatcaaggcgcccaagatagtcgcccctgaacgtgacgttccaggtacgattgaaagcacttggaacaaaccgatgaacaacgccatcttgaacgtcatcgtgttcaagtcagtcaaccaagcatccttgttagccaagtaacgctcaacgacaatgaacaaaataccgtaaatgatcaacatagatgccacaacccaagcattcaaccagtgcgcatccatgtagtcgttaagtgccaagccggccactacggcaggcaaaacaccgacaatcaccttgaaccacaaagtccacgtttgcttcttttcaatcgtagactttgatggtgcaaatgggttcaacttgtggaagtacaattggataaccgcgaaaatagcacccaattggatagcgtagtcaaacatcgctgtaaagctctttgtccaaactgaaccacctggaatgttcatcaatgattcagcgataataatgtgccccgttgatgatactggcaagaattctgttaatccttccacaataccaattacaagagacttcaacaaatcaagcatatgctgctccttatttttaaatatcaacagtactactttaccaaaccaacctagaaacacctaatacctgagggacttctttactgattaattgaaaatagtatcaccgtctgtcgtcacaacgtttagacgatcagtcgctgattcatcgcgactgtaactaccaacaaagcggttgccttgaatcttaatgtcaccgttgttagcttgaatctgtaacccaggcacgggcatattcgttacatccaagttaccctcacgcaacgtccaggcattcacaccagtcaattgcgcattttggacggttagattaccagaattcaactgcacaaccccgtcattcatcacaacatctttcagttgcatatcagtgtcagacgctgaaacgaatgccttgccgagcgttgcttgcttggctgaaaattgtgaatcagccaggttcatcgttgtctcaggtgacttcacaccattaagtgttaccaaaccatacgtattattcaacgtcaaattcttcgtctcaacatcatgtagcgatgaagaacctgagtagtttcgaatatgcacgtatttcatcacggcctttttcggaacataaaccgtcaaaacgtgttcaacacgcttattaaagccaacccggtacttatctttttgcgtcccagtataacgaatgtgcaaggcgccatccttgtctgtgaggttaagctgcgtggcatccccaacagttcccttcacacgatactcattcttatcactcgcaacaacgtgaacatctaattcaaccgccgtcgcatcaatcgttttgatggtatcgaatttttgattgattgctttttcctgtggcaacacaaaatgaccatcacgccaaaccaaactattttggccaccattgacgtaaccaatcactgacaacatgatacccagtgcagcgacagcaaagccgataatgataactcgtagcatcttaggcatgcttcacacctccttgtggcttgcgagtaaagcgacggccgataaacttaacaaagttcatcaaggcacggaacaccgttcgaacaaccacgaagccaattggccatgcgataaattgcagaccaatccaaatcaagcctaagcctccttggaagaaggcagtttgccaactttgaccggcaatcgcaattgcaccaaagacttggaagaaacccgtaaagagcaaccagagcaaaataatgataactgctactgctaccaagacaacaccaaacaagcccagcaaaattgcaataattgctggaatccaaacaactgatgtcaccaatccaacgataaccacccacaataggtttagttgtcgctgaatacgtgacttgaattgcttcgttgcagaactaccttcgtctggtgcctcttgatcagcgacatcatcatagcggattgaataatccaccaagacacggcgggctaattgcttaggtgtcccaaactcagcgattaacttttcgccgctaagtccagcatccgctgcgtattctcgataaaatgcaaggacatcatctcgttcatcttctgtcagaccaaacaaatgtccgcgcagttgtgtgaagtaaatgttattctccattgtctcccctctccgccatcataatttcattaacattgccgctgaaagttcgccactcatcttggattcgcaccacttcagaacgtccttcatcggaaattttataatatcggcgattacgcccttcaaaaggttcatcgtatgtcgtcacccaacccttagacttgagacgacgtaagactggatacatcgttgattcggaaactgcaaaacgctcttgcacctgcttcgtcaacgcatagccatataaatcttcgtcagaaagcaacgccaatactaacccatccattaaatcactggataattgcatcgccataattcattttcctttacaatactataagtcatataatatactctcagtataagaaagaatgctaatgttgtaaaggcaaacaccatacaacaagttctaatggcatttaagaggggtatctattatggcaaagaagcaattaacaaagtctcgtgataaggtcatgagcggtgtccttggtggtttcgctgagtatttctcgattgacgcgacactactacgtgttatcttcgcggcagctgttgtattcaccggtgtcttcccaatggttattttgtatattatcgcagccgttgttatgcctgaaccatcaagccacaatcgctacgagtaccgtgataacgatgatcgcaaagacgtcacaccacaccgttacgacgacgacatttaatgcaaaacaaagcgccggctaggacagaatcctaaccggcgctttttatgtctatcttaccaactgaacaacccaaccatagcagctgacatcaatgatactaagatacctgataccaagatcaacggtacatttgcagcaatcaaatcagccttttcacggttaaccaagctcttgtatgatccgataatcattcccaacgtaccgaagtttgcaaaactcgtgacgaagaccgtcaaaacggcacgcgcgtgagctgaggcaaacattcccgtgcggtgaataacatcctttgacacttctcccatgacaacgaactcgttcgttaccagttttgttcccatgtattgggcaatttggaaggcatcgttcacgttgaaacctagcaaccatgcaaatgggaacataatcacaccgaaaatattctccaatgacaaccatggcaacgtcgtcaatgacaacaggttatcaatcaacgcagccaaaccaacgaaggcaataaccgtcgcaacgataatcaccgcaaccaatccagcaccttggatagagtcacccaagaaagcgaagaatggttggcgttgtgtcttaccattatccaacgtctcttcgtggttcaataccgcgattacatcttcgtcttcaggtacttcgaccggattcaaaatcgttgtcatcataattgcgctcaaaatgttcaacggaatcgccgtcaatacgtattgaccaggcatcatcccaacatatgaaccaacaatagccgccgtaactgtactcattgacatcatggcaaccgtcaaattacgcttggcattcatttgttgcaattgtagcttagaaacggccaaaacttccgtcgttcccaagaacatcatttcaactgagaagaatgactcgaactttggttgacctgtcaaaaatgacaagccacgaccaacccacttaaccaaccatggcaaaacaccaaggtatgtcaaaatatcaaacattggaatgattacaatgattggcaaaacagctgacgtcacgaagttcattgaacctgacgctggctttacccagtctggcaaggcaaatgaaattccgtcaaaggccgcactggtcaaccactggaaaccattagctgcagccaagacagcgtctcgaccaatcgtgaaactcgtgaagaaccatgccaacaataattggatgaccaaaattacaccaactgaacgccagtggatgtgcttgcgatcacgagaaaataaatatgccacccctaggaatacaaaaattccaaggatgttcatcaacaatagcatcgctactctccttgaggggtatttatgtaaaacaacttaacaaacttaagtgtatcaaaagtaagcgacttgttaaacggtttacccttggtaataatttggttaaacgtttaacttagaaaatccacaaaaaaacacacctacttttgcaagtagatgcgttttcataatctttattgcgcgtatgaataataactagaaccgtaagttccagaaccatcgtccaccgtgctaccatcttctgaagtcgtgtcagtcgtttcatcagaactatcatagacgtatgaagtcaaaccgttagctgcaagcgttgctgagctaacttcgccggcaaacattggtcccgtctttgctgctttcaagccaagtgacttacgcaaaacattcgttccacgttgcttttcactctgaggaatcaattctgatgaacctgaaaccaagttcacttcagtaccttgcaagtgatccgtcttaattgtcttcgctgcgctgatatactttgacgcaatcgtcaacatatcatcaaacgtcaaatctgtattcgttgaatcagaaatcgtgttcaagaactttgcgttaatcaacttagttggattgctcttagccttttccacaatcgcttcaagcactagtcgttgacgtgcttgacgaccgtaatcaccttgtgggtcatcgtaacgcatacgtgagaacgcaagcgcagccgccccgttcattttgtggtacgtgtgggttacgccgtcctcgcctgtgtgcgtgtaggtagatgatccttccgtaaagctataaagatttccaggatcagcgtgagccgtatctggattatagtcaaaggtcaacggagactttacatcaataccgcccaactcattaacaatcttttccaacgcacccatgttaacaattgcatagtaatcaatcggtacgtttagccaatcttgaatagtcttaatcgtggtcttagcagaccccaattcataagccgcattcaatttttgagggaactgatcctcatagccaatcggagcgataactgagtcacgtggcaatgacatcactgtcaccttgtcttgcttaggattaaccgtcaccaacattagtgaatcagtacgtcccttatatgttcgacctagttctccagtatcagtccccaatagcaagattgagaagggctttccatcagccaaaacccccgaaacatcacgtgccttcttaacaccagcgctttggaaagcattatcaaccgcattctttgtattcttataggctgtgccggctaccacaccaaccgccaaaactaagacagcgataactgataaaataatgtttcgcactaatttaaatttccgaccattccttgggcgctttggaccacggggaccacgaactttctttttatgtccgctagccatacgttccgcttcacgccgtgccgtacgtgattgtggctcattttccatgagcgactcctctcttcaatccagtagtatttaatactgattaataacaatttttataattctcaagatagcgcaaaaacggtatcttggacattatacaagccttcacctttaaaaaagcttatagtaacttatttattctataccaaaaaacaagcctagtcagcatttctcactaactaagcttgtttcataattaaacattaaactgccacgggtgccttaattgacttagccggcttataattctcaaccttaatatcgtccattgtgtaatcaaaaattgaggttacatctgggttcaatacaagcgttggtaactcagccatttcacgagaaagttgctcagtcacctggtcaacgtgatttgagtagatgtgtgcatcgccaaatgtgtgcacgaactcgcccgcttcaagccccgtttgtgcagccaccatgtgcaacaacagtgagtatgacgcaatattgaacggcacacccaagaagatgtcagctgaacgttggtaaagttgcaaactcaacttaccatctgccacgtagaattggaacaatgtgtggcacggtggcaatgcttgtgatgggacgtcttctgggttccaggcactaacaatcaaacgacgtgaatttgggttcgtcttaatctggttcactacatcatcaatttgatcaataaagccgccttgcaccttacgccagtgacgccattgcgcgccgtatacgtcacccaattcaccaaacttatccgcaaaagcatcatctgccaaaatgcggtcaacgaagagttggtgttgttcatcataggcagccttgaactcctcgtctaccaacgcacgacgcccaaaatcagtcatatcaggtcccgtgtattcatcggattcaacccagttcttaaatgcccattcgtcccaaatgtgattgttgtgttccaacaagaaacgaatatttgtgttaccttgcaagaaccatagcaattcgctcttaatcaagccgaatggcacacgtttcgttgttagcaatggaaaaccttctgccatatcaaaatgcaattgacggccaaatactgagcgtgtacccgtacccgtgcgatcacccttcacattccccgtttccaacacttcacgtgccatatccaaatatgcttgttcattacgactcatgtcattatccccttagttgttttcagttacgtacttgtcaaaattaatcattgcgacatccgtggctgttagtggcacttgttggagtgcaacacccttagcttggattaatgatgtcgcgaactcatcattattgtagttacggatgtagttaatcttcttaataccagcttgtaacaaaaacttcgtgcagtgaacgcaaggaaaatctgtgacgtaaatctcagcaccatctgctgcaatccccatttttgctagttgcatcaaggcgttttgctctgcgtgaaccgcacggatgcagtgcccatcaacaattaaatccccaacttctgtacagtgtggcgtcccagtaaccgatccgttatacccactcgcaataatacgtccgtcttttacaactactgctccgacatgtaggcgcgtacaagtactgcgtgatgctaacatagccgcttgcatcataaagtaagccggccaaccaattcgttcgtctttcatcattattccccatcgatttattttcgttactcctataataaccgacaaaatcgaacgtttcaaatcttgatttttaagttcgtacgtgattttattccgttttagcatgttaaacgaacagaacatcataaacacagtctaaaaatcagccagttacgaatgttcaaatttttaaccgtcccaaatgaccgtaagcccgaaaattacggctatcaacaaatcgatatcatttagaaaatggaatttttcacgcgcctaaactctctcgttaaaaagaagtgcataatattattttccgttgtgaatttacattttttatgataaaattgtaaatgaccttagtgtgtcataaaacacactcgtttacgcagcggtttcatttgtcgctggatgtgaggatagcctcacgaaaggagttcttatgcctgcagcattagcagaaattaagcaacaattagacgatcaccttggtgagccaattactttgattactcacgagagccgtcaccgtaacatcgagcacgaagccgttgtacgtgagacgttccgttcagtattcgtcctagacttgaagcaagaaggtaacgagttcgaccgtgcctcattcagttacacggatatcttgacggataacatcgagattactttcgcctaacaaacaagccccgattcgcatcagcggatcggggcttttcttttactcttcgattgtcatatcatcatccgttgttggtgcaacacgaacaacttcaaactcattgatgtaggcatccttgaaatcaagggccgtaatttcaaaatcaagtaccttgatggtatctcctgctgacgtatcagaattctcatccaagaagaatcccgtcaatgtcaccatgtcagagtcatcaaatgggcggatgtcctcatggaagtaacgttcaaaatcatacaacgtcatctttccagagaccttgtagtgcatgttaccagcgtcatcagcacctagcttttcaactaggtcatcagcaactgcatccatctcgtcacgaactgaaccgaacaattcctcgtagatatccttatcagtcacgatacccgacgtaccgccatattcgtccttcacaataacgattggcgtacgacgcgcaatcatcttttgcaaaacatcttgaattggcatattctcaggaaccgttggcatgtgacggataatcttacgaacagacaatgtgtcatcaatttgggcttggcgcatcaaatcatagttgaagacgtatcccaaaatcttatccttatcattgtcagccacaactgggaaacgagagtgcttcgtttcaaaataacgttgcaaggtatcatgcactgaatccgtaatatcaaccacgtccaattgcgtacgatcaatcatgatatcaactgctaccttatcattcatctcaaaggcacgttgcataaagacatagtccgcatcgtcaagctcaccactgcgagcggccgtacgagacaagcttaggatttcggcttctgaataaacctcatccccttcgttagcgggcttcatacccatcaaacgagtcacgccagtcgctgagacgttcaacaaccacacgaatggatagaagataacgtggaatagacgcaatggcgttgcgacgaacaaagcgaccttcactgggaagtcgatggccacattctttggcaccaactccgtaaagacaacttcaacatacgtcaaaaataccaaggcaataaccgatgcaatcacgccggcacttgcccctgtcatttccttcaagaagccaccttcaagcaataagtgggcaattgtctcttcacccatccaaccaagaatcaacccggccaacgtaataccaacttgggtcgttgatagatactcatttaggttttcaaccatgtggatagccgttgcaatttgacgtgatggcttttcacgttcttcttgcaactcaaccaaggcgctcttacgcaccttaaccaaggcaaattcagcagcaacgaacaacgttgcaaacaataggactaggatgatgacaataaccgaaattaataactcaccttcactcaatgttattccctactttcttttagtacaaattcaatgacaccattatagcaaaaaacacctgatatttatcaggtgttcactcgcgtatgattaatgttcgtcttctgagtcagattcaggatcctcttcaggcaacgccacaacttcgaaatcattgatgtaagcatccttgaaatccaaagctgtaatctcaaagttattaatcttgatagcttcaccaacttcaaagttaggatgctcatcaaggacataacctgtcaacgtgaccatttctgaatcctcaaatgaacggatttcagtcttaaagaatcgttcgaaatcgtacaacgtcatctttccagagaccttgtagtgcatgtttccttcttcatctgatccaatcttttgaaccaaatcatcagaaacatcatcgatttcgtcacgcaccgtaccaaacaactcttcataaacgtccttatcagtaacgatacctgacgttccaccatattcgtccttaacaacaacgattggtgcacggtgctcaatcatttcttgcaaaacttccgtaataggttggttttcagaaacgactggcaaattacgcaaaacagttcgaactgatgcatccatactcaaacgcccttggcggaccaagtcatatgagaagacgtatcccaaaatcttgtccttgtcgttgtcagcaaccactggcatacgtgagaacttttcttctaggtacaagttcaatgcatctccgattgtgtccgtaacatccacaactgttagttgtgtacggtcaatcataatatcaactgcaaccttgtcattcattgagaaggcacgcttcataaacgttaagtcttcttcgtccaactcacccgcttgggcagcatcctcagacaacgaaataatttcgttttgtgagtagatgtcttcatctgggtgagcattaaatccaagcacctttgttacaccagcagccgtacggtcaaacaaccaaattaatgggtaaagtacgatgtggaagaacataactggacgcacgatgaacaacaacaccttaaccggttggtcgatggcaatgttctttggcaccaagtcagtaaagacagcgtggataaatgtaaagatcaaaattgcggctactgacgcaacactgtgggcgatagctgctggcaatagatgtgatgaaataatcaagtcagcgatgaacgcttcacccaaccaacccaaaatcaatgatgtcagcgtaataccaacttgcgcagttgatagatactctgtcatgtggttagtcatgttaatggcgtgcgttaagtttgatgatggcttgttacgtgcttcttgcaacgcacgcaaagctgatggacgcaccttaactagtgagtactcagttagcgtgaacaaaacagccaacaacaaaataacaacaataacaacaatattgatcataatagacggaccggaatccataattggtttacctcttctttaataaaaatattttcgtaataaacattataacagaattaagcgttgtacacacccgcatcatataatgcgttatgcaattcaatgaatcgctccaatgacaacttttcagcacgcgtacgtggatccaaatcgatagcttcaagtgcggccgtcaacttggcttgcattgcctcacccttaccaaaggcagtcgtcaagttgttccacaacgtcttacgacgcattacaaaaccaatcttgaacaactcaaacaattgcttttcgtcacgtggttgaaccgccaatggctcacgtggcgtcaatgaaataattgctgaatcaacattagggtttggcacaaatgctgttcgtgataccgtaaaggccaacttagcgttcattcggtattgcactgccaacgtcaaagaaccatagtcctttgtaccaggctcagctgacaaacggtcggcaacttccttttgcatcatcacgacaatgttgtcaaagtgaatacctgattgcaacacttgcatcaagattggcgtcgtaatgtagtaaggcaagttggccaccaacttcaatggtgccgttgtatcagcaaattgcttggcgaattctttctccaaatcaaccttcaagatatcgttgtgcacaattgtgacattgtcatatggcgccattgtgtggtccaataccggaatcaaacggtcatcgatttcaaaagcgacgacttgcttggctgctcgggcaagttgctccgtcaacgcaccaataccaggtccaatttcaacaacgttatccgtatcctttacgtcaccggctgcgacgatattcttcaaaatattgatatccgtcaagaagttttgaccaagtgacttcttggtgttgataccaaattgattcatgatagcttgcgtgcgcaccggcgtcgcaatatcaggtacatcagacatttaattctcctcatccatctcttgtaagatggtctttaattcttcgtttgtcacgccaaacatgtttagtcgcttcagcaattgcttaccattaacgtagcccaatccaaggcgttctgagacatgttcacgtcgttgtgcagcatttgcaccagccatcagtccataacgcaccaaatcgctacgcgtgatgtctgacgtcatatcgacatcactggctgtataaactttgctaagtgcctggcgaatatcatccgccgaggcgtattcaattcctaaactatgatgcttaatctggcgaccagcttcatctttcgttagaaatgcgtgcttcgcatctggcacgaccgccgtaataagcttccgcaatcgctcaccattgaagtccggatccgtaaacacaataatcccacgtgacttcgctgcacgctgaattgcttgtagcgtcgcttctgacaacgctgaaccattagtctcaattgtgtccgcttcaacagcatgacgcaaaacctcagtatcagccttaccttcaacgacaatcacttcctgaatcttcattacttatccaagtgccacaaacggtgtgcattcgccgttgtaatgtcagccaactcgttatatgtcatcccaagttggtcggcaatgttttgaatcgtgtagcggacgaacattggctcattttgcttaccacgcattggcgttggtgccaaataaggtgcatccgtctcaactagcaaacggtccaatggcactgacttcaatgtctcatggacatccttagcattcttgaacgttgcaattcctgagaatgaaatgtacatacccaaatccaagaattgcttagcttcttctgccgttcccgtaaatgagtgcatgacaccaccaaactcagcaacgttggcatcctttagcacttcatacgtgtcagccgtggcttctcgcgtgtgaatcgtgacgggcttgtggaattcacgagccaagtccaattgcgccttaaacactgctttttggacgtctggcgttgggttctcttcccagtagtagtccaagcccatttcaccgataccaacaactgctgggtcagctaattgttcacgtagcgtggtcatatcttctggcttaaagtcgccactctcacccggttgccaaccaacaatggcgtgaacaccttcaaattcgtgggcgatttcaatggcacgttgattaccaactgtgtcatatccaaccacattcatttcaacgacacgatattcacgtgcgcgggcccagtaagctgcgacgtcatgccaaaaagattcgtcgttcaagtgcgtgtgtgtatcaaagctatccgctggacgctttgttggatcataaattgccatgatatctcctatttctaaacgtttgtaatacttactattttatcaaagaaacccagagaatacgaattgagacctgcaaaaaaggccaggatttaatcctgacctctcatcaattaatcttctgcatcagttgccagtacaagcgcctgtgctgacgtgacttcgttatacaattcattaatcaatgctgaactgaaacgatcatcacgacgtcgctcttgtatgaacgtcaattctgcactcaatgcccccaacaaaatttcctgctcctcagccgaagatacttgctggtctcgaatacggtcacgttcttgtgccgcgacatcacgtaatgcaactacataacgaggatcttcactttctgcctcagcctgtgcaatgaagtcagccaccgcaggctcgctaatctcagcaatttctgtaaagactagttcgcgacttgaatgatacttttgcacggcgtcatcagggtttaagtatcccgtcttcttaacagccttaaacttcttttgcatcgccaacgtttgattcaaatcatgttgttcgtgttcggtcagtcctcgtcgtgttgccttacgttgcaagcgatctatacgtcgttgcatcttctgattgatacgacgcatacgttcttcgggcttgagtcgccgtgaacgcatcaaactcgtcacaacgcgctccaaaatgcggaaccacatccgcacattgtttgacccacgtgcccagcgtgaatcagcattggccttcactctacgataataaatcatcgtttgttgcgatacgataccggcatttatcgccgcttcaactgcctcatcggtaacgctttgaatatccgttaaggctttttgccaaatcgtgcgatctaattgatcaccaccatatcccaattgatcctgcaattgatcaatcacatttcgcttaaccgagttagacacatctaacccttccacatatgacatggccgcattaatcatagcaatatgcgcttctgaatattcgctagtgtcatactcaggcttaatttcaggcaacatccgtggcaagatcaacaacggtgccaccaaactgacgataataacggttgccgcaatcagcaacaacatatcacggtgtggaaaggcctgaccattatcaagcgtcaacggcaatgagaaggccatcgccatcgttactgttccgtgaaccccacccaacgcgaaaatccaagcatcacggtttttatgggtttgatcgaccattgatgacatcggtgaatcctgacgaacacgctcaatcataatgtgacggaagactgccataacgccgtagattgcgaggccaattccgatataccctaaccacgtcgttaatggtgagtgaatataagtcttaaatacgcgaaccaacgaaataccaagtaacacaaacaccagtccatttaggagttgtgacacaatcatcgtcagctgattattcaagttatttaattgcgatgacataaactgcgtgtggtgcttttcttcattagagatgattcccatcaccaccacggcgataatacctgacacgcccgcatgttccgctagtccgtacaccagaataggtgacaagaaataaatcattacgtgagcaaccgtatcatcaaactgcgcgcgcaataaatgttggcgaatatacaaaagtaccacgccagcaataccaccgacaacagcaccaccaagggcaacaataagaaactcttcaaagccatgaatgaacgagaacgtgccagtgttcatccacaataaagccaactccaatacaactagaccagtcgcatcattaaacaatgactctaaactcagtgcgcgtccgataccctttggcacttccaatccatctgtaacagattctagagcggttgcatctgttggcgttacgatggcagctagcgccaaagccattggtaaagcccagccaattgcccagtgaccaaacaacatcaagacaacaacagtcataacggcaatgataccggctaagttgataattgcccggaaattctttgacaccaaacggacatcagttcgttgaccttcataaaatagcaatggcgcaataatcagcatcataaaccattccggatcaagttcaacgactgacttgcttagcaccggaatcgtcgccaagataataccacctaaaatctgccaaaatgccttgggaattcgtggcattacctgtgacagtagattagcgacaacaattgtcaaaatcattggcaccaatgtgtaaaagattgtcatactatctttcctatctttttttaataggtctattctaacaaaaagagagcagtgtgacgtacacactgctctcttaatttttaatgattagcctagttctgaaccagcttcgatttcatctggcaaaatcgtcaagataacgttaccgtccttttcagcagacaacaacataccttctgacatttcacccatcatcttacgtggcttcaagttagcaacgaaggcaaccttcttaccaaccaaaccagcgtattctgggtaccacttcttgatacctgacaaaatcgtgcgaccatccttagtaccgtcgttcaacttgaagcgcaacaacttgtttgacttctcaacttcagtaacttcaagaatttcagctacacgcatctcaaccttgtcaaagtcatcaaattcaatcaaatcctttgtagggacttcaatgtatgacttttcagcctcttcagcaggctttgcagcaccacccgtcatctcatctcggatgtaagccacttcggcatccacatcaacacgtgggaagattggctcacccttttcaacaaccttaccacccgttggtaggtcttcaaacttcaaatcagcgatttgcaagtttgactctgccaaaccaagttggtggaagatttgcttaggagcgcgcgtcaaagcaggttgcaacaagatagctgcaacacgcaatgcagcagccaagtgggccattacagaagccaacttatctgcttgagcttcatccttagccaacgtccaaggtgttgtctcatcaatgtacttgttagcacgtgaaatcaacttccaaacttcagccaaagcgtctgccgtacgcaaaccagccatgttttcgttgtaagccttgataacatcgttagccgtttgaaccaagtcagcgtcaaattcagtcgcacctgtgttaagtgcaggaataacaccgccttcgtacttgttaatcatcgcaacagtacggttcaacaagttacccaagtcgtttgccaagtcgtagttcaacttagaaacgaagtcttcaggcgtaaagataccgtcgttaccgtatggcattgcacgcaacaagtagtaacgcactgcatcgataccgtaacgatcagccaatgtatcagggtacacaacgttacccttagactttgacatcttaccatcacgcatcgtcaaccaaccgtgtcccaacacttgcttaggcaatggcaagcccaaggcgtgcaacataattggccagtaaatcgtgtggaaacgaacaatttccttacctaccaattgcacgtttgctggccagaacttatcgaacaaagtcgtatcatctgaaccgtatccaagtgccgtaatgtagtttgacaaggcatcaatccacacgtaaacaacgtgcttagggtcagatagaactggtacaccccacttgaacgccgtacgcgttacggccaagtcttcaagaccaggcttgatgaagttattaatcatctcgttcatacgagactcaggttggataaattctgggtgtgacttgtagtagtccaacaaccagtcagcgtactttcccatacggaagaagtatgactcttccttaaccaactcaacttcgtgaccagaaggtgccttaccaccgataacgttgccgtcttcgtcgcggtaaacttcagccaattgtgactcagtaaagtactcttcgtcatcaactgaataccaaccttcgtactcacccttgtagatgtcatcttgatccaagaattgttggaagatcttttggatagccttctcgtgatattcgtccgtcgtacggatgaaaccgtcgttggtaatatccaagtctgcccacaacttcttgatatctgcagccatgccgtcaacgtattgttgcggcgtcatgtttagcttttcagccttttgctcaatcttcaaaccgtgttcgtcagttcccgtcaagaagtaaacatcttcattcaacaaacggtggtaacgcgcagccgcatcagccaacaccgttgtgtaagtgttaccgatgtgcaacttaccagatggatagtaaattggcgtcgtaatgtagaatgtgttcttatctgccatttttcttatacctcccgccactacgaatgggtagggcgtcattttttgattgcgagaccatcccgcaatgtctgttgtttattataacaaagtttaggaagccccgcttaagttatattgcggacttcgaccgtaacttgcacaaaaaaaccgtaccatttctggtacggtttccgttgcatcgcgacgtcctatcctcgcaggaagcgatcctccaactactttcggcgctattgagcttaacttctgtgttcggtatgggaacaggtgtggcctcaatgccatcgtcacgacacggtatttaattgagaaaatattagctctctcaaaactgaatcataatttgtaaatcaaacttcgtttgagccttacaccacacccgcattcccagcttggaaggctggagcactagccattgtactacatccgcatgaatgctttttataacttcgttgccgcaacaacataatatataatacacatccatttatgaatcgtcaaccccttttttaaaagaagtttgaattcattttattttctacttgtgaacgtacatcgcatccccaaaactaaagaagcgataaccctcagaaatagcgtgttgataagcattcaagatgttttcacgtccagtaaacgccgcaaccaacatcaccaaagttgactttggcaagtggaagtttgtaatgaacgcatcaacaaccgtccacttgtaaccaggcttaataaagatatccgtccaacctgagtcttctcgcagttcaccattaaactttgagccaattgtctcaagggtacggattgatgttgtacccgttgccacgatacgaccaccatcggccttcacatcattcaatgtttgtgccgcctcagctgacaattggtagaactctgagtgcatcttgtgatcctcaatgttctcttcttcaaccggacggaacgttcctagaccaacgtgcaacgtcaattcaactagcttaacacccttatcagcagccttttgcaatagctctggtgtccagtgcaatccagccgttggcgctgcagctgatccattaacctttgagtaaaccgtttgataacgttccttatcatctagcttctctttaatatatggtggcaatggcatttcaccaagtgattccaaaatctccaagaagataccatcgtacttaaactcaatcatacgaccaccgtgttcaagctcttcagtgacgactgccttcaatgcaccatccccaaagacgatttcttgacccactgggtacttcttagctggctttaccaacgtttcccaaacatcaccatgatcttgacgcagcaacaagacttctacgtgaccaccagttcctggacgctcaccataaaggcgtgctggcaagacgcgtgagttattcataaccaatgcatcgccaggatttaggtaatccaaaatatcatagaagtgtcgatcgtgtacttcacccgtttctgcattcaattccaacaaacgtgagccatcgcgttgcttcaatggcgtttgtgcaatcaattcatgtggcaaatcatagtcaaaatcttcaagtgtatagtgttgttctgtcatctcaattaacccttcttctcaacaaatggtagtcctaagtgttcatacgctgcttgcgtcaccacacgtccgcgcggtgtacgctgcaagaaaccaatttgtagcaaatatggctcatacattgattcaatcgtatcaacttcttcaccaatattagctgcgatggtattcacacccaccgggccaccttgatagtattcaatcattgtgcgcaaaatcttgtggtcaacttcatctagtccggcactatcaaccttcaacaaatccaatgagaagttaaccatcgcatcatcgatgtcatcgcgctgcttcaccatcgcgaagtcgcgcacacgacgaagtagacgatttgcgacacgtggcgttccacgtgatcggcgagccaattcaatcgcacccgactctttaatcgttgtattaaaaatgtcagctgaacgttgaataatctctgctaactcagctgttgtgtaatacgccatgtgttcgacaataccaaagcgatcgcgcaacggttgtgacaacataccggcacgcgttgttgcaccaatcaatgtgaatggtggcaacgggaagtgaattggtcgggcagttgggccttcaccagcgataatatcaacgtagaagtcttccatcgctgaataaagcatttcctcaactgtcttaggcatacggtgaatttcatcaataaacaacacgtcacccggttgcaattcatttagcaaagccaacaaatcgcccgacttttcaatcgctggccctgacgtcgtacgcaaaccaacgcccatttcattagcaatcaccattgccagcgtcgtcttacctagtccaggtggtccatacagcaaaacgtggtcaaggggttcttcacgttgacgggccgcttgaatataaacttgcaagcgggccttcagcggttcttgaccgatgtattgactcaacgttgatgggcgaagtgacttttcaatcaattcctcaccgaaatcagccgccgagtcacgtaaaatatcgtcagccatctaacagcctcctttcggcttattattggagtaacttcaaaccagcactgacatacgcagccgtatccattggggcttccttagccagtgccttttcaaccttattaacatctttcttcgcatatccaagcgcttcaagtgccaacaaagcatccgtcaactctgggttatcatcattagctggttgcgttggcaaaatcaaaccaagatcagtgtcattattaaacggcaaatcaccaagcttgttttgcaaatccagaatgatttgttgcgctgtctttttaccaataccagggaacttaatcaagaagttcacatcgttattagcaatcgcgctcactagcccactgtgatcagcattcgccaaaatggccaaagctgacttcggaccaatcccagacacgtttagcagcttttggaacagcaacttttcatcagccgtaataaagccatacaaagattgctcgttttcacgaataatttgctcaacgtaaacgcgttctaattcattcaatggaaaagcgtatggattggcaactaagacgcgatagccaacgccaccaacttccacaacgatgtaatttggtgcaatatcagtaataacaccattcaaatactcgtacatctatcttctccctgttcatttacttaattcatattgtaccagaaattaagttttcccgaacaggaagatacaaaatcaagcatctggctccttttgtatcacatgcgatacaccgaaagcacttttagttagtcaaatcgataatttctagttttctttcacaattcgttcacaactcaaagctattataagtatatcgacttgatgttaaccgaattacaaacccatgtaattctgcaagttgattcgtcacccacatggcgattgattttgctttcccaagcgaatctactcaattaacatatctcttataaacctacagcaaaaatggaccaagtcttcgtgactcggtccatttttgtttaccatcattttctattcagcatcaataccaatgaatgaccatgtgtcaaaatcaaacaggccttgatccgtaatcttcaaacttggaataactggcaatgccataaacgacaacgtttggaagacatcaaagtcgacattgcatagttgcgaaatcttagcatgcaactcacgggtcttagcaactgtcgtttcaactgatgccgtggtcatcaacccaccaatttcaagtggcagtgctgtaacgtcgccttgtccatccacaacaaccataccgccaccaatttcgcggagcgcattggccgcctgcacaatcgcttcatcactggcaccagcaatcaccacattgtgcgaatcatttgagaaagttgtgccaacggcgccttcccgaatgcccaacccgcgaatgataccaacgccattacccaaatcatggtaacgttccgcaaccgtaatcttggcaaattcagccgttggcataaattcatggtcttcattcattgtgacatcgacaatgctgtgttcggtatcaatgtggaaaggctttacgtcaataacgtgcgcacggcccgtcttcaatggcaatgccaaatcagccttagtcaaagaaacattcatcaagttcgtggcgaatgggcgtggttgcaccggctcgtgctcatcgatccattcaccgctgaccatcgtacgtgttggtttcaacgtctttaaatcacccaccacaaccaaatcagccacatacccagccgtcaacgcaccaacattagcgaggtgatgtgcttcggccgcattcaacgttgccattgtcaacgccaattcaggagccatccccgcgttcatcgcaacacgtacactatggtcgacaccaccattttctgcaatatccactgccgtcttatcatcagttgcaaatgagaattgacgttgattttgggcattgatggctggcaagattgccaattcatcttgttcaaccgtcccttcgcgaatcaagatgtgcatgccaagcgctgcacgttcagcagcttcctgggcattaaccgcttcgtgatcggtatcaatgccaacattacggtaatccgcaatttgctcaggggttagccctgctccatgaccatcaaccgttttgtgtgcagccaatgcatcagcaatcttttgcatcatatctggatcggcatttgcgaccgctggatagtccatcacttcagccaacccaccgacgtcgggatgctcgtaaaacggcttcaagtcagccgcatgcagcgctgccccagtgcgctcgaagttcgtggccggtactgacgatggcaacatcacatgataatggaacggcgtccggccagcttcatccaacatatattggatagctggtgcaccagccacactcgcaatttcatgtggatcaatgaaagcgcgggtaaccccatggtccatgaaaacacttgccaaggttgtcggtgctaacgtcgtactttcaacgtgcatgtgcgcatcaatcaagcctggaatcacgtactgaccttgcgcatcatacgtttggcttgcgacgccatcagtcggcgtacccaagaaaacaattttgtcaccagttacccaaagatccgtctcaacaaatttttgattaaaaacatcaagtactttggcattcgtaatatgccaatctgctgttactgtcatttcattacccctatgtatacaagaaaagtgcggcaagccgcactttcggtttaaatctattgcttggcgtagttcggtgctgactttgtcaattccacgtcatgtgggtgactttcagccaaaccagccgctgtaatttggacaaattgcgcattaagacgcaaatcatcgatggttgctgaaccagtgtagcccatgcctgaacggagcccaccagcaatttggaacaaatcatccgcaggtgtgtcaccgataatatcggtgtcgaccataacagctaccgcaccagcagccaacgcctttacgatgtcacctgagtagcgaataccagcacccaaaacaacgccggcatcaaattcgctcgcaacttcagcaactgccatcgttgtcgttaccgtatataccggttgaccaggcaatggggctaccttaaccaaatcaatgcccgtttcaaacaatcgacgggccgtctcagcatcagcaactggaccagccataatcgtcaatggcggtacttgttgcgccaacaaacgcaacgactcgatggcttggtcaaggttgtcatccaatacaaaatcaatcaacttcgccccagctgcatggagcataactgccgtctcaaatgcatcaacttcattcaagacttcgaccccaacaagggtagcctcatcatcagcgaccattgtttgcacatcttgtaattgcgttcccccagctggcaagactgccagtgcaccgttttcagcgaatgcttgtgccatccccaaatccgtcatcgctggtgccccaatcaccggcaatgcctcttgcacatcagctgacaaattcgtcgccaaagacacggcgtttggcaaaacgtttgattcacttggtaccaacaatacttgatccaaactcaatccagctacttctgtttccatcatgtttaaactctcccctaggcttgtgcgacaacgatacgtggtacttgtggcaaacgcgtgtaatcaaccgcttgcttcatattagccaagtgaccttggttcaccatctcatcaattgtcgttgcaccagcatttaccatgccacgtcgaaccccaaccaatacattgttcaagacatccgtcaacgcacccttgtacgccgtacgtgcttcgataccctctggcaccatcttgttggcttcattaacttcaccttggaaataacgatcctttgaaccgttttccatcgctgcaattgatcccataccacggtacgacttgtattggtgacctgtttgttcatcagtaaagacttccccaggtgcttccaaggtaccagcaagcattgatccaagcatcactgcgtttccacccgaagccaacgcctttacaacatcaccagcatccttgataccaccgtcagcaatgatggccttgccgtattgcttggcaacttcagctgcatcggcaatggctgaaatttgtggaacccccacaccagccacaacacgcgtcgtgcaaattgaaccaggtccgattccaaccttaaccacgtcggcacctgcatcgtacaaggcagcagcgccagccttcgtcgcaatatttccagcaatgatgttcaactctgggaaggcagcacgtacttcgctaaccttacgcaacaccccttctgaatgaccatgggccgaatcaagcacgattgcatcaacgccagcttcaaccaaggcaccaacacgcgtcactgtatctgacgtcacaccaaccgcaccagcgaccaacaagcgaccgttaaaatcaaccgctgcttgtgggtagcgtgcgacatcgattgttgccgccttgaccttagcaacctcggctgcttggtcggcaatcaacatgttcttgtgaaccacacccataccaccaagcaaagccaattgcgttgccaaacgcgcttcggttaccgtatccatcgcggctgacaacataggaatgttgaggtgcaaagttggtgttagggtcgttgccaaagaaatatcgctttgtgataatccgttagtcgtgttgtttaccaattgaacgtcatcaaacgtcaatcccattggaacgaacttatttgtggctgaaaagtgtgacatgagaacctccaaattttgtgtaacaaaaaagcatttctggatacagtgatccacaaatgcttacaaagagggttttctcttgtgagtcatttgcggattgtcgccactttaggtaggcggtagaaactcgctggccattttccagcaattaaatctgcaaggacaaaaatgtcttttttgaaaaagttattgttgaatatactacacgacttatgacagattgcaagccctagatacgaataaaatagttttaatatgattttacgttcggttaacagtttaacagccgtcaaaccgcgtgattattccgaaaaataagcgtacaatagttacttgtaaaaaataaatagcgattgaggaggtcatcatgattcagcgacgactttctggtctccctacctggcaacgtaatttgtacgtcctctggttcggggttttcatgaccggaattggcttcagtgaagtcatgccatttctctccctttacgtcgacactttgggacacttcactaagaaccaattgacgttctacagtggtgccgcttttgcgattacctttttgatgacggccattgtctcaccattttggggtaagctcgctgacagtaaaggccgtaagctaatgttgctccgtgcttcattaggaatggcgattgtgttcttgctcatgggagcagcacagaatatttggcaattgattttcttgcgcgctttgcaaggattgtttggtggtttcatttcaaatgcaaacgccatgattgccacgcaaacaccaaaggaacgctccggctacgctttgggtctattggttactggtgtgaccggtggaaacttgttaggaccgtttcttggcggtgtgctagcctcattggttagctatcgtatttcatttgttattactggtattattttcctactcgttttcaccttaacactgacaatggtcaaagaagagttcacaccaatcgagcgtggcgcttcaccatctcgtaaggaagtcttccaaatgttgaagttcccaaagctcaccattgtcttgtttaccaccacgttgattattcaaatggtcaaccaatcaatcagtccgattgtcgcactatttgttcgtgaacttaaccacggtgcaccaagtacgactttcttagctggtttggttgcggcaatgcctggaattgcaacaatgattgctgcaccacgttttggtcgcattggtgaccgcattgggacgaaccgcatgatcatgattggttttgcattagcattcatctttatgctaccgactggttttgtgaccgccgtctggcaattggtcattctgcgtttcatgattggtatttcagatgcgacgatgttgccagccgtgcaaacgatgctgtcgaaatcaacgccacgtgaaattacctcacgtatcttcgcctacaatcagtcattccaatcacttggtgcggttgccggaccaatgcttggtaccctggttgcaacatactttgattacaacggtatcttcatggtcagtgccgcgttgattgtggttaacgccattatcttcggtacgaatacacgtttcttgcgtcacactgatgacgacgtaaacgactaaaaataaaaggtcgatgttactcaatttctcgagtagcatcgaccttattttttacttcatttttctgagaatgtggtacatcaacagcaaagccagttgcaacgcaccaaatgacatcacaaacacaaaactgtgcatggtaaaggcttgcaatacttgttgcacaaccgaatgaccgttagtcagcagatcccatgagtttagacgcaggaatcggccgaggtaaatcccaaatgccgataccaatgacaaaacagcataaaatgctagtgcctcaattctggcttcttcaccaaaaaagcggaccgccatgatatgtgccgatgacacccctaacaacgtaccaatcatcacaccactagccaacaacgcgtagttaaagaactgcgtctcagtcatcaaacctgttccaattgatgataagtgactaaagtccgtcagcatgtacattgtatttggaaagaaaatcaaccaaacaagtgttagcacaactgtcatccaacgctttagttggcgatttttgattaacagcgataaatcaaacgggattaacgctaaaaagacgttccatattaaaaacatgaaattcgtcggaaacagccacactgttagcatgaacagtgccaccaatatatgaatttcaactatgccccgcttcacatttctcaccaaccctttaaaacatcataccttcattatacggcgcgaacattaaactaagccaaacttagcttttacttcagcgacgacgtttgcgccgtgacgcgcttttcgtaaggtacttcgaacaaatcaacatccccaacttcaaccgtcacttgacctgacaacaagtccgtcacatcagtttcgaaacttgccatgtcttcatcagacaccggcacaaccagtgtcacacccgtatcatattgtgtatccaaaataacatattcatgttgctcgagccaatactttagaggctcataattcttataatcaatgcgcaacgacattttgtgacgttgaatgcgttgcactaagccgagttctgcaataccacccgcaactgtaccagcgtatgcacgcaccaaaccaccggcgcccaacttgataccaccaaagtaacgcgtcacaacagcagcaacgtcgtgcacttcattgttcttcaacacttctagcattggcacacccgctgttccagctggttcaccatcatcagaataacgttgcacttggtcacggtcacctagcatgtatgaccagacgttgtgcgtggctttattgtgctctttattaatacggtcaataaactcgcgcgcctcttcttcggaattcacacgcgccatattaacgataaaccgagactttttaatgacttgttcccaagtatattcatccgccgcaatcgtgacatattgatctggattgctgacgtgttcagtttgattgccggccatcattttctccttttcacacaaaaagccagatgcaagcatctgacttttgatttttactcttcgaattcgaaagcaaagtccaaaatttgaacagtgtcaccaccacgagcacctgcatcacgcaaagcttcgtcgacacccatgaagcgcaattgacgtgcaaaacgcatcattgattccgtgtagttcgtgttcgtacgcttgaacaaacgttcgatttcatcaccgtaaagaatccaagtaccatcttcatcacgatcgatttcgaatggcgtacggtcttcggtaaactcgtacaaagcagtctcgttttcatcaggctccatacccttaggaataaaggcaggcgtctcatccaacaagtcggctgtacgttgcatcaatggttccaaaccttgacgcgtcaatgatgaaattggcataatctcgacatcttctgggacatctggatcagcagccaacttcttcttgaattctgccaacgtctcttcggcgtctggcatatccatcttcgttggcacgataatttgtggacgctccaacaaggctggatcgtactcggccaactcgttattgatcttaacgtagttttcgtatggatcttcttctggatcgatacctgacatatcaatcatgtgcaagataacacgcgtacgctcaacgtgacgaaggaattgaattcccaaaccgacaccttgtgaggcaccctcaatcaatccaggcaagtcagccataacaaagtcacgaccatcttccaaacgcaccattcccaagttaggaaccaatgtcgtaaagtgatatgccgcaacctttggcttagcagccgttacaactgacaacaacgttgactttccaacagatgggaaaccaaccaacccaacatcggccaaaaccttcaattcaagggcaatgtccaactcttctcctggctcaccgttttcagcaatttcaggagcagggtttgttgatgaagcgaaacgcatgttaccgcgtccaccacgtccaccttgcgcaacaaccaaacgttgaccttgctcagtcaagtcaccaattacgcgacctgtctcagcatcagtaatcgttgttccttgtgggaccttgataatcaaatcatcagctgactttccagtcattccctttgtggcaccattaccacctggcgtggccttaaagtggcgcttgtaacggaaatccatcaaggtacgtagtccttcatccacttccatcacaacagatccaccgtgaccaccgtcacctccaaaaggaccacccatgttgatgtacttttcgtgtcggaaagaaacggctccatcgccacccttaccggcctttacaaaaattttaacttggtcgacaaacgccatcgtttatgacctcactttctttattaaagctcttaaaatataagcgcaatttgacgcttatcattttacagtacttagcctcgtttgaccacctttaatcatcactgtgttgaattgcttgcagtgaaatcttaatggcgttggccaccttctcagaaacgccgacttcgcgcagttcttcaatcgatgcattggcaatcttcttgagtgaaccaaacttcgtcaataacttctgacgcgtctttggtcccaccccggcaatttcatccaactttgaccccaaagaactcttcgagcgcaattgacggtggaacgtaattgcaaaccggtgcacttcatcttgaatacgttgcaataggaagaatccttgcgactttggatccaagttaacgtgcggttcaccttcttcacgcaacaagtcggcagtcttgtgttggtcattcttaaccatcgctgcgaccggaattgccaaaccaagctcatcttcaatgacttcacgagccgcattcaactgaataacgccaccgtccatcaaaatcaaatcaggcatttcagcatgttccttgagcaaacgcgtatagcgacgacgaataacttccatcgtttcagcacgttcgtccgcgtgatcaacggtcttggtcttgtacttgcggtatttattcttgtttggcacaccatcttcaaaaacaaccatagctgaaaccatttcttcaccctgggtgtgtgagtggtcaaacgcctcaatacggtgaatatggtcaagacctaacgcgtcggcaatttcttgcatcgctccattcgtcttcgactcattcatctccatcaaacggaacttttcatccaacacgattttggcattcttttccgccaaatcgagcaagtcacgcttttcaccacgttgcggtgtacgaactggcacattcaacacttctgagataatctgcttatcaacgccagctggtaccaaaatttcctttggcaacacggcgttcttacggttgtagaactgcaaaataaaactcgtcaattcttcttcaggcgaatcaacgatggcaaaggtgcgcttctcacgtttcatcaaacgtgcttggcgaatgaagaagacttgaacagataaccaccccttgtccatatagaagttgaacaagtcacgtggtgtcccgtcctttgagataatcttttgcttttcaacagttgtctcaataaacttcagttggtcacgcaaatcggcggcccgctcaaactcaagcttttcagccgcgtcggccatcttaccttgcaagaccttcgtcacttcttttgtatccccatccaagaaccgttgaatcttcttgatttgatccaagtactccgtgaatggcaccttacgatagcaaggacccaagcattgtcccatgttggcatacaaacatggacgtccttggtaaccgttacaacgacgcagtggataaaccttttgcaagaaatgcaaggtttcctgcgcagcgtaaacgtttggataagggccaaagtattgggcgccgtcttctttgacgtcgttggccaattcaagctttgggtctgattcgtgggtaatcttaatgtaagggtaccccgttccacgcttcaagcgaatgttatagtacggctggtatttttgaatcaacgtgatttcaagcaacaatgattccttttcggaactcgtgacgatgaaatcaaagtccgcgatattctcaaccagctgggctgtcttaccggtgtgttcacttttaaagtaagaacgcacacggttttttaggttcttggctttaccgacataaatgattttgccgttcacatccttcatttggtatgagccgggcaaatctggtaacagcgcaagtttttgttcaatatgttctgacgccattcgcttttcctttcaaatagtatttacttcattatacgccgaaattcggtttaatttaaccccggagattggttgaaaaactgcgcaaaaaaagccactaggaaatctctcacttcctagtggcttaagggtttactttgtcttgtagacgtaaatcattacggctagtgacgtcatcaacaatccagcaatcacttcgactgtctcggttgaagatggtgccattgttgttgctgtcgttgcagccaatccctcttcggccatcaaccacaatcctgataccgtacctgcaatcgcaagtgatgcttgttgtgcgaacttcatctgttctttcccctttaaataaataattgcttccgaagttgtatattacggttcgtttttgaattatttatgaagttgaaaacgttctcattattaccaaatgcgaatacggttttcaccgacgaccaaactaccaactggtccggctaattcacgttcgattttgtcaccaaccaaatcttcattcaagacatagtccgatccatcaggttgttcaaactccgcatcaaccaagcgtaccttgcccaacgtttctgatgtctgggttggcgcgacaaaattcgtcactgactctggtaccgacaattctaggtaatacgcttcgccttgcttcaccacatcaaagtgtgggttcatttcatcaatcacgtttgtcttttccgcagtggttgcacgggcaccgttcaaataaacgttatgtgacacatacattggttgttcaaccgtttcgaattgctcaatatcggttggtcgcgtcatgtgcaccgcatcaatgtacgcttcaagcgttgttggcgcttccgcgaactgtgccgttccttgcacttcccacgccttgtttggcgtgccgataaagacgttgttgtaaaaacggtcatccccaccataaacgcaagcatagccagcaatctgagttgagtgcggcgtgtgatatggcgttgttcggttaagcaccttttgacgcttcatcgcaccagcaatcaagttattgacgaacgcgccaccttgggcaaattcatcgaccgcattttcagaaccgaaaacattgtgatcaaccatgaatggtccgtggctcacttcaacgaagaagtcacgattgttgtggtgataaacgttacggttaatgcgcgtaccttgggtttgccaatccaaccatgttcccaaaaccgtattgtggatgtggttgtgtgtgagttgcacatcaatcgccgcgtgcaacttaatgccagcaacttcccagccatggtattcacgcttcaagccaatgttgtagatatggttatccgcaatcgttgagaaaacacaacccaagtgaccaacgataccattttgaccacagtcataaatctcattgtttcggacgacgtgtgacccaatcgtctctttgcgccaaccatgattgtttatcgcctcaaacaccgtttccaattgatattggtagcccggcttgtcacgacgatgcgtgtagtagttatcgcctgatgcgcgttccttacctagtgaaataccactagtcttagcgtcgtgaatacgattgttctcgataatccaacccttactccagtgcgcaccaatcaagcctggttgctcagcagtaggtggcgtccaaggtgttgctgcttgcgccatttcaaagccacgcaccgtgatgtagttacgaccaatttgacttggatagaacacatatgggcgcacgttcatttcaatcaaatgctctgacggcttaacatcatgaaaattagcataaattgtcgtcacatcatccgtcacttcagcaaaccacttgtacttggtacgagctgggtacggttctgcaatttcctcatccgtcataaaatcatgtacatgattacgctcttcacctgcatcaacctcagccaatgattgcgcttcgtacatcgacaccccatcaatataaatgtctgccgtgtgcgtcttacgatttaggtttgaaatgagccaatccccatttagctcatcgtcaaacggattgaactcgccaaataccttgttatccacaattgccttatagaccgaaccagcaatctcttcccactcagtaaccacttctgagcccttgataactaccttttcgcgtggcgctgcttggtaaacaatgcggcgtcggtcgcttaacccggcgttctttggattcacccattcacggtattccccctcgtgaacaatgactgtgtcgcccggttgcgcaatttgcgcagcgtgattaatcgtcaacaatggccgctctgccgtcccgtcgtgatgatcatttcctgtttttgcaacgtgaatctgcatttttcctacccccatgaaatcacttttgccccttcatcataaacaaaagtgacgcctttctgacggcaaaaaaatgaatttatttagacgacaagcccctgggtaatcgtggtatactattggcaagaatatttgatgggggaaagccaaatgccattgcaaacaaagcgtactgatgaattgagcaagcaatttgatgacttgttcgttatgcccgaagtcaaggatgatcaaaaggatcgtttcttgggtaagaaggatgaagagcaattgaagcaataatctgctcacgaaaaaacgtcgatgaccataatcagtcatcgacgttttttgtttagtcttttgttttaacgaacaagcctttcagactagccaaagcagccttcgtgatattaccgtcgttgtacgtcaacacgttacgcttgtagacacgcaagccgaacatgctgatgaataccaacacaatcacctcaagcaccaatgcaattgccgcatcccccatcgtcgcatattgcaaccctagacgggccggcatcagcgtttgtgaaatgaatggcacgtatgacaagatgttcaagaatgtgttgtttggttgacctgacaacgtaaacgttagcacataaccaatcattgccaagtaggtgattggtgccaccgcttgttgcacttggctcaagtcatttaccattgccgcaacaatcgccgttaggaccatgtacataaagatggcaaccaatgcaattagcaacgtcataatggcaaagccggtatcaactcccgccaatagttccttaatcatcttcaagtacttgtagtgtggcgcaaagacgttaaccagcaacccagcaattacatacagcaacccatgcgtcaacgccaagccagcaataccgctcaacttaccgaagaattgtaccgctggtgatgtcgcagccaacaaaatttccatgatacgtgatgacttctcattggcaatctcttgcgcaatcatactgatgtatgacgtcaagaacacgaaaatcaagataccaatggccgatgccaaagccgtattggctgaattggccaccgctccaccggctgattgtcctttgtcgctttgcgttgtcgtcttcaaaaccggtggcgtcatcaacttttgcaaatcttcacctgacaagttaatttcagcggccgtgttcagcattgaaaaactcgtcaagttggccttcagcttcgtttctgaaactgattcaccgtctgctgaggcaaccaattggaacttcgtctcaccagtctccttcagatacgcgtctagcttacctttgcgtaagtctgctttggcttgcttttcagttgcaaccgacttcaccttagcgtcaaaaccatctgtctttttcaagtacgtcgttagcgctggttggttcaccaccccgacaactggcgtcttgtgactttgcgtggccgtaatgatgaaagtgattcctgcgatgacaccaacaatcaataccggcgccaagaccaacgcccagtatccgaatgacttaatacgtgttaagtaggtttggcgtgctactaagaataattggcgactagtcatttacgccacctccttgtacttcacgacggaaaatctcatcaagcgttggcgcagtttgcgcaaacactggtacataaccgtcttgtgcaactgtactaaagacttggcgaccaacctcggcgttcgtcaaacgtacttggcgaccaatgccttgtggttcaacggacaggacgccatcaatggccaacaaatctgcgtctgctaccggtgactcaatataaatctcggtacgaccgaatgattcacgaatctcagtcgtggcaccactcaaaaccgtttcaccgtgacgcaacattgtcaggtggtcagacagcttttcaacacccgacatattgtgagaactgaaaataatcatcgcgccatcttgcttcaaacgcttgatttcattcatcatcaattccgtgttcactggatcaagtccggtgaacggctcgtccaaaatcaaaaattccgggtggaagataaccgttgaaatcaactgaaccttttgtgcgttacccttagaaagcttttgcactttatcagtcgtcttacccacgacatccaagcgcttcatccaatcttgcaatgacgccttcgcatcagcacgcttcatgccgtgcaactcagcaaagtacatcacttgttcttcaatggttagcttttggtacagcccacgctcttcaggcaaaaagccgatgcgctgtttatcagccgacgtaatcttgtgcccatcccaagtaatttcaccactcgtaggttcgataaaatccaagaccatacggaacgtggttgttttacccgcaccattttggccgatcagccccatcacttcaccaggcttgatgaccatattcatatcctgaactgctagcttgtcgccaaaccgcttgttcaggtttttcaattcaatcatgtaagttactccctatttgtctgacatgttaataccattgtacccaagccatatgaataattgtattaactttattcatttgttaggaaaatatcgtcacagactgcatagaaaaagtcgcacccataaaaaggaatgcgactttcattagacattatgcccagttaatttcatctcgttgcacaagttggaaatcaatatttgccatacgtgcgcgtccagtagggttttgaccatggacttgcaagtagaaacgaacgtcagcatcatcacgcatctctgctggtgacaacacaacatcgtggtcgtagtgcaattggaatcccttgagttctggcacatacgtgtatagacgaccaacatcgacatcaaaatcggcgcggtacattgctaccaattcgacgtccgttgctggatttgttaaatcataacgaatcatctgacggcctccatctcatttaatcgtatgcgttattttagtgcttcacggcggaaacggtcaagcatttcgggtgtaaacttcaactcacgtggcttagacccgttttgttcaccaatcaaaccacggtccgttagtgcgtccatgatacgaccggcacggttatagcccataccaaagtggcgttgaattgatgatgttgaagcaccaccagcgcgcaagatgaattcaagcacgtcatcccaacgttcatctagttcatcaccttctgagccaggattatcaatcgcgttcacttcttcatcagaaacttccatgctcttatcatattgggcttcaccttggttcttgataaagtccgtcaatgactcaacgtcttcgtcagtcaggaaggctccttgaacacgttgtggaccgtttgaaccaattggcgcaaacagcatatcaccacgacccaatagcttttcggcaccgttactgtccaaaatcgtacgtgaatcaacaccagatgaaacggcaaacgccatacgtgatggcacgtttgccttaatcaaaccagtaatgatatcaactgacggacgctgtgttgcgacaatcatgtggataccagcggcacgacccaactgcgcaatacgcacaatagagttttcaacgtcgcctgaaacggcagacgtcatcatcaagtcagccaactcgtcgataatgacaaccaagtatggcatcttttgaaggaccgtacttgggtccgctgcattgcgcttttcaactaagcggttgtaaccgtcaatgttacgtaccccttcatcagccagcaacttgaaacggcgatccatctcggaaacaaccttcttcaagccaagcgatgccttcttagggtctgaaataaccggtgtaatcaagtgtggaatgtcgttataaactgacaactccaccttctttggatcaaccagcatcaaacgaacttgtgatggcttagcttgcaacaagattgaagccaaaataccgttaatggcaactgacttacctgaaccagttgaaccggcaatcaacaagtgtggcatcttcgtcaaatcaagtttcacgacgccactcgtcacaccacgaccaattgggacaaccaaaggcttggtggtatcgataccagcctcttcaaccatgtcacggaacccaaccgttgcttgttgatcattggcaacttcgattccgacaacatttttaccagggataggtgcttcaatacgcaatgacttggcagccaaggccaacgccaagtcatcggcaaggttttgaatctttgacaccttcaccccaacggctggcttaatttcgtattgtgtaaccgttggaccgagaaccaccttttcaaccgtcgcgttgatgttaaaactcttcaacgtttcatgcaagatacgcgccttgtcgttcaacgcatcacgctctgctgactggtcagtcgaaccaatgtgttgcaacaagtcagtggttggcaaaatgtaatccttgtcgtcaatcaacgtacccaaaccagacgcatcgacgtcagccgttggttctgaaatcgttgatggctcaacgtgaccaacatttgattggtgcgccgttgtctttggtgacgtttgcgcatcattgtggccaagaatatcagcgtgcgtcaatggcacatcttgaccaggcaatagctcatcatctggtaggtcttcaccataaacaaccggttcaattgcagcatcttgcgcttgaataacggcatccggattaaagcttggatcatacgtcatttcaacgggcgcttcatcttcgcttggaagtggcgtgaactcattcgtcactggctcagccgccgcaaacgttgcttcatcaactggcgcttctggcttgaatggtgctggtgccacaatttctggcatcacaaattcagtggcagttgcatcgacttcaggttcagcctccacagctgccgttggtgtcttagccttctttgatgtgattggtgcatcgtttgacgcagaggcatcgggcaagccatccatcatctgcgcagcgcgttctgcttctgatgcaaacggatcttcgttaaagaactcttgcatcgctgacttttgacggacacggaagctttcaattgattcagtcaccttttcatgggctgttgaagcttgcgtttgcaccaaatcaccggcaccttccgccaaattaaagaagttgtcaaacacgtcgcggattggcaaattgaagaacatgaccggtccagcaatcaatagaatgactgctaccagccatgatccaaaatcagccatcgccatataagtaccgctgtacatcaacgccccaatgaggccaccaccaaccggggttgtgaccgccttattgttcatgtcttgattgattagcgtttgaatggtttgtgcgtaagcctcatggacgttcatcttatcaaagagcaaaattgatccaaccaacatgacacccaaataaaagagggtgaaaccaacgtattgttgccacttaaagcgctttggccattgcccgtaagcaaccaccaccaggagtggaattaatagcacaagcaagaagaactgataagaaccacctactacaaggcgaataatattagccaaaaactttccaactaatccaaccttagcgatggcgataaccgtcataatcgtcgcaaatagtccaatcaattgtgggccacgttcaagccaccagttctgttgcgctgcttttttctttttggcagacgtcgactttttgggcgttgttttacgcttggtagtcggacgcttttttgctgtcgccgccatattaatctcctttcttaagtgaataaacgctcatttatttttacttcaacttgtcgtagtcgtattcgtgggtcaagtctaggtttgggaacccttgttgacgcaacgtttcatagataacgatggctgccgtgtttgacaagttcaatgaacgaatgtggtcatcgttttgtggaatacgcaacgccttctcagggtgttgcttcatgaatggctcaggcaaaccagtcgtttccttaccgaacaagaagtagtaatcgtgatcagggtttgtgtaatcagcttcgtgataagcacgtggtgcgaactttgaaatcaagaacagttcatctgtttccttcaagctggccataaaggctggcaagttctcgtggattgtaatatcaactgtatcccagtaatccaatccggcacgcttaacgtgcttgtcatccaacttaaatcccaaaggctcaatcaagtgaagctttgtgttagtacccgttgccgtacgggcgatatttccagtatttgctggcatcaatggctcaaataatacgatgtgattcgtgctcatgattttctcctattctgggaaggctcccctcccccaacgcgtttaattgcatacaaaaataagtatagcatggtctgataactgaccacgctatacttagtaaaccttattaaatgctttactcgttttcttccgtaaacagtcctgagttttcctgccaccacttatacaaacggtacaacaacactttcagaatggcataccctggaattccaaaaataacccctaccaaaccaaaaatgttaccagctgacaacaagataaccaacactgtgaccgggtgaatctgtagagaattccctagcagcttcggcgtaatgagtcggccttctaaagtctgttcaatcataaagaccactagtaccgacaccaacatcattggcgaaacgaataatccaacgacaacggctggtaccattgccaaaaatgatcctaagaacggaatcaaattcaagacacccgccacaatcgcaatcaaccaaccatatggtaatccgataatcgtatacccaatcgcaaacatcaccatgacagcaaacgcgactgacaattgaccacggatgtagtttgagatttggttgttaatttcaccaattgtctcaaggaaagatggtcgcgcctgtggtggcaaaaactttgccatgtatccaggcatttggtgaccatccttcaacaagtaaaatagcatgaacgggaatgtcaacaaggtgatgacaaccgttgttactgttccaacaacggacgaaacgcccttgattcccttacttgcatattctgccgagtattgtttaaaccaggttgtgatgtcattgttggtttcattaaaccacttattgaccgacacaaatcgcttgtccgatgtcaaattatcaacggtcttaacaataccgcgccagtactctggccagtgtttaatcagtccagcaacttgatccgtaatccaaggaatgaatacggccagcccccaaacaatcaacaaagccaagacaacgaattgaatcgtaatcgtcacggcacgatgaagcttaaagcgacgctcagcccaatcaaccatcggatttagcaagtaataaaagacacccgcgataataatcggtgcccccactgcgccgaacaagccagcgactggtgcaaagatgaaatcaaccttctttaacatataaataatggccaaaatcagtaaaattaccagcatcgttgaaatgattttgttatctaacagccagcgatacaaaatcgaccggtgtttttggttgttgctcatatagtctatccccccaaaataaaaagccagttaccaactggcaactgactttattgtatcaagcttaaatgaacaatacacgcactgattcaggaatttcgtagtccttttgtgacaacgtcaattcaccagtctcagcatcgcgacggtaaaccgtcacattgtccgtgttttggttagctgcaaccaagaactcgttacttgggttcaacgcgaagtcacgtgggaaatcaccctcagttgaaatccattgaatgtgttcaactgatgcaccaccatccttaaccgcaaagacagcaattgagttgtgaccacggtttgacgtgtaaacaaacttaccgtcgtttgacaagtaaatagcagcaccaccgttgtgctccgtccaatcagccggaatcgttgaaacagtttgcaacaacgtgaatgatccgtcagcgttgtacttcaatactgacaactttgatgacaattcacccaacaagtaagcgtattgaccatcagggctaaagcgtaagtgacgagggccaaagccggcttcggtctcaaacgttgcaaccaacgtcaacttaccttcgtcagacacatcaaacgtcaacaccttgtcagcacccaaatccacaactgccactcggttgtctggcgtcaagttgttccagtgaacgtgtgatgacccttgttctggacgtggacctgagccttctgattggaatgaatccgtcaacgtcaatgaaccatcggctgcaatcgcgaagacttccaacgtacccttgtggtaattacctgagtacaacaattgacgggcttcatcaacagcgacgtacgcaggtgaagcaccttctgccaatacttcttgtgtcaacgttgcttcgtcattggcgaagtcaaatacaccaacaccaccttggtcaccgttcttgtcaactgcgtacaacttgttggccttgctcaaagcaaggtatgttggtgaaccaacttcagcaaccaacttggcatcttgcaactcaacagtctccgtgttcaatgctgcttcgtaaattccctttgaaacacgtcgcgtataagtaccaaataaaatcttttccaatgccatggttgatctcgctttcattcattaaatatctttcagtaaacgcttacattataacataaaagcgtatgcatcgacagacgcatacgctttaattacctatttattcgcaattacttcaatttcaatgcgggcgttctttggcaacgttgccacagcaactgctgaacgagccgggaatgcatcgacgtcgctaaagtattcggcgtacaactcatttactggcgcgaaatcagccatatcagccaagtaaacgctcaccttcacgatatccgcacgcgtcatatcagccgcagccagcaagccatcaatattcttaaagacttgcgttgcttgatccaaggtcgtctccccggcaaactcacctgtgctaggaatcaacccaacttggcctgaagcgtacaacgttccatttgtcaaaacagcttgtgagtatgggccaattgcagccggcgcattcgttgttgtaataatttgctttgtcatttttatatcccctacaaatttaatatcgtcagtatacgcgcaaaaatcgatagcagaattaaaaaaggacctacccgaaaaggtagatcccaaaactgttatttagccttaaacttacgacgctcttgtacacgagatacaatcactgacgcaataattgatagtgttaacaagccaacgataacagtcaatgacaccacgtttgaaatgtggaagtgccaatcgaatgccttcgctgattcgttcaagaccatcttcaccccaataaaggccaagatgaccgccaatgcgtacttgatgtaacggaacattggcaaaataccagacaaagcaaagtacaatgaacgcagtcccataatcgcaaaaatgtttgacgtcacaacgataaacgtatcttgcgtaacggccaaaacggctggaattgagtcaacagcaaacagcaaatctgatgcttcaatgaacaacaaggccaacaagaattgcgttgcgtaacgctttccgttttccttaaccaagaaatgcggttcagccacatcttccttcaatggcaaaatcttacgcaaactcttgataatgaagctatcgttcaaatcttgcgcttcttccttttcgaagagcatcttcacaccagtgacaatcaagaacgcaccgaagatgtacatcaaccaggcgaaatggtgtagcaaggctgccccaccaaaaatgaaaatcacacgcatcactaaggcaccaaagacaccccagaatagcaaacggtgttgatacttcaattcaataccgaagaaaccaaataccaaaatgaagataaacaagttatcaatactcaatgacttttcaagcaagtatgccgtcacgaaatcaagcgcatgatcaccgcctgtgaagaaccaaaggcctcctgcaaaaatgaaggcaagcccaatccaaaaggcactccacaacaatgattctttcatggttggtgcctcattatttttgtggaagacacccaaatcaagtgccaacatcaccaaaacaaaggcgaagaaaccaatccaataacctataccaacttccatgtatttctcaactttcttataaatagatacgtctcgggccaccaatttggtccgcaatgactataagactattctaaccgaatattaatcgtaatactattaccaactttttgacaatagatttcaaacgctacgacttatcttgcgttaatttttgtgaccacccgaacttggcatctaaccaccagcacaaaccaactagtgcgtatgtaaacacggcatccaaaaccgcgtgttggtgcaacaagaacgtacttaacgtaattagaaggccgaagacaacacagatagtcccgagtacggaccggtgctcacgaagggccacaacgccaaagaacaccgctaaggcagcccaagtattgtgataacttgggaatgatccaaaaacattcacagatgatgaatcaagcactgcaatttgactataaaatgcactatcttttgacaacacttgaattggcccaaccaaaaagtcgtgtggaattgtcaccgttggcatcacggcataaatcactgtcgaaatcacatacaccagcgaactcaccgtgaagtattgccaaaacaatcgctctcggccagcaaaccaggccatgactggccacaaaataatccaaataaatggcaatggcatatacagtgcaaaaatcggcgtgaaccaaggtatgacgcgatcaatgcctaactgcaaattaacggctgaagcgacgccaccgtgtacgccgccagcccaagtcgccacaacaaagtagctaaatgattcaatcgcccatacaaacaaaaacagtcccacaatcattggccatttcgcgtgccaaacctgtttaaaactcgtcatgatatttccccctatcatcttcatcaaacacaggttatcacggcattgtgaacaattttcgaatgacgtttttatatgcaaaaaagccaggcaagaaattgcctggctctcatattaattaatgattagtttgacttaacgtccaattctaggaagttagcaaccttagtagcttcgttagcaacagcgtgcaacgtagccaaacggttattcttaaccgcttcgtcttcgaccatgaccatcgtctcatcgaagtaagctgcaactgctggttgcaagttcaacaaagcaaccaacttagcatccgtttctgcaacttcagcaactggtgaaacagcttcgaacaaagccttttcagcatcgttctcgaacaacgttacatcaacaacagagtcagttgcgttcttcgtcgtcaagcgcatgacacgcgtcaacgcttcaacgccttcacggaagttatcgtcagccacgtgagctgccaaaacttgcgctgattcgaacatttgtgtcgtatcagcaaagtcgttctttgttacggcgttgatgatgtcacgacgaacaccatcatcttgcaacgccttcacaacacggtcagtcaagaagttcaccacggcagccacgttgttttgcaactcagccataacgtcttctggcaaaccaaacttagcagcatcagcgttgatgtcatcaatcaagtctgacaagataccgtcaatgtccaactcccacttgttgtcggccaaaatgtttacaacacctgaagcggcacgacgcaaagcgtatgggtcgtttgaacctgatggtaccataccaccggcgaagaatgacaacaagctatccaacttgtcagccaaagccaaaaccttacccaaatctgatgctggcaattcaccatcagcagagattggcatgtagtgctcacggattgcttgggcaacggcagcatcttcaccaaacaagttggcgtacttctcacccatgataccttgcaattcgtcgaactcaccgaccataccagtcatcaagtcaaacttgtaaatctcaccagcgcgagccaactttgtttgttggtcagctgagaagttcaaacggccggcgataatggcagccaaagccttggcacggcgcgtgtgtgcagcaactgatcccaacttagcgtggaatgaaacaacttccaacttgttgttgtagaagtcgatatcgtgcttttgatcctcgtggtagaagaacttagcgtcttccaaacgagcaaccaacaccttctcgttaccggcaatcacgttgtcgatgtgttcagcgtttccgttacgaactgagataaagtgtggcaacaaagcaccgttagcatcaaccacgtggaagaaacgttggtgctccttcattgacgtaatcaatacttcgtcaggaacttccaagtaaccttcgtcgaagccaccagcaaaggccgttgggtattcaacgatgttgttaacttcttcaagcaaatcatcgtcaacaaccacttgccagttgttgtcagcagcgatttggcgcacttgtgcacggatgttttccttacgtgcttcagcatcagcttgcacgaaaacagacgtcaaagcttcttcgtacttgtcagcagatgcgatttcaacatcgtgacccaagaagcggtgtccacgtgatgaacgaccagttgcaacacccaaaatatcaaatggcacaacttgatcatccaacaatgcaaccatccaacgaattggacgaacgtattcgaatgtgtgacgaccccacttcattgtcgttgagaacgtcattgcctcaacaactgacttgaagcctgccaaaacagcagctgctggttgtccagcttcgaacttcgtcacataaacgtattcgttaccgttaaattccttgaacgtgatgtcgtcggtcgtcataccttgaccacgtacgaacccttgggcagcctttgagtagttaccttcagcgtccaaagcagccttcttagcaggtccctttacttcttcagtgaagtcttcagccttttcagccacacctgaaatcaaaactgccaaacggcgtggcgttgagaatggcttgattgactcgtaagccaaacgctcatccttcataaagttttcggcacgctcaaccaattggttaattgcgggcgtaaccaagtgggcaggaacttcttccaaaccaatttctagcaaaaagttagccatcttagttctcctcctcatctgcaggcaagtacttcgcacgcaaagcttcgtccttcaacaatgggaaaccaagcttcttacgctcatcaatgaaggcacgcgcaactgaacgggccatgttacggatacgtgaaaggtactttgcacgctcagtaactgaaaccgttccacgcgcgtccaacaagttaaacgtgtgtgatgacttcaaaatgtagtcgtaagctgggtgaaccaagcccttttccaaggccttcttggcttcagcttcgtactcgttaaagtgacgcaacaacatttcttggtctgactcttcgaatgagtaaactgagtgctcgtactctggctccttaaagatgtcaccgtacaaaacgccgttaccccattccaaatcgtaaaccgttggcacatcttggatgtatgaagccaaacgctccaaaccatacgtgatttctgatgttacggcatcaacttggattcctccaacttgttggaagtacgtaaattgcgtcacttccataccgtccaaccagatttcccaaccgataccagcggcacccattgaagggttttcccagttatcttcaacgaaacggatatcgtgttccaaaggatcaatgcccagggccttcaaagaatccaagtacaattcttggatgttgtcaggtgatggcttcataaccacttggaattggtggtgttggtacaaacggtttgggttatccccgtaacgtccatcggctggacgacgtgatggctctacgtaagctgcgttccatggctcaggaccattggcacgtaggaacgtgtaagggctcatcgtaccggcacccttttctgtatcgtaggcttccattagcattgcgccttgatcagcccagaacttttgcaacgtcaaaataatgtcttgcacactcatttttgcactcatgttgacaaattcctttctcgtggttggcttcgagcaaataaaaagccctacaccaatcacctttaaaaatgattgatgtagggacgataattcgcggttccaccctacttctaggaaaactcctagcagcttcattggattaaattgtgctccggcagtgccccttgcgtgttttcagatcaccctcacatcaccggtgacttgctggactgagttcacgtaattcttctgctttcatcgcttattacatgtaataagtttatcactcagcgtttaaaagtcaacgcgcatgactgattaattatgaatgctggtgcgcatattaccacggtccgcttcgtccttcagattaaaaaagactgacaacaaaatgttgccagtctatcataattaatcttgatattcggttgtttttgaccacaagtacatgccgtagaaggcattgaaagttttcacaatcatcaggacaaacatccccaatgcaccagaaccgcctgcctgaatttgattccaccaaagtagcaagcccacggcgtcaacaaataaccacacaatccattgtgacaagtagccgtacgttgccaaaatttgggccaacatcccaagtggtagttgagatgagtccaggtaaacttgattaccgtgagccgtcttcgcaaccgtcaacacaataccgtaaacaacaactgcccctgcgactaggcagcccatcatcttcggaccgatacgcttcgcctgaatttggctgtgatcagcttgttgtgataattgcttgtaccacgccgccatccccacgaattgcatcacaaagaagaatccttggttcaaaatatcaccaaccaagtgattgtgaatcgacattaatagccaaataccgttcgtcaacaatccccagaagaagttcgtcaaacgaccactggccaacataatcaaatagaatgccaagacaaggccggtaatcaaactcgtccatccagatgatgaataatcacccgtataaacaaacgcccaaaccgtcactgccatgataacaaccatgtacacacgttggaatcgattcatcaatgccaagtcgcgtctgatgttagttggcgacgtcgcctcacgcaaagctcgcttcaaattctgcatctttctactactccctaaaactaaaacactaagaaatagattatcacattaactaatcgtttgtgcataatgtcacaggactgtaactcgttagtgttcgggatgcgaaaaaagacgacatacccaatcgagcatgtcgtccattaactgttgtttaatcttttccaagcaatcctgatagcttgtccttaacgtcatccaaatcaacgttatcaagcatgtcagccttgtcgccaagcaactcgccggccttatccttcaaatcgttcaagtcagctccttcaagtacgtcagctgccttgtccttcaaatcatccaaattaatgtccatagaaccatctcctatctgaaaacgttttctttctacacatttattataagtgattagtcttcggatgtctcgttatttgactcggcctgtccacgcgttgctaagcgtgcctgccagcctgataactgttggataaatgattttgcccgcaaatgaacaccaacttgatcatcatatagcttgtccatcacgcgcgccatatcttgttttgtttcgtcttttagacttaacgtgcccagttgcttcaaatcaaccttcgcaagttgtgacaagatacgaactgagcgtggatttgcgttcatacgattttcgtcttgatcccagtgaatttggcaaatcgtgccgtttagcttctcagaaaaatcgagtggtaaatcgcgacgaccacaaactgcgcattcaccccaagttggatttaatccaaacgccggtagcagttgcacttcaaagtagttcgctaagccttgtggatcaagcccttcctccaacttttccagtgccagctttgcccagttgaaccatttttcgattggttgattatcaacaaacgctgcgtcaatcaatcccagaatgtatgtcatgtaggcattcttttcaacatccatcatcaactcacgcgaatggtgactctctttaaccgaattgatgaaactcaatcccgtttgatttagcgtgccttcgaaggttgcaatcgtcatcggttgaacatctgcagcaaactggtagcgcttagacttaccatttttgatgtaaaacatgcgtttgccggccgttttagtcagcattttaaccatcaagtctttctctttgtggtcacgttgatacatgacaatcgcttcaaatacttccgccatgccgcctcctaataaaaaagagaccaatcagtctctctttcacatcattaaatatctgaatcttccttgtaaccgtacgtttgcaaggcttgtggcttatcacgccaacgttcttcaaccttaacccacgtctccaagaaaatcttgtcaccaagcaagcgttcgatatccttacgagcacgaacaccaatttccttgatcatcgcaccttgcttaccgataacgatgttcttttgcgttggacgctcaacaacgattgtcgcttgcacgtgcaagtggttctcatcttgacgttcaatcttgtcgatcacaacggcaactgagtgtggcacttcttgacgcgtcaattgtagcaccttctcacgaatcaactcactcatgatgaaacgttctgggtggtccgtgatttggtcagctgggtagtattgtggtccttcttccatcttgtccatggcgaagtccaacaactctggcacaccgtcacccttcaaagctgaaattgggaagatttccgcaaattccatttgttggctgtaatcagcaataattgccaacaagtctgatgggttaaccaaatcaatcttgttgatgatcaagtaaactggtgtgtttgtgtccttcaaacggttgatgatgaagtcatcaccagcaccacgtggctcgtcggcgttaaccaagaaccaaaccatgtcggcttcacgcaaagctgacatcgccgtcttcaccatgaagtcacccaatgagttgtgtggcttgtgaattcctggtgtgtccatgaacacgatttgaccttcatctgtcgtgtaaattccttggatcttgtttcgtgtcgtttgcgcctttggtgacatgatggcaatcttttcaccaatcatcttgttcaaaagcgttgacttaccaacgtttggacgaccaactagggcaacgaaacctgacttaaatccttgttcactcatgtatattattctctattctttctataatccacgcatcgcgcgtacaactaacttatttaataatcatctgcaaatttggcaaaatgtatggttggaaaatcaaaacaccaatcacaatggcaaatgccaccgctgccaacacagcaccagacgccacgtccttagcaaccttggctagcgggtgatattgttcacccacaatcaaatcaacgatggcttcaaccatggtattcacgaactcagccatgataaccgtaaagacggcgactgaaatccacaaccaatctgaacgtcctagtttaacatagatgccgacaagtaagactacaatcgccgcaacaatatgaaaacgcatgtttcgttcacgaaccaaaagttgaccgataccttctaaggcatgaccaagggcttggatgaagtgcgtatttttctcaatttgtggctcttgtgtagcagcctttttcttatcgtgtaagtccataactatctaaaatctcacgttgcaaatcaaacataatcttttcgtcttcatcactgcgcatgtggtcgtaaccattcaagtgcaagaaaccgtgcacaaccaagaatcctagttcgcgctcatatgagtgttccaagtattccgcttgttcaccaatcttatcgacagaaacgataatgtcaccaatgttcttcgccaaatcctcggccatctcttcatccatcatcaatggcaaatcatcaccatcttcttcaatggcaaatgagatgacgtcagttggcttgtccaatccacggtattcgcggttgtaacgttgaatttcgtcattgttaacgaatgttactgacatctcagtgtctgctggcaacttcatatactcaccagcatagtccaaaaccttttcaacaaggtcaatttgctcggcaggaacgccaggctttgattggtcaataattgccaaatccataatcttaatccttcttctcttttgcttcttttgccttttcttgggctgcatcaaaggcgtcgtatgcattaataattgctccaacaactgggtgacgcacaacgtcatccgctgcgaactcaatgaattcgatgtgtgacacatttaccaaaacacggcgagcttgaatcaagcctgaacgcaccttgcttggcaaatcgatttgtgaaacgtctccgtttacaaccatgtgcgaaccgaaccccaaacgagttaggaacatcttcatttgttgtggcgtcgtgttttgcgcttcatccaaaatgataaaggcattatccaacgtacgaccacgcatgtaggccaatggcgcaatttcaatcgtaccacgatccatcaaacgttccgtatgctcagcacccaaaatagcgtgcaacgcatcgtaaattggtcgtaggtaaggatcaaccttttccttcaaatcacctggcaagaaaccaaggctttcaccagcttcaactgcaggacgcgtgatgataattttctccacatcaccgcgcttcaaagcagccacggccattacaacagccaaatacgtctttccagttccagccggaccaataccaaacgtaatgtcgttattgcgaatcgcttgaatataacggcgttgaccatagttcttaacacgaactgggtgtcccttggcatcacgaatcaacgtctccgtgtacatatcaccaaagtattccaacgtcccacgttctgacatcttcatcgctgagacgatatcagttgcgtttagcttcacaccttttttaatcaaagcggccaattcagcgacgattgcttcagcagcatcaactgcgtcagcttcacccttaatcgtaagttggtccccaaacacagacaatgcaacatgcatgccttcttcaattaacttcaaattactgtcttgtgcgccgaccaaaccaatttcttgctcagcattttcaaaacgataaactttttcaacttgtgctgccaaaaatgtaatccctctaattcgaattattctcttacggttactattataccgcaaatagatatgtatcgggggcatcccccgcatcagagttcgactaagattagcccaacaatgattgtacagtttggttaaccaacttaccgtcagccttacccttaaccttaggcatcaaagcacccataaccttacccaagtcagcctttgatgatgcaccaacttcagcaatcgtttccttaacaacggcaacgacttcttcttctgacatttgctcaggcatgtaacgcttcaaaacgtcgatttggccttggatttcttcagccaaatcttcacgatcagcatccttgtatgattccagctcttcgacacgttgcttcatttcacgtgacaaaacagccaattcttcgtcagcagtcaagtcgtgacccaacttgatttgctcgttagaaactgaagactttaccatacgaacaacgcccaaagtaaccttgtccttagccttcattgctttcttcatgtcgttagtcaattgttccaacaaactcatagtcattatctcctttttgtttttgaataatttctgagtataaaacaaaaccggaccaccagcaggtagcccggcaagagtcgaattaacggctcttcttgttcttgcgcttacgagcggcctcagccttcaacttacgttgtactgatggcttgatgtagaactcacgcttacggtactcttgcaaggtaccatcctttgatacaccacgcttgaagcgacggagagcatcatcaagagactcattcttacgaacaacagtctttgccataatgtttaccctcccttcccgtgtgaagtttccaacttttatatatgtcgcacacttttgttctttaatagtttaccagaattgaacctgttgtcaacgctttatacaaaactgctgacgatttgttatcactcttcacctagtcacacctaaaatgtttgtacctaagctttttgtacctaacaaaccgttagcttacaactttggttcgtagaaacgaccgaacgtgcggtcgatgcgccaaagtgatgcccaggcctgtggatcaacctcataaatggcatcacgtaggtcatattgctcatacattgagataaccgtgaacaagacttccttgtggtggtggttatatccaccttcagcgtggtgcacgatggtaataccacggcggatatcacgttgaatggcttcgataaccaaatcaggcttttccgtcacaatcatcacttgcatcttttgttgacgcgtataaaccaaatcaatcacgcgcgcgttgataaccagcccaataccggtgtacaacgcatattgtggaccaaacaagaaccctgaggccaacaagatgaagaagttaaacgttaagttcactgctcccatcttcatgccagtcttacgacgtaccaggataccgataatatccaacccaccagttgagagtccgttacgaagtgccaacccagttccgaatccattgacagccccaccaaagatggccattacaagcggatcgtgcgtccataattgttctggttgcgaaaccaaacgcatggcaatcgcggccagcaacaaagccaacgccgtaaacatcgcaaatcgcttaccaattgcacggtacgcagtaatcattaggggcacgttaatcagcaccaacaagacaccaactggcacatgccaccccacaaagcgttcaagcaatgtgtttagcagctgggctagccctgtaaatccagaagaataaatgtgtccgggtgtccaaaaaaagttcaatgcaatcgctgaagcaactgcatataccatcgcactaccaatgcgacttgagtactggtgtcgattaaaatactgttctatctggtccattttctcgcttctttcaatttgtactttatgattttagcacgaaaatgccgatataaataaaaaacttacggaccaatgcccgtaagttttcgtcatactttaactattatgcttcgttttcttcattacgctcatcttccttgcgacgacggaagaatgcgaataggaatcctagaattgcgcctgcaaccattgtgatccattcagaaccaacgccagcttgttccatcttcaacgcattagaacgcttggcgtcatcagacacaatcatgtcatgaatcaaatcacgaccggtatttgaaccccctagacgagttcggttgccgtttgatgagcctgggttcaacgtttgttgacttgatgctgcattattaccatacaacatcgctgcatcattgccgaacaccgcagcgcgtgcaattgggttaacacccgctgaaaccaatcctagtgtcccgtttgtcacggaatcagtttgtgcaccatccggcgtagcaactggtgacgtggttacaccatttgacccgtttgagtcatttgcgtcgttttgattgtcagcagttggtgcgtctgggcccgttacgtttgaatcgccttcaccagaaatgcttggcgctgcgatgtaacccgtatcaggcctaccaccttctgtattgccgtcaatcgtttgttgaccgtggtcaggcgtgcttggcgctggaacagccccataacccggcttttgcaatgcatctgctggctgtgtatccggcttttgcaacgcgtcagctggttgcgtatctggcttttgtactggctttcctggcttttgtattggcttttgctttggtggccttgctggctgcggatcctgcttctggaatgcgtctgctggtagcttattaggcgtgccacctacggtattaccggcaatgttaatatttccaggatcttgtagttgagtaggatcctctccagaaaaaacaggtttcttgattggtaatgtcgtaataccctgttcaggttcttccggtgttggtgcttcaggctcttccggtgtttccggacgattaccttgttgaataccaacatacattccttgggtcgcataccaagcctctgtttgatctgaagatccgctagtcttgtacagcacttggaattgaatgtcattaacgttattaaacttcaccacaatcatcgcagtcgtggcaaccgtcgccatacgttcgtttttgaacattagataaccatcgaaggttgttccgttaacaacaaccttctccgcgtgccaatccattgcccggctgccgtttattgtgaatcctgcttcacgaataatttcagcacgaacatcagcttctcccagcttcgtattcaaagcgtccatgttagacgtatacaacggtgaattccaagttaccttggttgcattatctaagtctcttacgaccatgtgactattctcattcaaaaaaacatcatcagaaccatagacagtccctgccacagtcatcattcctagaacaacagctgaagataatgctaatttacgccaattcaacatgtcacaattccccaaattcctttaatccaaattctctaacaaaagatacttacttatctttatcactaacaaaaagtataaagatgaattatgaacaaaatgtgaaatgcgacaatctcggctgttctattttcgaaacatattgacttactattaataggaatatcgattgacaaataaaaaagcgcacgttcgcaaaacaatgcaaacgtgcgctttaattatctaattattcttctgacatgtttggtgcttcaatgtcggcgtatacagtcgccgtcaagcccaagtcatcaacaatttgtgccttcgcaacaggtgttggtgcttctgtcattggctcagttgcctttgagttcttagggaacgcaatcacctcacggatgttgtcacgtccagccaacaacatagccaaacgatccaatcctagggcgattccacccattggtgggaagccgtattccataccttcaagcaagaagccaaatgcgtcgtgcgcagcttccttagtgaagccaagagctgacaacatcttttcttggatatccatacggtgaatacggattgaacctgaacccaactcgtatccgttcaacacaaggtcgtatgattgggcgtgtgcttggtgagcaccttccgtcgtctccaacaatggcaaatcttcttcatttggcattgtgaatgggtggtgcgcagcaatccaacgatcttcttcagcttggtgctcgaacaatggccagttaacaacccaagcgaaagcccacttgctgttgtcaatcaaatccatttccttggctgtcatacgacgcaaagcatccaacgttgctgacacaacaccttctgaatcggcagcgaacaaaatcaagtcgccggccttagcttcagtttgagccaacaaatcgtcacccttcgtcgtgaagaacttagcaattggtccagtgataccttcatcagtcaccttcaaccaagccaatcccttagcaccgaaacgctcgatgtattgggccatcttatcaatgtccttacgtgagtagtgatcagcaccaccaggtacaacgattgcctttacttggccaccgttctttaccgcgttagcaaagacaccaaattctgaatcaaccatcaactctgacaaatcttgcaattccatgccgaaacgcatgtcaggcttgtcagttccgaaacgcttgattgaatcagcgtaatccaatactggaatttgggccgtatccaaatcaacatcaaccgtcttcttcatgatagcggcaacccattcgttaaccaatgccatgatttcgtcttgcgtcatgaatgacgtctcaacgtccaattgcgtaaattctggttgacggtcaccacgcaaatcctcgtcacggaaggcacgggcaacttggtagtaacggtcaaagccagcacccatcaacaattgcttaaacaattgtggtgattgtggcaatgcgtagaatgaaccagggtacacacgtgatggtactaggtagtcacgcgctccttctggcgttgacttggccaagtatggcgtctcaatgtcgataaagccgttggcatccaagaattcgtgcgtggcagccgtaatctttgaacggatgcgcaagttcttttgcatctcaggacgacgcaaatccaagtaacggtacttcaaacgcaattcgtctgaaacgttgatatcgtcttcaatatagaatggcgtcgtcttagcttctgacaaaatcgttgccttagcaacttgcacttcgatcttacctgacttcaagttgtcgttaaccgcaccctcagcacgtgaacgaacgacaccttcaacttcaataacgaattctgaacgcatcttttcagcaaccgccaaagcatccgcaccaaattcttctgagaaggccaattgaacgataccttcacggtcacgcaaatcaacgaaaatcaaaccacccaagtcacggcgcttttgcacccatccttgtagcgtgacagtttgatcaaggtaggcttcatcaatcaagccagcatagttagtacgcttcataattagttttcctcttctacgtcttcttcaacttcaataaactctgggagacccgtgtaaagttcagccaacttcaccgtgatttcttcaccagttgtcatgttcttcaagttagccgtttgctcagccaattcgcgctcaccaatcgtgatgatgaaacgtgcgccaagcttgtcggccgtcttaaattgtgcctttagcttacgatcttggtaatcgcgttctgcgctgtaaccaaatgaacggactgcttggaccatttgcatagccgcaacatcagtaccttcacccatgttcgcaacgtaaacatccaatggtgcttgttcaggcaacgttgcaccctcggcttcaagcaacaacatcaaacgctcaagtccgataccaaatccaacacctggcatttcaggtccgccgaactcttcgaccaaaccgttgtaacgaccaccaccagtgattgtcgtccaaccacgacctagcgcagctgattgtgtcataacctcgaaaatcgtgtggttgtagtagtccaaaccacggacaacgttggcatcaacttcataatcgattcccatcgcttcaaggtaggcttgcaccttttcccagtgtgcttgagcatcttccgtcaagtaatccaagattgatggcgcatcagcaacaattgcttgatccttttcatcctttgaatccaagacacgcaatgggttcttctccaatcgcgtttgtgagtcagcagacaactcatcaaagtgtggcttcaagaagtcaatcaaggcattacggtagttttcacgtgattccttgtcacccaaagagttgatcttaaccttcaagtttgtcacacccaacgtttggaacaaatcaactgccattgcgataacttcagcatccaaagcaggtgagtctgaacccaacgcttccacaccgatttggtggaattgacgcatacgaccagcttgtggacgctcgtaacggaacattggtccaatgtagaacatcttgtatggcttttggtgttcaggtccaaacaacttgttctcaacgaaggcacggacaacaccggcagttccttctggacgcaaggcaacgtgacgatcacccttatccttgaagtcatacatttccttcgtcacaacgtctgatgtatcaccagcagaacgggcaaaaacatcaaagctttcaaaaatcggcgtacgcacttctgagtattggtagtcgccgaacaaaaggcgcgccgtctcttcaacgtagtgccacttcaatgattcaccagggagcaagtcagcagttccctttggcttttggaatgattgcttagccatgtttaaaattcctctcatgtttccgatggtgcaaaacgaaaaggcgccctcaacgacacttcatgtatcgtcaagggcgccttttagcgcggtaccaccttgaatttggtctcatgccgtaacgtggcaacacgcgcattgctgcgacctaaaaagtgtccccttgcttcagtaaccacaggcttacaccagaccctgctcgctttcttctaccaaccacaagtttgctttctcatcggtttatctatgggatttattatccaatagaaagtaaattgcgtcaaggtctatggtgccaccgtgtagcacattaagcgagcgtataaacgttccatttcggtaactcggtttgaaaccgccgaaacggcttgccagtcggctgcgttatcgaattgcaagaaggccgcactcatgtcgttaatttgatttttcaacgtggccaaactatgttcttgcgtctgaccaacttcagcgtctacaaaattacgcaattgaatgcccaagtcacccaaggccgccgtcacggccgccttgtcgaaattgactggttcatccccaaacatcacattcgttagatgataagcaatttcatccacaacgcctgccaagcgcatgacttccattgccacttcattatcagtattaatcgctgtcatattaaatgcctcgtttctaaacacattccccatcaaagaaatggtatcgaaattccacgaataatactatcaataacccctaacaatctgtgactaattaacggtttttacccgattgtcaaaatacgtttccaacccttgggccacgtctttggcaatcaactttcggtaagctgggctctttatttgtttaaagtctcgatctgagttgatgtaaccattttccagcaaagtagctggcaccttgttatcaatcaacaccacatattcagcacggtcaatcccacgattctccaaaggcatgttcggattcatcgcatcattaattgcttgcgctaggtccttagaaccattgtctttgtgataataatatgcagtaaagccactcgcggtatttgcttcgtccactgaatcgaagtggaaagaaataaatgcatctgcgtttgcattctcagccacctttgggatttgtgaaagataaacaagtttatcactattacgcgtcataatgacccgagcgcctgttgcccgtagcgtttttgccactcgttgcgccaacaacaatgtatacgtcttttccattttgccactattggacttggcaccaggatcgttaccaccgtgtccagggtctaaaacaatcgttgcttccgacaacggcgtaaccttatctaacggctttgtacgttctagcaaccagctagctacccaccccgtcgattcatcttcacgacgtacctggtaccaaccatcgttttcttgcaaaatctgtaagtgctcaccctgctttagcactgaaatcggtgtgctcgtcacacctcgattttcacgaagcgttaggttggggatttgcaccgttatttgttgcttatacagcatcaccgtcgtgacagaaaccgccacagccaacataccaacggtaatcgccaacggcatccagaattttgtaatccatgccaacattaaccggcctagtttttgcatgttgtcatgtcctttctctaaataatgtcttagaacagtgtaccttatttcgagcaaaaaacggcacccactttttgtgagtaccgtttatgttaggtcttcttttacgtaaaaccagaattagaaagtcttaccttcccattcgtttgatggcaatgcatcaaagtcgtacgttgcaacatccgcaacatccgtgataaaggcgtgagctggcactgacatcatcaagttgatgccaccttccttttccttcaccaagataactggcttcttcgttgcttctgagtaaccaatctcccaggcagtacctggatcaacgtgttcaccctcatagtcaattacagcaatcacaacttcggctggatccaagtgatccttatcacccttgtagattgcctttgcccattcctttgaaccaaactcgaattcgtcgtgttgctcagtacgtggactgaagaattctgacaccgttgggttggctgctagagccttttccatacgttcaatacgatcaatttggtcatcatcaaaaaatggaccggctaggtagacgcgcttcataaaattccctcttcatctaacttttattatttagtcttacctaataattttacccgacgaatagcgaacaagcaacacctacataaatggcacatccgccttattggcaaatggtgctgaagctgttttggccacctgaacctgagtgtgcaacaacgatgcattcgcatgcgtcaaatccggaatgtataccacttccatatcgtacgtctgcccctcacagcgtacgaccttcccaatgaacgggcggtcaatgccctttgcttcatcgcaatgggccaagtcgccaacttgtaactcataatcttgcataggcacttccccctgtactagtctttgcgattagtgtacccagcgcgtttgatgaagccacgcataattattgattttttctcggagttagtgtgccacgtattggcgttgttgatccttcaaaccagccaacacaaacttggctggatcagctgagatatcaaactcacgatcctctgaaccgtgcaagccagccataaacacttcctcataagctggaatagtcaaatactcacgcttctcaaacaaagcgtccatttgaccagcaatcaaaccatcacggaagtttggttgcaaaatagctgagtagaactccccttcagcacctgatccatatgagaagattcccaaacggtcacccgcagctaagtcttcagagttggccaacaatgagtacaagctcaagtaaactgaacctgtgtacaagttaccaatgcgcttgttgtaaacacgacttgcttcaaattcatttaacaagtccgcttgcttagcttcatcagcctcaggcaaaatgtcgcgcaaggccttcaagcccatctttgtgaatggcaagtggaatgcgtaggccttaaagtcattgattgaacgacctgtcttctccttgtaacgtgaccacaaatcgcggaagaactcacggtaaacttcagctgagtacttaccgtcaaccaacgcttcttcagcgtaaaccggacgccagaaatccatcacatcacgtgacatgaattggttgtcgcggttcaattctagaatgcgtgggttttcagtaaccaacattgccactgcaccggcaccttgcgtcacttcacctggtgtgtgcaaaccgtaacgggcaatatcagatgccatgaccaacacctttgaacctgggtgcaaggcaacgtagtcacgcgcttgcatcaaaccgtacgttccagcatagcaagcttgcttcatttcgattgtgcgtgcatattcattcaaacccaacaagcgttgtacataaacagcagctgactttgagttatcaatacctgattcagtcgcaaaaataatcgtgtcaatttccgcgcgttcttcagctgtcaataattgatcagctgcattagctgccattgtgacaacgtcttgggtaggtggcacaacagcttgttctgtttcaccaatcccaatcaagtacttatctggttcttcgtttcgagcgtttgccaaatccaccatatcaatatattggtgtggtgagaaaaagctcatcttatcaattccaataactgccatttcttattttccttccacttgtgatgcaatgcgattcataatatcacgggccaacgctagcttagattggagtggcaacttttctggcgcagcatttcgttgcagcaacgttacctcatttgtgtcatgtccaaatccaacttgggcctttgacacatcatttgcaactagcatatccgcatttttcttttctagtttattttgcgcatacgtcaacaaatcttgcgtttcagccgcaaacccaactaaatattgggtggtcttttgctgacccaaagtcgctaagatatctggattttcaactaaatcaatcgtcaaaccagcgtgatcagcgttcttcttcatcttttgatctgccggtgtcgccacacggtaatcagacacagccgcagccatgatagccacatcggtatcgtcaaaatgatccgtcatcgctgccaacaattcacgcgctgattgaactggcaccatcgtaacgccaactggtgctggcaactcagatgatgatacaagtgtcacatcggcgccttgctccgccgctgcttgtgctaatgcatatcccatcttacctgatgaacgattcgtaatgaatcgaactggatcaattggctcaaccgtaccacctgcggaaacgaccaccttcttgccggccaagcgaccagtctgttgacggagtttcaaatcagcaagtgccaaaatttcatctggttcgggcaaacgtcccttaccagcatagccttccgcaagcatgccttcagctggttcaatgatgataacaccatcttcacgtaacgtctttagattgcgttgcgtcgctgggttttcgtacatattcacattcatagccggtgcaacaatgactggcgtgtgacgagccaacaaaactgatgacgctgcgtcatccccaatgccagctgccatcttcgccaaaatgttggcagttgccggcacaacgaaaatatagtttgcccaatcagctagactgacgtgcgcaatcatactttcattgtgggcatcaaataaatcggtcacaaccgggtgttgcgttagtgcctcaaatgtttttggggttacaaattctgttgcagcctgggtcataacaaccttgacgtttgcaccttgcttcatcaacaagcgggcaaaaatggctgacttatatgctgcaacgcccccactgacgatgagcacaatgtttttatcagtaaacatttcgacactcctttgcatctagttaaaaagtcatctgatttaagtttaccatgaagcgcgaccacaaataaaaagagagtgatatctctgatttttcagaaacatcactctcctaaaatttatatcctacttgtcgtcttgcttacgacgcttagcgataagtaacaacaagattgatgagaataggaagatacctagtggcaaccacctattttcatgtgcaatcgccgtatcaaggcccgcacgactgatttctcgatcgtctagttggctgattcggtcgacaatacgacgaccattcgtctcaccagctagcgtacgtggcgccgttgcttgatatggcaaagactgagctaatggcaatacccatgtgcctgactcatagcccgtgtatgggaggacaccaggcacaatgactggataaccaccgctttgatagattggcgtcgtaccgtaaagcgcttgcgtcacaactgccggtgtctcacttgtttgtgttgccacactaaccgtcgcagcttgttcagcctctgctttcgcaacagctgattgcaaagcctgcatcgctgccaaaatatccgccgttagattatctggatcatccaaggccgctgccgcaagaatctcttgcaaacgttgcatggctgcttgaacagccggatcatcactaactgaactgttttgggccgcttgaatggcttgctgtgcttgactattagcattttcacggctttccttcgccgattcagtcgcattttgaaacttagtcatcgcctgttcaatcgctgttcgtgtcgcatttggatcattaagcactgtttgtagctgcttaatggcatcagcgacacccttttcatttgaaactggcttggcatcagcaattgcttgctgtgcttgctcacgtgcatcatcaaccagcgcagtcatagcatcatgtaacgcttgcatggcagccttaatatcagctgtcaatgcatcgctcgtgtccgttgcggcggtcgtcattgcgttacgcaatgtgtccatggccgcaaccacagttggatcatttgccaaatctgattgtgccacttggtcaagcaacgcatttccatcagtagtcgttgcatcacgttcttgtgtatctgttgcaacttgattcaacaaatcttccgtcgcttgcttgatatccgcataattggcattcggatcattaaccaaagcgttcaacgcatcgattgcagctgccgtggctggctcatgactaacaggtgccgtcttggtcaaagcatctgctgcggcatcgcgagcttgttcacgatagccaaccacatcatcttgcgcctttgttaaggcctcagttgccgcgacaatatccttcgtcaaagcgccactagaatcattagcggcttcgtccatcaaacgttgcaaattagcgaccgcttccgcaacttgtggctcgctcgccacttcagccggtacattggtaatcgtctcgttagccgttgtgttagcagtgtcacgattctccttttcggttgttgtcgcatcagtcaaagccttcacagcatctgaaatttcttcagccgttgacttcgggtcacccaaaacagcttccaatgcattcttcgccgtggccacagctgtttcatttgaaaccggtgctgttgcatccattgcagctgcggcattgtcacgttcagttgcttggttagctgcttcctgagcgaccgcatcctgcagttgcttcgtggcagtcgcaatcgcttcactagtgccttcgtcatttgcagcatcagcttgcgcttgttgcaaagcagtgattgcatcttgaacagcttgtgattggctctgatcgctatttgcggcacttgtggcagcttcattagccgcttgattaaccgtgtcacgctcatcatttgcttcagcaacggcatcttgcaacgccttgattgcgtcattaatttgggccgcggttgccgttgaatcatttagcaatgtgtctaagtcgctgactgcctgttgtacgccaggttcttgtgacactggcgccgtttgacccttcacttgatccgccagttcagctgcttggttacgcgattcaaccgctgcgagctgcgcatcttgcaatgccttcatagcgtcttgaatatcactcgtcaaagcgtcaggactgtcggcatcagcttggttcatgacgtcttccaacgccttaatcgcatcttgtacgccttgatcagctgacaaatcactatcctcagctgacgcgatggcatccgttgccgatgacttcgtattatcacgttgtgtcttagtttgatcaatcacatcttggtaggctgccatggcatcctctaagtcagccgctgttgcgtttggatcatcaatcacctcttgcaaagctgactttgcatccgtaatcgctggttcatttgtaaccggacttgtcttgctattatcttgtaccaatgccgatgcttcgtcacgagctgtgtcttgtgcttgttcggcaacgctgaccgcctcttgcaaagcgcgcatcgcatcaacgatatcttgagatacccaagcgtgaccagcctcatcaaccgtttcgttagccgccttggtttgtgcatccttcaaattctgaatagccgtcaatactgattcatcagtcgcaaccgttgacgattgggccgctgaaatggcatcagctgcttcagtactcgtcgcattacgttcggtcgtatcactcgcagtcgctgcattcaaagccttggttgcatcacgaaccgcttcagcagttgaattttcatcggctaacaaggcttgcaaatcagaaattgctttggccgtcgccgattcgtttgaaattggctttgtttgactcaacgcattttcagctgctagaacagcttcttgcttatcccgagccgcttcggcaactgtatctgaaagctcttggatggcatccaaaatatcttgtgtcaaagcagaagatgaatcatttgccgcattcttttgcaactcttgcaacttctcaaccgcctcttgtacagcaggctcgttaatttgtggcgtaccttgcgcattcgaaatggctgtgtcagcattgctattcgcagaatcacgggctgcgttagccgtatctactgcgttttccagtgccgttgttgcatcgttaatttcctcgaccgttgcactaggatcattgagcaccttatccaatgcggattgcgcatccttaacacctgattcatttgaaactggtgccgtctcaacttgaccagccgcatcacgagctgcatcctgagcggccttagcgtctgcgatagcttgcgtcaccgccttggttgctgcttcaatgtcttcagtcaacgcatcagcattatcggtcgccgccttggtttgaaggtcttgcagtttagcaattgcatcttgcacgcccggttcaccagcttgatcgccagtttgggcgtcatcgatgacactatcagccgcactattcgcggcatcacggttatcttgcgccgtcttcacagcatcctcaagcgcttgttgggcagcttcaatctctgctaccgtcgatgccgggtcatcaaggacatcattcaacgcttgttgcgcaccctgaacaccttgttcgttagaaacgggcgccgtctcaacttggccagccgcatcacgagctgcatcttgtgcagctgccgcctgttcgacagcatcagcaatggccttagttgccgcctcaatgtcagccgttaatgcattttcatcgtcttgactagccgcatcttgcaaatcacgcaatgcttgaatcgcatcttgcacactttgctcatcagcttggtttgttgcttcagcatctgtcactgcttggtcagccgcttcgttagcagtatcacgctgctcagaagctgtatcaactgcatcttgaagcgcctgagcagcgtcgttaatgtccgcaattgagacatccccaccggattcggctgaagcaatcaaatcatccaatgccttttgtgcgttaacaacttccgtttcatgactaactggtgacgtcaccacagcttcggcgtcatcgatggccttttgctgatcagacttagccgcatccaacgcatcttgtaacgctgtcattgcgtcggtaatttcagcagtcgtccccttatcggttgctgcattttcttgtgcttccttcaaggcagcaatcgcatcctgcacgccctgttcatcggcataatccgaattctgagcgttcgttaccgcagtcgtcgcttcgtcattgactccagttcgttcctcacgcacagtatcaatcgcatccttaaagtcttgcatcgcttcttcaatgtcggttgctgttgactttggatcatctagcaccttttgcaatgtttccttagccgttgccgtatctggttccaatgaaaccggcgccgtgtcgctcatcgcatcttgcgctgccgtcactgcatcttcgcgggctgacgcggcatcagaaattgcttgggcaagggcttgcgttgccgcttcaatgtcgtccgttagcggtacgttaccgtcactgtccgacttttcatccgttgcattggcaatgacattttgtagattttcaatcgctgcctgaacgccttcatcattagcgttatcgcctgcttgggcattcgtgatagcagcgtccgcagctgataccgcatcgctacgagtgtccttttcagtcgccgtcgcatttgtcaaagcagttgtcgcattggtaatttggtcagcggttgcattttgattatccaaaatatcttgaagtgactttgacgcggccaagatatttgcttcattagaaactggcgtcatcgctgcaatcgctgccgcagcggctgcccgggcagcttcttggtcggcttgagcatcagaaatagccttgttcaaggcttctgtcgcctttgtcactgcatccgtcgtacccgtgtcagcattagcgctatcaacggcctcttgcaatgccttttgtgcggcaatgacatctgaatcaagcgctgccgtcgattgtgaagcgttcgaaattgctgtatcagcaccattcaaagcgttattacgtgcttcaagtgcatctgccaccgcatccttcaatgcatcacgggccgcgataatttggtcggttgtcgacgctgaatcagccaataccttatccaaattatccttagctgatgcaacagccgtctcttgactaaccgggttggttgccacagcctttgccgaagcaactgctactgcgcggtctaatgcatttgttgcatcgacaatcgcttgcgttgttccggtattattatcagctgccgcaaccgcatcatccagcgccttttgggctgcaacaactgtactatcgccagcgacgccttggtcagttgcgtttgtctcagcagtttcagcgtttgtcttagccgtttcacggtcactcttggctgctacaattgcgtcatcaagtgccttttgggctgcctgcacatcagccgtcgtctttgttggatcattagaaatcgtttccaagtttgaggctgcggatgagacggccgattcttggtcgtatggtgacgtttctgtcacaacgactgtaattgttttcgtcgtcttcaaaccagttgcatcagttgccgtcaacgttaccgtatacgttcccggttcatccttcacaacatcagcataattagatgtcagcgttgtgctaccgtccatttgattatcggttgcttgcgcattaattgccttcaagaaactgtcagccgtcgcccccgcaccggtcgtcacctgataactatccttacccgttgaaatagtaggcgcttgcgtatccgtatagttcactgtgaatacttgggcagtcgcgtcagtgtcgccatcattacttgtattatcgtaatttggtgtcgctgccaaagccgctgatagtgtgtcatatgtcttaccatctgcgccagtgacattgtaggtataacctgtcttagccaaggtactatcagttgctgtaaacgcaattttactatcagtgccacctgttactgactccacatctgacgttttagcattcacaacctgcttcaatgtcgccgtttgcttatcagccttcaaaacaatcgttgagttctgatcagttgctgtatctgcatcgaatttaccggtgattgtggcactacgcatcgttgtagcataagtcatcgaaatgcccgacgccaatgtcgtacttgcactgtccaaacgataaccgcttggtgcataaacaaataacgaacctggcaacgcatcatccgttacacctgaagtaacggttggcgcaccagaaagtggtgtgccacctgaataagtaaagttggccttttgcgacaaagctgagtaagaaacaccaaaactttgtaccgctgcatccgaagcacccgaactattagttgtgctgtcatagacaccattcgaaccagctgccagcgcttcgctcatcgtactgtactgcttaccatccggtgcagtgacgacatagctatagccagcaaccgccaagctagcatccgtaatggcaatcgacccactcgtcacaccactggcagcaacggtagttccgtttttaaccgcatttgacgcattcaacccagttcgattgaccgtagcttgttgcggtgacttttcgtacaccaaatccaatgaaggcgtcgtgcccgaaccaaccttaactgaaatatcattcgcagatttaatgtagtaaccaggcacaaccggcgcatcataactaaacgtatcgcttgatgccttaggtgaagccccgttgattccgactgactgtccgtcaccaacgtccaacttcgtactagttaacaacgtattaccagctgtgtctttatacgtcactggcaccgtcattgaggccttggttcctgatactgactgaattgacgatgtcatttcagttgtgttatctccggccgaaccaattagggcaaatgacaaatacggcatcgtcgtcgtattaatcgtcatactcttggtaactttacctcccaaactaaacgtcaatgttttagtcgaggcggtatacttcactgaccaggcggcacccgttccagcgttaataccatcaggcttattactagctggcaaacttgaaacaccacttcctgacgtcaatgaactatccactgatgcttgtgtcagattaccacttgagtccgtggtacggataccaaccatcgggtacgtgccactggcatctttgtaggtagatccatttgagtacatgtccataccaaacgaaatggcgtttttaataccttgaattccaaggccaccaccacccgttccgcttccaagcgtatcaggcaaaattgatgacagcagaataccgttataatcagccgcgttcgccgcataattaccaacataaaacgatccactggcagtaaaatcgttcttcgtatccagcgccgtattataaacaaccaaccctgtttgctgctttccattagacaagctgtaccacgaataattattgttcgaattgccagattgatagcttgcacttcccttaacaagatagtcgctggtttcttttccagttgacgtcgttgaacgactaggcactgcggtcgccttatcgattgtcgtgttcgcaaccgttgccgccgatgccggctccaacgccatatgaatagcagcctcgaacatgtcatcaactttatctgcaacaccgctggcatcgctcgccgccgcaattcccccgagcatggctaaggttgcgattcctttaaccaaccacttcttttgagtgccttcactgcctgctttaaacagtggcacctcatcatcatattttgatttcattattaacccctcgctaatactctaatttcttgtgataccgccagtataaaaaacgaatatgatgtcaccgcaataaaacagcgccaaaacagtacgaaaattctgaacagaatacggtaaatatttcatttgtgtgaacaaaaaatcggccgagacactcgttgtcccgaccgataatacctactatttttgcttacgacgtcgcatcaaaatgattagccaaacaattatcatgagcaatatcccaataatgcccaacataatctttaaccaaattggcatccgtgtcgcttctgcaactgccccactgactcgttgctttgctgtcacggtcaagctatcgttaaaatgccacttaccttgattcgtcttaacatccgttaccacacgataccgaccggctgctaacgactgatcaagctttgtcagatgtgaatactggctatctggtgcaaaccgcaaaccttcttgcattttgtcaaaaatcaactgatcaccctgatacaagcgcgtccgcacctgcatgtcatgttgaaatgcaggcatcggattcacaagcatcgtttgcagcatattttcaccagcaaccgttttaagttgtgcccccgcagagcgcatcttagccggcacatccccctcgtgattgcgaactaagaccgccaccgtatacgcatacgactgctttatttgcacgcctgattccttagaatcacttggcgacttacgctcaaaaaatgttaagccccctgcttttatcccatcaaattggtttgctggcatatgaatggtactcgtgaccaattcttgaccatgcggtggtagtgtaatgtttttgggcaccgaaaccagatttcgccaagctgttgactgcgccgtttcataatcaacgacgccgttacgattcgtcgtcgcctgcgctgatttgatatcaaccgtaagtggcttctccgtgtcgttcgtcaataaaacttgaacttcattcacttgatcaggcgccaaaactaagtcgaaatatcctgtcgtttccgaacgttgctcagttgcttgcatcactcgtacgctgaatggcatttcgtttgccgatgctgttcccccaaacaatatcgccaacatcattacaactagtccccaaaccaatttcatctcttttacgctcctgtcggtgctgcaaggagcttataaactacctcacttgaataattaccggccaattttttcacttgacccggtactgttaacttaacatccgccatcgataaagatgacgtgccatagccatcgccagctttagcactggctaagcgagcgaagtcaccgtttagcgtgattgcgctctttgatggcatcactaaagtatcttcaatagctgacttcacagacatttcacccacgtgtagcttggccccttttaattcagtgccagttgcatgcttgaacggggttgcttggcgaatttgcaattcccaaccatctaacttttcgcgttggtcagtcacctgtacgtgattagcaactggatttccagcaaacacatcgcgctcagccgaataagttcgatccatcaaactcactttttgcgtgtcaaaacgccaaggtgaggcataatcaatcgtcaacggcatccccgccttacgcatatttgccggtgcagcttggtccttggtctttgcatcagtcggatttacccgatcaatcgcaattgggtcttcaacccctgcaaagctaaccgtcgctggcacggttgtcgttggatccttctcagctgaaaagattgatccacccgtcagcattgttaatccaaccgtcaagactgccaaggtagcccggcacttaaacaccatcatctataattcccccattttatctctatggtcctgcgaccaatttaatctcaagctcagcttcatagtcgccgagcggtacaacctcgtggtctccgatttgcatctcaaaacgcgtttcatgcgtttgtgcctcttgaccactcaatatctcttgaaacgattccgttatgatttgttgattcgcaatcaattgcggtgaaatgacttgtccggttacccgattggtaaacggtcgggccagtcgtaggtgcactgcccaggatttcaaaatactcccctgtactgtcaaaatacctgttccaggtagtgcagctgttcgagttgactgaccgtatgactttgacacactgccaaatgagactggtgttatcgccatcgtcatcggccgttcaatttgtagcggtcgggccgttagcatatttaagctgtccaaccaagttgaagcagcgtatggcaaatcactcacggtttgtccgttgccacgtcctttcacgcgtaatgattggattgaaaattcttcagtatctgaattaggcgttgtgctgtgtgcgataagctgttgtagttcaaaagtgccacgatttcgtcgatacacaagtcccctctcctgcgtattgaccagctccaattcagctggtgcaacgattttaaataccgtcggctggcaaaattcaatcaaagcagtggtggtacgacctcggacgaataatcggccatcttgtttcacctgtaatccgccaccgctcacaccgttttgatctttataaacgacggcttgttgttgcaacccggtcaattgtaattggccacctgattcaaccgtcaccattgcagcgtccgtgttctgccagaataaggctggctggacgctcgcaatatccactcgcgacccaccttgcagaacgacttgatcaaagcccatgtcaattggacttacgattggaccatcgctttgctgtaatacggaaatcgaaacgtgaccacccgttgcaattgtcaactggccaccgttatccgttgcaaaaacgtgaccgccagtttgaccaaaggcttctacaaatccatctggcccaacctgaatatttggtgcggtaatcatgtcaccgtgcgatccgtgtaatactaattgaccattgataatgacttcgtcagccactaacatgcggccctgatagccagggctcatggacacattactgtcgggcaatgtctggacccgccgtgcgttaattaaaggtgcttcgtcggcacctgacaaccacaattcccccgttaatttaatctctcccaaactggtcagactaactggttgcttgttctgttcaggtgcaaatgctaattcataaccatcgccaatcaatgtgacatcttgtgtccgtggtgctaatcctgtcgcaatgtcgtcaacaatatccgcttctaaccgaattgtttgatccggttcgtctaaatgccaagcttgctcgaattcacgcatcgtttccacccgatgctcagaagcgtacaaatcatgactaaaccacatacttatgacacccagcataacgccgaaaatcagtcttccaattctcatctcactcctcccgttcaacaaataggaatcgtttacgtgcttaactttatcgaatggcaacaaacttcaccacgtcgtttttttctgtttttttcaaaaaaatctactttttctttgtaaggtactgaaaatactaaaaaggccagtgaataatcactgacctttaaatctgtcttttgtaagcaatacggcttgctcaatgaactgtgcaaacatcgtttcatccggatagcgcgtccaaatgaagcctggtgttacaccaaattgcgaaatttcaacatctgatatgtaaaaatcggtatctggacgaaattcatgtgccacaatcacgttaatcattggtgatcttttcagccggtcttgaatcaattcttcaagtgccggcaaatttgtcatatcaatcacgacgacaaccgtcggtaagatggcgtgctttgataaattgcgaatcatagcatctaaatactcttcaaataatgaattaaccagcacctgctcgtcaaaccctattttctcagcaagatgatggagcacccgcaacacaaacgccgtatgaatcggaaaatcacggtgcgcgatttctaaatcaggcgttggccggtaaccgtaaacactaaagtacgctgtacgcatgttggttgctgatagttgcgatgtcacacgattcagaatccgttccgaaagttcctggttaaatagcgcttgatactccgtcttaacaatcgttttaaaccgtgccaattttttctgagccacttcagtcaacagcgagaccggcacactcgaagcgaaccccgtagagtacagactagcgatggcaaaatcagcttcacgttccacaacagctttaggcaaagacacaaatgaacccattaactcaattagtccagcgcgggtcgcctgatgttcagcatcccacttcgccgaatccgttaatagcgccgggatttcttccggtaaaagatgatgatcattaatgagacggtaataccaaatcgtaaattgcattcgcattgcctgcttcgtcgtctcgcgcaatggaatattaaatagatttgcaattgctagtacggcttgttccgttcgttcgcgcatttcaggcggaaatggaatctcatgattaccatacgcttgacgcattaagccaaagaaaaagatgcgaatggtcgtttcgtttccaaccaggccattatgcaaggtcagttttatattggcttgtttcagcaccgcagcaattttacttttggcagctcgcgcaatcggtacactggtgtggtacgtttctgcaaattgttcataggattcgaatgtccctgtaaaaatgacaccaagcaactgccagataactgacttttgccgataatcaaacgcaactgttttgacatccaccaatacagcacgatttaccgtgactgctttttgtttttcatcatacgcatacgctgttggttcatttggaaaatatgtctctaaatcatcaagcaacatcgtaattgtcgacaatgtgcgataacgtgaccagcctaacgaagtcagaatacgtttaattggaaaaaaactatctgatcgcgtcgttaaatagttcagcaacgttaatttgtcttgttctttcttttctaacacccacgctaattcatccatccccacgcccccaatcgttgactttagtgtacggaacacacgaatttagtgcaaggggagacactttttgaagaaaagtcgactttttttgaaattaggtgttgcatgataaatatccatctggtatattattatctgttgttaagagcggtaagcaattaacaaagtttcatggcccattggtcaagcggttaagactccggtttttcacaccggcatccagtggtgtaaggctcaaacgaagtttgatttacaaattatgattcagttttgagagagctaatattttctcaattaaataccgtgtcgtgacgatggcattgaggccacacctgttcccataccgaacacagaagttaagctcaatagcgccgaaagtagttggaggatcgcttcctgcgaggataggacgtcgcgatgcaacgtaaaccgtaccagaaatggtgcggtttttttgtgcgtttgtaaagtaactatttacaaaaacgcaacgcaatcatgacacaacactgacgaaacacatacaaaggttcactatacttaaagatgtcgtaaggggtaagcgcctcacttcagtctgctactactaactgttgcttaccgcttgcgacctaactcgaataatacatgaccatagaaggagtcagtgatgaataagaagcagcttgttgtaggaagtactgttgttctcgtattagccgggggattggttgggcatgatgcaaatgccgcaaagaagaagcaagtgttggctgtggggtcaaccgctttacaaccactagcgtcacaagccgctgagatgtatggagagaagcatcctggtgtgtcggttgtcgtgcaaggtggtggatctggagctggtctgagccaagttggtaagggtggcgtaaccattggaaattctgatatttttgcaagtcagaaggatggggttgatgctaaaaagctaacagatcataaagtagcagttgttggtattgcaccagtggtaaataaggatgtgccagtaaagtctttgaccaaggaacaattgcgagacatctttacgggtaagattactaactggaaggacgttggtggtaaggatgaagatattgtcctagttaaccgtgcccaaggttctggtacacgtttcacgtttgaacatgatgttttggacggcgagagcgctaagacatcacaagaacaagatgataatggtgccgttcaaaagattgtgtcaacgacgcctggtgccatttcatacttggctttctcatacacaacaggaccaaatgctaagggtatcaagacggttgccattgataaggtaaagccaactgataaaaacgtcgcatcaaacaagtggcaaatctgggcctacgagcacatgtacacaacgaagaagactgataagaatacaaagtcttacatcaaatttgtgcaatcaaaggccatgaagtcgactattaagaagcttggatacatcccagtttctgatatgaaggttacgaagaatgctgacggtgacgtcaaaaagaattaaagattgaaagagcatgttgaacagagagtcaatatgctctttttttggacaaaaacggtaaacgcccctctttatttataagggggatgttatggaatttgacttaagtttattatatgggcgcctagttccggcagccaatacagtatcaacgccggctaatgtcgtaatgacaccagcaatcgaaaatgaaatttgtcagcggtgtgcgacaacaattaaaccgcattggcttttggtagatggggccacttattgctgggcatgcgccaacttaggacgcctttcaagccaagatgtcttactgaccatacctgagccacgagcctatgaaattgaaccagagccatgtgtgtggacgggaacgttaacaccggctcaacagcgagtggcggatgaacagatcaaagccttggagaatggggcctctcatctcacatatgcagtaactggtgcaggtaaaacagaaatgctctttccgatgttaacctacgcattgcaagcgggaaaacgcgttgcgattgtttcgccacgtgtggatgtgattgttgaactagcgccccgtattcgcgcggcgtttatcaccgattttgtaacactttatggcgattcaccggatgactatcgctacacacaattggtcctagcttcaacgcaccaattgctccgctttaaacaagcgtttgatgtcattgtgattgatgaagtagatgcttttccatacgcagaaaatccacagctgattggtgccttgcatcaagcgactgcatcacacggatcgcatttctatctaacggcgacaccgagttcgcgtttgcttcgtgaagtacggcgtagacaaatggcacttagtctgttgccacgtcgttttcatggcaatccactgccaaattttacgataaggcgggtgggtgagtggcgcaaaaagatgccccggcaactacaacaattactacaaacatatcagcaaactggacaacgatttttactgtttgtgccgtcagtcgctgatttagatacggtgctaacgatggttcatcatggcacatctgatatggccattgcagccacgcacgccactgattcagagcgacaagcaaaggtacaggcaatgcgcgacgaaagcctacaagcgctcattacaaccaccattttggagcgtggagtaacgtttccgggcatcgatgtgattatcttaggcgctgatgatgcggtgttcagtcaggcagcgctcattcaaattgctgggcgttgtgggcgtagtagtagccgaccattcggcaacgttacggcgtttgttcaagaaagaacgcaaacacttctggcagcacgcagtgagataaattatttaaatcagatggggcgaagttatgagatgtgagttttgcggaaagggcgttgcacaaacttggcaattatgggatttttggcagttcaaaccaaagagccaacagccgatttgtcaggactgttgggggaagttcacgccaatcatcgggccgacctgccaagagtgcggccgggcctcccgccaagaaacatgcgaagattgccaggtttggttaggggaaggctatccgccacttaagaatcaagcgttgtttaaatacgatgccatgatgcacgatttctttcagcaatataagtttcggggtggttatcatctgcgaactatttttcaagaagccttgcagaaaaggttggctgaagtttcagtggatatgattgtgccaatcccagttagtcccgatacgttagcgatgcgcgggttcaaccaagttaatggtctattagaaatatgtgaaatagatgatattctatgttgtatatcgcataacaagagtgtacaatcattgaaaacacgtcaggatcgtctaaatacggcacaaccatttatgtgccaattgggtaatcttgatttaactggtcagagaatttgcttagttgatgatgtttatacgacagggagaaccttgcgacatgctgcgacgtgtttatatgaatgtggtgcgaaacagatatgcacgattaccctagctagatgacggagctatgaacagtttatgaaaacgctttctctcttgtcatctgagtgttacaatatagttaccgaaaggacatctcaaggatactttgggagatgcgtgaagccatattaggggactaggcccacgcaaaataagtcagataggagacagaattatgctagaatttaaggtacgtggtgaaaacattgaggtcacagacgcgatgactgagtacatcgagaagcgtttgtcacgtttggagcgttacttgaatgatgatgctaagtatgtagcacacgttaatgttcgttcttacaaggaaggaacattcaagactgaagtaacgatccaattgccatacttgttgttgcgtgcagaagatacgcaatcagacatgtatcaaacggtcgacttcgtgtcagaaaagttggagcgccaaatccgtaagtacaagactaaggttaaccgcaagtctcgtgaaaagggatacaagggcatcgagcaattggactttgctgttgaagagcaagttgaagaagctgaggctgaagaagcagcaggtttggacattgttcgtacaaagcacgttgctttgaagccaatggatgctgaagaagccgttttgcaaatggaattgttgggccacgagttcttcatcttccaagatgctgagacgaacacaccagctgttgtctacaagcgtcgtgatggcaagtatgctttgttggatacggaagcataatttcgttagattaaggcgttacgcataaaacctataaataaaatcaaacactggtatgagatgatagggcatctcgtaccggtgtttttttatgttgttgacttactaaaaattagagtataaaatcaatattgttaaaaaataatgagaaacaatttgagcaggaaagtagttagccttgggaaatgcacagaaaactgttgaatgatgagagacagtgattaaccagctgatgaaaatggcctgtgattggtatgcgtgagtggcaagcctatgagcgcataacggggtggtcgccgttacaacgacacgcgtatcgtcaatgcatcatctcgcaccctgaccgtacgttatgaagattgcgccgggtaactggccaataaagatagaatggtaacacgacaagctcgtttctattccagaatttatctggggtaggaacgggctttttattttagaaatgaggcataagaatgacagaatcagaattgaatttcgacacacttgctttacatggtggatatacacctgacgcggaggcacatgcgacgagcgtacctatttaccaaacgacgtcatatgtatatgacagcgcggatgatgcggcctcacaatttgcgcttgagaagccaggccaactttatacgcgctttaccaatccgacgacagcggtccttgaagatcgattggcgttgttagaaggtggtgtgggcgcagtggccgtttcatcggggatggcagccattaattacgcattggaaaacttgacggtcgctggtgatcacattgtggccgctaacacgctatacggtgggacacataacctgcttgcgaccgcctatccacgtcgcggggtcacaactacgtttgtggatatcgacgattgggttgccgtcacaaatgccattcaagcgaatacgaaggcattgtacgttgaattaattggtaatcccaactcgaatattgctgacttaacggtgttggctgacattgcacacgaagcgggtattccattgattgtcgacaacacatttgcgacggcgtacttatcacgtgtttttgactttggtgcggacattgtcgtttactcggcaactaagttcttgtcaggtcacggtgcagcactgggtggtgtaattgtcgatagtggtcactttgattggacccaaaatgataagttccctggtttgaccacgccggacgaaagttaccacgggctggtttacacggaaaagtttgggaatgctgcctacattaaccgcattcgctataacttgctgcgtgattccggcgcaacgttgtcaccatttaatgcttggctcattttgttgggtcttgaaacgttatctttgcgtgtacaacgtcacgtggataatgccaagcgtgttgcgcaattcttggcacaacacccagctgtggcgtgggtgaattatgccggattgactgataatcgttactacgagcgtgcgcaacaatatctgccaaagggaccaggttcaatcttcacgtttggggttgtcgggggtgctgatgctggtaaaaaagtgttggacagtgtcaaagtattcacgcattttgcttcgtctggtgaaggtaagtcatctatcttgcacccggcatcaacctcacacgcacaactttcagaagaagagttgatcgcttcaggcacccgcccagagacgcttcgcttgtctgtcggcattgaagatattagtgatttgctggctgacttggatcaagcattgcgttttgcaaccggcgattaagccacggtgaaacctgttataatagaatcattattgattaattatcagtgccgttaaaggcaagaaggagattctattcatggctaagacgaagttcgtttcaccacaacaatacgcagcaaacttgggggctgttatccaagcaactgaggacgctggtaacaaggtggcacctttctttgagaagttggatgacgcaatcaaggctgacaaggtggctgagatgccaaaggccgaattccaagaaattgcaatggaatttgacgaagccgttgccgtttacaaggatgcttcagctaagatcaacgcaatcgctgccccagttcgtttgatgggtgttcaccaatcaatgaagaagacgtttggtgaatacgctgatgccactgaaatgatggcaaagtcattggacgttgaaaaccaaacgattaacatggacgacttcaagcaatcagagacggatcaagatacgttgatggagaagttcttggtgcaagttcgtcgcatcatgaacacggtaatgtaatgacgacggcggtagatgatgccctaaagattgatatcgttggggaagtagcaaaagaattggccttgccacttaacaaagtgaccgcaacggctgatttgttggctgatggtaacacggtgccatttatcgcgcgttaccgtaaggatgttacgggtaacttggatgaagtccaaattcgtgacatccaagcagccacgaagcgtttggaagatttacaagcgcgtaaggcgacagttgaaaaggccatcactgagcaaaaggcgatgacaccaaacttgatgaaggccttggtggcagctgatacgatgcaagcggtggaagatttgtatctcccatacaagcaaaagcgtcgtaccaaggcgactatcgccaaggaagccggcttgatgccaatggcgcagtttgtacaaaagttcccagcggaaggcttgcaagcagaagcagcgaagtatgttgatgcggataaggatttgccagatgtggctgccgttatggccggtgtccacgagattttcgccgaagttattggtgaaaacgctggcttgcgtgactgggttcgtaagtatactcgtgaccacgggcgcttggtttctaagcaaaagcgtggcgcaggtgataaggacgaacaaggcattttccaactttactacgactttagtatgccgatgaataaggtggcgaaccaccaaattttggcaattaaccgtggtgaaaatgaaggtgtgttgtcaggcagcatcgatgttgacgtggctgctatcgagcgttacttgaagttccgtttggttgggtcaaagactggcgaatcagccgacgttttgacagcagcagctaacgacgcctacaagcgtttcattggtccagctatcgaacgcgaattgcgcaaggaattgttcgatcgcgcagcgggggatgccattaaggtgtttggcacaaacttgtatcacttgctgatggcggcgcctttgcgtggccgtgtcgtgttgggttacgacccaggtgttcgtacaggttctaagctagcggttgtcgacgagaatggtaagttcttggagaaggctcacatttacccattgcgtggtatgcagtacgatcctaagggtgctaagcaaaccatcattaacttggttaaaaagtatggggtgtcattggttgccatcggaaacggaacggcttctcgtgaatcacaaagcttcgtagctgacatcattaagtcagatttgcctgacttgcaatatgtcgtggttaacgaatcaggtgcttcagtgtactcagctagcgatatggcgcgtgctgaattccccgacttgcaagtcgagcaacgttcagccatttcaattgcccgtcgtttgcaagatccaatggctgagttgattaagatcgacccacaagcggtcggcgttgggcaataccaacacgacttgccaacgaaggaacttgaaacggaattggatgcggtactggagacggcggttaaccaagttggtgttaacttgaatacggcgtcaccacaattgctaacgcacattgctggtttaactaagacgacagctgccaatatcgtcgcttatcgtgatgagaatggtcaatttacgtcacgcgcgcaattgaagaaggtaccaaagcttggacctaaggcgtttgagcaagctgcgggattcttgcgtttgccagatggaaagaacgcgttggacaacactgacattcacccagaatcatacaaaattgcggaggccttgttggctgaggcaggtgtcacagcactaggtgaagccgcgcaaaagccattggcccgtttaaacaatcaggcgatagctgatcgcttcggcatcggtctcgcaacgttgcaagatattattgcatcattgggtaacccaggccgtgatttgcgtgatgatgcgccaggtgctgtgttgcgttcggatgtgttgtcattgaaggacttgaagccggggatgcaattgcaaggaacggtacgtaacgtggtcgacttcggggcattcgttgatttgggtgtgcacgaagatggtctggttcacatttcacgcatggctaagcgtcgcgtgacgaacccacacgagattgttgccgttggtgacattattactgtttgggtggttgacgttgacgtaaagcgtgagcgaatcggtttgacgatgattgaaccaacagaaaagtaaacgagaagagtggatgatagtccactcttttttattatccaggtataatagtaagaaaagggggaaagtgccatggcatttttagacgtagtaagtaaggtcgttaagaagaccggtgatgttgtgaccgtattgggcgagcaagcacaaaagggtggcgattatttggctgatccagaaaaccaagctaagattaatgacaaggttggtgaattcaaggacgccgttgttaatgtgtttaatgacatcaccaagaaggataagtcacaacaaactgaagccgaagcggaacctggggtacgcaaggatgtaacgccagctgatgaggatattattattaagtatccagaagatgaaccagctgaagacgttaaggtagaggtcttgcaaccccgtcataacaatgatgacgagatatagtcagcttgcatataagcgctatatctgataatataatctgtgctgatactttcggtacagacatgcggtcgtggcggaattggcagacgcgcaggattaaggatcctgtggtagagataccgtgcgggttcgacccccgccgatcgcataatgatttgaaaagcctcgagatacgttgatgtatctcgaggcttttttcgtttttaatctgcaagctgataaatctgtttaagttaacataaaaaccaatgaataacctgtccatcagggcagttgtataaagttgttgcaaaaaaattgatataagtccatttttggacgtttattatatttttgtccgataacggacatttgattaaaaatagtgttttgattgaaagccatcatcttacataataaagccaatgaatataggcctttttagacctggaatggtaggcgatgatatgacgtttttcaagaataggaacagtctttggtttgttttttgggctgtaattttgacactagcagtagttttctttccggacgagtccagtctgaaatctgaccaatcagtgccggactcttatcagagtgtacaggcagacaaattggccaatcaatttagtgaaaaagataagggtgcgaaaacggtcattgccgtatacacaaatggtaatcaaccgttgaccgatgttcaaaatcaagcaattgatcaaacagtcaaaaagctacgagataatgcggccgaatataaaattactggtgtgacggatgcgggagatagttccgaggcgaagtcacaggtcgtttcgaaggataaaacgacacgactggtacagctaacagtgaagtcaaacgatattacgaaaatgaaaaaggaactgacggcggcaactgctacaaaacaagtcaggtcttacattacaggtagtgatatcttggaccaagatttcggtgatgctaccggtaagggaatcgccaaaacagaattaatcgctgttatttttatttttgttgtgctgatttttgtctttaagtcaccaatcacaccgattttgtcactagctacggttggcgtgtcagcggtcgttggcattagtatcgtgtataacatggttaaatattggggattgtcatactcggatttaacggaagcgtttattattattgtcctttttgggattggaaccgattataatattttgctatataatgagttccgatcaggtctcgtgcgtggactggacaagtttgcggcatcaaaagaggccattcgagttggtggccgcaccattttgtacgccggcgtatcggtgttgattggtatgggaacgctctattttgctgacttttacctctataagtcggcatttggtattgctatcagtgtggcggtcttgttgatggtgctgttaacgttaaacccattctttatgacgacatttggttcgtttatgttctggccaaccaagtcgtttaacgttgagggtgaaagtcgcttctggcaattccttaccaaaacagctttggcacgtcctgtaatcgcactcgggacacttctaattatcttggtgccgattgcattacaaagtcacggtgatttaaattacgatagtgcggttgaggtgagtgacaagacgccatcgaagcaaggatataatttgattcagtctcatttctcgaaggggatggctgcctcgacgacgatttacttaaagtcaaatacaacattagataatcaagatgaccttcgggtaattgatcaagttacgcaaaatcttaagtcaattaagagcgtagaaaaagtgatgtccgtaacccaaccagttggtgaaaaaatcaaagcgctatacgttaagcaacaattatcagacgtgacttctggacttgggtcggccacaaatggcttatcacaaattaagtctggtttgcattcagcgaagacggaaattgatggttctgacatgagtggtactgtgaaatcagccacagagttgtcagatgggtcaaaggaagttgctgctggtgcagcatcgttgcaatcaggtattggccagattacaacgggcattaatcaattgcagagtcagttgacagcagggacggccgatggcgaacagattacacagttagccgcggctctgcctgaattaaaccaggcgattaaccaattaaatgaacaagttaatctgaccaataatcaacaggacgcagatgtgactgatcacctaacgaagattggttcagcggcaaacgagattggcaatcaactcggtagcgttaacgaggcgttgcaaaacgtgagtgaagacagcggctttgacgcgcagtcactgcttgatgaaatgaagcaagcaggcattgaaatgacggccgaacaacaggctgctgttaagcaatcgattgatgacaaactggcaaagcagcaagctgaaatggctgctgtgcagaaacaagtgacagcatctttgacggctattggtgaacaggcacagcaaattggcgctacggatcaagcattggcaagtcagctaacatcattaaatgaaacaactagccaactacaaacagcggttgcccaattgacgcaagcctcaaatcagctgttaccaacgtcggcaagtgtgattcaacaattatcagagggaatggatcaacttaagtcagggacaacacaattgaccacggcgttgaatgaagttgattcgcaaactggacaattgacagccggcgcacaacaagttgctaacggcaactcgcaatttgcggctgggtttaccggccttgctggtcaaatgaagacattgtcagagggattggctagcgctgatggtggcctaggtgaagttagtgccggcacgaatgacgtgaacaagtacgtgaaggagctcaagcagtcatcatcatcagagatgttttacgtaccaaatgatatgattcatggtgaggactttaagtcgtcattagacacatacctatcggataatcgtaagatgacgtcaattacagtgtacttgaagggtgatccaagtacggtacatgcgacaaagcaaattgataatatcaaagctgtattaacggccactttggctggtacggatttgaaagatgctaccttcgcaattggtggtacgacatcgtcaaccaaagatttgaatgatttagcaacgaaagactttgttaaaacagcggccatcatgctgatgggaatcttaattgcgttgttgttcgtcacacgttcattctggcagtcaattgctatcgaagggacgttagtgttggcgtactatgccgcattgaacattgtgcactgggtgacgtcgtctttgctaggccaagatagtttgacttggaatacacctttcttctcatttatcatgttaatagcattgggtgttgattacaccattttcttgatgttgaagtaccgcgacgaattagcagctcataaggatgcccgcgtaggggtaaaggctagcctaatcaagtcggttgcgatgattgggacggttgttatatctgccgcagttattttgggcggaacctttgccgcgttgattccgtcaggtgttctaacgctaattcaagttgcccttgttgtgattgttggcctggtattgctagttatcttaattcctttggtgttgccagcggttattagtttgacgcagggtaacacagcggaataagtgtttttaaaagttggaatggggggatagttatggaaattaagccattgcagcgaaaagactttgggaagattcaacgatttgcgatcacggggatgcatttgtcacggtacacatcaaatcgtttcgagttatatttttacgccaaatatttttggtatttagagttgttacgtgcaacgcgaatctacgcagcttatgaaggggatgagtttgccggcgtgcttttgttagatattgatggggaacagaaagcatatcgtagttggtgggctcaaaaattcgttgcgttgatggagtggattatgcaacgtggttatgcggatacgtcagatcagtacggtagtgccaatgatgaaatgttagcaaattacaaacaaacccaacatgttgatggcgagttgaatttctttttggtcaatacagagattgttggccgaggaatcggaacacaattgctaattgcggcagaaaaagatttggagaacaaacacatctatttattcacggatgatggttcaacttaccaattctatgacaagcgtggctttgaacgggtaggagaaaaacaaatttcgctacccgttaacggcgaagatgttgcattaacggcgatgttgtacgcaaaacaatactgataaaaacaaggctgggacaaacgtatctgtcccagccttgttttagtattcttcaaagattgtcgtcaagattgaaatgatgacttgcttatctgtttgggcaccatcctgcaaccattgattaaccaccccaattgtcccggttacggagtaggtcacaccgtagtaatcagtcgggttattacgatcaaggtgttctagtaacaatattttttcaatgaagataggtatcattcgaccgaataaatcagtgttttgtgattgcgttaaaacaacaaatgcgtgtttgtgatcatctatgtaactaactaagttgcttactaacagagaaaaactgtcttcggacaaatcgggataatccgcagttatttgatttaccaagccggctagtaactcattgacggtttggtcgtataaatcgaatacgtcatcgaaatggacgtaaaaggtgcttctagagacattcgcaatgtccacgattgacttaatcgtaattttgtttagcggcgttgttggtaataatgaaagtagagcgtctgacaaggcgtcccgtgtttttttaatgcgacgatcgatggtcatagataaacctcctttcataaaatagacacatgtccactattagaagattgtatcatgcgtggacggaacgggccttaacataacaataattgagaaagatttttccgacagggtagtagatatcaggcgacgacagcagttagatgtagccaaaggattcgtggtttcgtgggccgaattaataaatttaaactggtcttatctaaccgaatgacagaaacgaacaatttcgagatgtctgtaagcatattgctattactttgttttgtcattaatgagaagtgaaagtttttgcgtttttttcaaaaagttagataattgtgccaccaagtcagaaggtacctacatttgcgggtcaaaatggaccgtaaatgggacgttccttttcatttgacaccttgctttttcgtgctacaccatatagacttatattttgtaagtgaaatgtggtacaaatcagttaggagattttaatcatgacaaagtacggtgtaattgtaggatcaactcgtaagaactcatactcacttggtgtagcagaggcccttgttgctggtttgccagccgatgcagaagtttcatacttcgacatcgcaacgttgcctttgtacaaccaagaccttgatgctaactctcctaaggaatatgaagacttccgtgcgtgggtttctgcacaagatgcctttatcatggtaacgcctgaacacaaccgttcagtgccagctgcattgaagaacgctttggacattgcttcacgtccatggggacaaaacgtctgggctggaaagccagttttgcctgcctcacaatcaatcgccggtcttggtggtgttgtagcgcaccacgtgttgcgtaactctttggacttcttggacatggctatcatgcaccaaccagagctttacattggtaacacggccgaattggcaaacgaaggtggaaagatcactaacgaaggaacgaagtcattccttgctggtgtagctgaccaatacaacacgtttgttttgaagcacttgggataataactattatgaaaatgacgactagtttaacgactagtcgtcatttttgtatatgtaagggttatcatttaacatttgactgaaataagcgtacgcttaacgtatccaccggctacgaaaggaagtgcacttatggacgcaatggagaagtcacaacggatcgaaaattggttgaaagaaaacgggtctgtgcaagtcgcagtttcagagtacatggcggcgaatccgccaatgtcagttagtcgctttttggcgacgaatgactgttctaacaagcctgaaacaggcttggaaggtattttgttgccaaacggcttgtattacgatttgcgtggttctcacagtatgatgatgaatgtgctagctgcacagacgcttgatacgacgattgagaactacatgaagtcagtacccaaggtttgttataccgcaatgacggcttatgcaatgaaaattacaggtgccgtcatgttacacaataatgtacaacaatatgctgatgaactaacgcaggcgcaaaaggatgcgctattgcagttggaatcagcgaataaattagtagttaatctccagccagtccggatgccggcgcgtatcaaggtgcactatccaaagctggttgaacggcaacaggcagtgcttgcggctaactagagaaagagaaacgttctggcagatgccggaacgttttttaatagaattttgcttatttaaagtttggcggtagaatgaattgtgaagttgtacacacggaggagagcgatgacaaaacacgatcatcatcatgatatgagcatgcatgagcatagcgaacatcagatgaatatgagcgaaaaacatatggacatggatatgccaatggcgcatcatgacatggaccacatggaccacatggaccacatggaccacatggaccacatgaatcatgatgacatgatgatgcacggtggccatatgatgtatatggggaatatgaatcgaaagctgattgtatccttaatcttgacggtgccaattatcctactgtcaccaatgatggggatgaagatgccgtttacgattaccggcattccgggtcaaaactggctggtactgttgctggggtcaattctatttttctacggtggtacgccattctttaacggtgcccgtggcgaattgcagagtcgcaagccggcaatgatgacgttgattacaatgggcattgtggcggcttacgtttacagtttgtacgccacgattatgaacgccttgcatcctgaagccatggtgatggatttcttctgggagttggcaacgttgatcgacattatgttgattggtcacatcatcgagatgaacgcggtgatgaaggctggttctgccgttgatggtctggcagcgttggtgcccaagatggcgcaccgtcgtcatcatggtgaccacttcatggatgtcgcgatttcagatttggcattaggcgatgtattgctagtcaaagaaaatgaacgtgtgccagttgatgggcgtgtcttaacggggatgccaacgttggatgaatcactactaacaggtgaatcaaccggcgtcatgaagcacgaaggcgaccacgttgttggtggctcgctaaatggtggggcctcattcacgatgacagtggcgcatcgttctgatgatgggttcttggcccaagtccagcacttggttgccaatgcccaacaaaatcaatcacacgcggagacgctggctgaccgagtagctggctggttgttctacgctgcgatgattgttggtattttggcctttgtgatttggacagccgtccatggctttgcctacgctttgccaatcgcggtgacggtgtttatcattgcctgtccacacgcacttggcctggccatcccattggttgttgcgcgtttgacaggcttggctgcccaaaatggtttgctaatccaaaaccgcgctgccttggagcgcgtgaacgatttgcgttacgtgttgatggataagacaggaacgctgacggaaggtgactttaaggtgcaaaccgttaacgctttggctgacggttggacgtcagatgatgtgttgcgttatgctgcagcccttgaacaaggtagctcacacccgttggcaactggtattttgaaggcagcccatgaattggatgtgccaatggtgatgcatcaaacggcgacagctggtgaaggtgtttctggtatgattggcgatgcgcattatcgtttggtgtcaccaacaacgctgcctgaaactctcgatcagcaagttcgagacctaatcgtgaaggcgacggcaacaggcgagacggtcagtgtcttgttgaagcatgatgaaccacttggtattatcggcttgtcagatgcgattaagtcagatgcaaaagcattcatcgccaacttacaggcgcaacatatcacaccggtaatgttgactggtgataatgaaaaagcagcccaacgcgtggctgcaaacttaggcattcacgaagtccgtgctgacctgaagccggctgacaagattgcgttggtcaagacgtaccaagccaatggtgcggtgatgatgattggtgatggtgttaatgactcacctgcattggcgcaagctgacttaggtgtggcaatcggtgccgggactgatgtcgcgattaatgcatcggatgtggtgctggtggattcaaagctcgctgatgtaacgacgttgcttgaactagcgcgtcaagcaaaacgcaagatgacccaaaacctttggtggggagcggggtacaacctaattgcaattccattggcggcaggtattctcattccggtcggctttaagctggatccaatggttggtgccattctgatgtcactctcaactattattgtggcgattaatgccatgacgctaaaactaaagaagtaaacaaaaacggcgaagcatatctgctccgccgttttttgatgaagttgtttttaacccccacacggctctctctaaaaagccatggtgctgtgtcaactaatctctattgagaaagggaaagagagatgatagaaattagtgacgggttagcacgtgatttattatgccagttaataggggactgcggtagaaaagtgcctgaggtgggaagatttttgatttttcaatcattttagtgggtttacgcaacaaaaaacacgcgccaggggggacgcgtgttttttaagaagatttggctagctggcaaaagaatctaagggggaggggggaaccagctagtcggggatcttcaaattatgctagggataagtcagggcgcatatctgcgcttctgaatgattatagtatgctgcaaatttgagaacgaaactaaaaagtgccaaatatgagtcaaattaacgtgattttttattttgggacctaaaacccgctatgtagcttacaaaatgttagaataataagtcgaataaaacgaaagcaggtgaacaagatggaagcaaagccaaagtacgtcggattgattacggcggccatcctgctctcaacgtttatgtcagctattgagggaaccgttatctcaacagctatgccaacaatcattggatcgttgcacggcatcaagttgatgagctgggtattcagtatttatatgttgatgactgctgtagcaacaccaatctatggtaagttgtcagatttgattggtcgtaagccggcaatgctatcagggctcattattttcttgattgggtcaatgatgagtggtgtgtcggatagcatgggaactttgattttctggcgtgctattcaaggaattggtgccggtggtatcatgccggttgcctttaccatcttggctgacctttacccaattgaaaagcgtgcctcaatcatgggcttgaactcgacagcatggggtgtcgcctcaatggtcggaccgctagttggtggctatttggttcaaaacttatcatggcactgggtattctttattaatttgccaattggcattatcacaattgctattttaattttcttctataaagatacctttgaaaagcgccaagcaattattgactacccaggtgtcctttggatgtcagtctttatcgttggcttgttgcttggtttgcaaatgatttcagaagcgaactggttgttgatggtgattttctttgtcgcttcagtacttggtttggtcttgtttatcaagcgcgagcgtaaggcaccggaaccattgattgatttgaagatgtttaagtccgttgatttcacggctgccaacacaattgctggtttgacggctggattcatcattgcttacaacatttacttgccaacgtggatgcaagcacttggtggtatgaagccatcagtagccggattcgttgtgacgccaagttcagttgtttggatgtttggtgccgtgattgctggccgtgtcttggctaagcacagtgcgcaatatctctttaagtttagtttgtttgttggtatgctttacgccattatgctggcggtgatgccaggggatgcgccattcgtgttgttccttgccactggattaattttcggtttgacgatgggatcaacgattacggcatcaacggtgatggcccagcaaacagtcgaaccaagtcaaattgggatggccacgtcatttaataacttggcccgtgccatggttcaaacaatgatgacaaccgtatatggtgttgtccttaatgtgtcaatgtcgattgctttgcagtcacaccacaacttgcacttcgctgagttgaatcaattgattgatccaaacacagcaaagaacttgccagctagtcacattgcaccgttgcgtgacatcatgacgtttggtttgcacaacatctactgggttggtgccttgttgatgttgggggctgtcttgacgaatgtctgggcaacgcgccagttgaaaaagtaaaattaaattgcttcaacaaaagtgttgacatttaataggcaaatgcgtattatattacatgtggttgcgataagtaacttacatgttttggaggattacccaagtctggctgaagggaacggtcttgaaaaccgtcaggtcgtgaaagcggcgcgtgggttcgaatcccacatcctcctttgatgttaagtcatcattattatttattatcgcgggatggagcagtctggtagctcgtcgggcccataacccgaaggtcgtaggttcaaatcctgctcccgcaatttatggagaattacccaagtctggctgaagggaacggtcttgaaaaccgtcaggtcgtgaaagcggcgcgtgggttcgaatcccacattctccttactgataaccgtgtccattgggcgcggttatttttttatcaaaaatcttgaggagtatgaattatgttaacattacagcttcgttatctcagatatgcaattgttggggtggttttgacggttttgacggcgctgataatgccagtgttactgggcatgagtccgtttttggacttgtcagtgccacatcgcatgatggcagcctttgcgattgcgactgtgtttgtgattgtggttgatgtacgcatggggatgcaagcatggcgccaacgccaagaagagggattgacgactttgtgggtgccaatcatcggtcaaacgctttggttggagacgaccgcttggatttacaaacagccagttgctggtgacttcttgcagacaatgacgttgccagttatgttggccggcttaacgattttgctattaacatttggtttgttgcaacgtcgtgaacgagccattccgctagatgatgtgatgaagcaagcaacgcgtcgtttgacatggttggttgtcgtattagccatctacgcattgattttcttcggactaacgttgaactggcaatcaggtttgactgtcgcaacgtctgtcttgctagtcgttgatccacgttggccagctttctgggctggttggcgtcgcttccgcattttgcgtgcactggctatggaaggtgtcacatttcaaaatccgcacgcacttgatgaagttcgggatgtggaccatgccattgttgaaaagtcaggcttgttgactagcgatgacgtgacggtgacttcggtcatgtctttggatgatcgttacagtgattttgatattcttggtattgtgactggcttggttgaaccagttaacgatgtgctttctaagaatattctgacattcgctgaagaacgcggtgtttatccatcaagcgcaagtgaagtggaacttattccaaatgccggtatccaaggggttatcttaaatgaacactttgccgtggtttcggccgcgtttgttttggccaatgattacacggtagatgaagatgttttggcaacatacaaagaactaggtaattcggttagttatgtggttgatagcattcaagttgttggtgttatgacctttggaacgtcattgagcaaagcggtattgcctatcgaccgtttcttccgtgaacgtggtatcacgacctacattgcaactgccgacacatctggatcagtgcgccaattgactaagctaatgggcacgctatcagaaccaacgactgacttgacgcctgaggaaaaggcagccaagcaagctgagttggttaacgacggtgagtcaatgttgattacgaaccaagttgtaccggagggcgtaacgccaatgctaacggtagcagtgggcaaggacgatatgattgctgacgtccatgttcgaacgatgactgacttgccaaagttgtgggatacgaccgatgctttgctaggagccgacacaaaggttttgctttggacaagtgtcgttgtgctactaattgtcttgattgcagccggtcttggcatcttcgtcacaccatggttgttcatggcgccaatcgttgccactatcattcgtttggtattgtcattaactttgcgtgccgtggttgcacccgaaaattaacaaatgattacaacgtgaaacatatggcccgtcatgtccccgaaaggttgatatgacgggctttttgtaacctacagcaattccggtataaattgacttatgttgtggaaaagcctaaaatgaaacatgtgttaataaagcgcaaaaaaacactattgatttgacatgaaagtcaactctatagacaggagatacaagatgaacattgcaatgatcatcctgctgtcgcttgtcgcaatcgtaattggcgttgcgattggttatcaagttgcgaagactcgcattaatcactcgctaaccattgcacgccaaaccgcatcagatattacgagtcaagccgctaacgatgctgagcagatgaaaaagactgccatcgtcgaagcgcgagatgaaagccaacgttaccaagaacgcattgaacgtgaactacaagaccgccgtgcggaagtgaagtcacaagaagagcgtctggtaagtcgtgaatctgtattggaccgaaaggatgcttcattgcaaaagcgtgaagaagtcatttcggaaaaggaaacgaaacttgatcaccaacgacaaagtgtcaacgataagcaaaagcgtgctgaagaattgattacagaacgcgaagcaaagttggttgagattgcaaacttgagtcgcgatgacgctcgtgagcaaatcttgtcagagacgaaggatgccttggtttctgaacgtgccgttatgattaaggaaagcgaagagcaagctgcggccgaagctgaaaagcgggctaagaacttggtggttagcgccatccaacgttctgctgcagacatggttgccgaaacaacggtatcagttgtgacgttacctaacgatgacatgaagggacgaattatcggtcgtgaaggtcgaaacattcgtgccatcgagacagttactggtattgatttgattatcgatgatacgccagaagcagtcgtattgagtggatttgatccggttcgtcgtgaaattgcgaagaatgctttggagaagttgattgccgacggtcgtattcacccagctcgcattgaagagatggttgaaaaggcccgtaaggaaatggatgagcacatccgtgaagttggtgaacaaacaatctttgatttgggcattcacaacatgcaccctgacttgattaagacaatcggtcgcatgaactaccgtacgagttatggacaaaacgtgctcgtacactcaattgaagtcgctaaactaacaggcatgttggctgctgagttaggtgaagacgttacgcttgccaagcgcgcaggattattacacgatattggtaaggcaattgatcatgaagttgacggttctcacgtagagcttggtgcagaattggccaagaaatacaaggaacgtccagttgtgattaatgccattgcctcacaccacggtgacgtggaagctgagtctgttattgctgtcttggttgcagccgctgattcaatttcagctgctcgacctggcgcacgttcagagtcacttgaaaactacgttcaacgactacaacaacttgaagccattgcaaatgacttcagtggtgttgaaaagtcattcgcgatccaagcgggtcgtgaggttcgtgttatcgttgagccagctgctgtttctgatttggaagcaacggttttggcccgtgatattaagaaccaaattgaacacgatttggattacccaggccacatcaaggtcacggttatccgcgaatcacgttcagtggaatatgcgaaataataacaaaaacagcgaactgcattagcggttcgctgtttttgtgtattttgccacaattctataaaatgctatactttgatataacacaatctgaaatggagagttcttcaatggcaaatgaagagaaattaaatatcaatgacattgcagaacgcgctggtgtcagtattgcgactgtgtctagatatttgcatggtcggttagaaaaaatgtctgacaaaacagcgaatcggattaagcaaattattgaagaaacaggctatgtgcctaacgcgtcagccgttcaattgatgacgcaacgcagtggtttgattgcggtcgtggctgcggatgttgacgactatttttcaacggaattctttaagggtgcatcttcaatccttgaagcagaacaatatacaggcgtgctatttgatacaaattcgtcagtggcccgggaagcatctttgctcgatcgcgtgagccagcaaaattttgacggtgtgattattcagccgatttcagatgatgatagtttgctcgaaaagcacatcaagaaggggttgccagttgtgctcgttgaccgtgagacaatgggtggtaactacgacatggtggtgacggataatgaacaagcagctaagcgtgcagcccagcactatcatgatgctggctttacgcgtttgattgttgtgactgaaccaattgctagcgtttcaacccgtacggcacgttggcgtggggtacaagcggtgtatccaaacgcgacgatggttgaagtaccgcgcgcaggtattgtgggtgaagaagtcctaaatgaaatgatgcagcaattgcgtggggaagaaccaaccgtgattttcttcttcaaggaacggttgatgctcgaaatcttgccacacatgattcgtgagaatgtgttaaatgaacaacgacaagtaaccggtttttcagacacgaaactagcgcgtgatttgaatccgaacgttaagttaatccagcaaaacccctttctgatgggggctacagcagctgaattgctactacgtcgactcgataaaaagacggtaatgcaacacactgaaaaagtggtgattgcggcgacgtatgaataagtggtttacaacacctgtaatgggtgttattcttttcacataaggttaagcgcttacctaacttttacccacgggtgagattagggagcgacttgaaccagtgggcatcacgcccatatatttttagacattggttaagcgcttaacctaaaaagagacacatgatattgatggatgagctgatcaattaaacgatttgacgaaatggtgcgattgttcacaggggaatgacatggcaaaactatttttgaacacatggatttttgaggatgcggttaagcaaggacgcgcacaagctgatcttgttgcgcaagccgaacgcttaggtgcggacggtattgaagttcgtcgcgaatacttcaaggatttggctactgagctaaaggctgtacgtgatgcagcggaagctagcaagttggccttggcattgagtattccggatgagctgtttgtaaatggggcggtaaacgaaaagctaccgcaatatattgcggagcttcaagcactaggagcacaaaaggccaagtttaatctaggtgattacgcacatttcgatggggatttggttgcagcgttccaagcatggcctgctgatattcaaatcaatattgaaaatgatcaaactgaactaagcggtcacctagagccaattcacgaattcttgcgtgatgctaaggaagccggcgtaaacattggttatgtttatgaccttggtaactgggcattcacgaagggtgatgcggttaagagtgctgaaacgttggcaccttatacagattatgttcactttaagaacgcagccgagaccgataacgggcttactgtgacggacgatttggctgaaggactattcgattgggaaaagatttatcaagcatttgatgctgacgttgatgtcgcacttgaattcccaatgatgacggatgagcaaatcgctgcacaagtcacgatgctccgtcgtgccatggaggtacgttaatcatggttaatacgattattgcaattctattgttgttgacgttcgtcggtttcatcttctacatctttaagggtggaaacttgatggttggtttcttcgtgatggctatcttgtgggccgtgattggcttggtaccatttgatgtggcaattaagaaggtctttgctgaaccagccttgaattacggaccaacgattatctacattgcgtttggatcttggttcggtcgcgtcttggttgattcaggtatcgcaccagctatttcacaacgtaccgcgaaggctggtaagaagaacgtaatgttggcagccattttggttgttttggttacggcattgattttcatcagtgcttacggtgttgggtcagttatcgctatcggagttatcttgttgccaattatgttgtcacttggtattcctcgtaagattgcgttgccagctttcttgatgtcagttggtgcgccaatgtacttgaacttggtgcttttcaaccaaatcaaggcgttcttcccaaaggctgaatatggtggtaagtacttggtcttcggtattgcagcgatggcggtacaattgttggccgttatcatttacctattcttgcaccgcaagtcatttgacccagctaaggctaacgaaaacttggaattggtcggcgctgaggaatcaactgaagaagttaagattccatggattgcctttattgtgccggttgtaccagtgtttatgaacctggcctttaagtgggatgcggtaccatcattgattttggcaacgttgcttgccatgttgttgacgggaaagatgcgtcactggaagtcatttattgatttcttgaatgacacgattcaaacagcgatttctgatattgccgggttgatcatgttcttgatggcattgattatgttctcaggtgcagcccaaattaacgctgctcgtttccaaacgttgttgacgtcaattctaccttcaaatatttgggtattggccttggccttgggaattgctgcaccattggccttgttccgtggacctttgcacgtttggggtgctggtgctgcgacagctgccgttttggcaggtgcccacattttcccagattcattgttgttgcctttgatgtacgtgccaagtttgatggctgtgtcaactgacttgacgcaatcatggaacgtttgggctttgaagtacatgaaggtcgacagtcgtgaattattgaagcaaggtgtgccggtaatgtggattgtttcaatcattaacgttattttggccgttttgatcattaagtaagagaatgagggattataatcatgagtgaatttctaactattggtgagccagtggtaacgtttatgtctaaggacgcggacgctagcttggttgacacgattaactactttaagttgttgggtggggcagaactgaacgttgccattggggtgcaacgtttgggtcacacaacggaatacgttagccgtttgggtgccgatccactaggtggttacgctaagaagcaaattttggaacacggtgttgggacgaccttcgtcacagaagatgctgacaactggactggtttccaattgaagcaaatggtaacgactggtgatccacaaacgtttaactaccgtacgggttcagcagctgctcacttgtcagctgatgtgttggatgacgttaagttggacgatgtgaagatcgcccacatgtcaggtatcttcccagctttgtcagaaacttcaaaccaagcgttccgtcacttgatggaccgtttggtagcagctgacaagttgattacgtttgatcctaacttgcgcccagcactatggaatgatgacgaacgcatgattcgggagattaacgagtttgctaagtcagccgacattattttgccaggtatgaatgaaggtaagattttgatgggtagcgaagaccctaaggatattgcggacttctatttgaaccaaagcgaccgtacgaaggttgttatcgtgaaggttggacctgctggtgcatacgttcaaacgcgtgatgcagaaggcttcatggtaccaggcttcaaggttaacaacgtggttgatacggttggtgccggtgatgggttcgcactcggtgtgattacggctttgttggaagacaagtcattgcgctcagcagcaatgcgcggtaacgcagtgggtgctttgcaagtgcaaacgccaggtgataatgatggttatccaacgcccgcacaacttaaggcgttttatgaagcagaaggagtgagtgaagactaatgaagttacaagtcgcaattgatcgtgtgtcattggcacacgctatcacgttggcaaaggaccttgatgggattgctgatgtgattgagttgggtacgtctttggtaaaggactacggtttgattgctttgtcagatatcaaggcagaaattaagcaatcagaattgttgatggacttgaaggccattgatgaaggtgtttacgagtttaacaagggcttcgaagccaatgccgatattttgacggtaatgggttcagctgacttgtctactatcagtgctgtttatgacgtcactgaaaaagctggcaagacgatgttgatcgacttgttgaacatgacggacgaagagattgcgccattgatgacgttcgaacacgctatctttggcttgcaccactcacacgataacgcatcaaactttgatgctgctggttcagttaagcacttccacgagcaattcccagctgctaagcgcattgcggttgctggtggtattgacttggatcaagtgaagaagttgtcagctgacggtattgcagaaattgcaattgttggtggtaagattgccggtgcagctgatccagttgcagccggtcgtgaatttaaggaggctctataatgtctttggtaaatgaagtattgtcagaaattcaagaagtgatgacgcaagttgacgaaagccaattggttgcggctgaaaagatcgtcacgaaggacaagcgtatctttgttttgggtgccggccgttcaggcttgatggcaaagggattcgcgatgcgtttgatgcacatcggttacacggtgttcgtcattggtgaaacgattacgccatcaatcgctgaaggggatgtcttggttgccgtttctggttcaggaacgacgggttcagttgttggacctgcccaaaaggcagccgacaacggcgttcacgttatcggtgtaacgtctaacccaacgtcaccattggctacgttgggtgaagccgcaatcatcgtccctggtgcaaccaaggctggggatggtgtgaagtcaatccaattgttgagcacgttgtttgatcaaagtgttcacgtaacattggatatcttgacgttgatgattagccgccgcgaccacgtctcaaacgacacggccaaggcaacgcactctaacatggaatagtacaccattaaattagactttcaaatcaaatctcactgaaataatcatcttaaccagcaaatctcgtttttacgagatttgctggttttttgtcgtaaaagaaaaaagaaaatacaatgaaagggtttacatttcttttgaaaccgcttacaataataaatgtgttaaagacacgggggaacgtaacatttggtagacattaattaaaagcgtagaagggatggggccctagttggtatcacgccgtcatatctcactcttgctgcttgaaaacatcgttcaatatctaaaactagctgaaaactcttctccttcagaaaacactagaacgatataatttctctccagaaaattcgagcagcaagagggtgatgcgacgactctttatcaacatcaacgctttcacaatcaaaaatattttgtgggtcgtcaaccataacctaaagccatattgcggatacgcagtatggcttttatttatgtcgttaattagtttgtggttagtgtcgacgcggtgcgtcaggacggacaccaaccattaccggccttttcatgacagttacataacacaattctgcaagttcactgaaagcacagaaataagtcctagtcaatagtaagcggtttcatattttggtcataattagcccaaaaattgactaaatgtaaacgctaacattaattaagtaataaagatgtttaaggatatatttgaggtgaaagctaatggctcaagattttaagaagcttgctagcagcgtggttgatgctgtcggcggcgtaggaaacgttactaatctaacgcactgcatgacgcgtttgcgctttattttgaaggatgaagcaaaggctagtgatgaaactgtaaagaacatcccaggtgttatgggattggttaagcaaggtggtcaataccaaatcattattggtaacaacgtggctgctgcttacaaggaaattttggcgcttggtgttgatggtggggctacggtcgatgccagcgagcaaccaaagcaaaagtggacgttgaagcgtgtcggtatgacgattttggatgccattatcggaacgatgacgcctttgattcctgccatcatcggtggatcaatggttaagttgttggcaatgttgttgctaatgacgggtgttgtgggtgaaacaaactcaacgtacgttttgttgaacacaattggtgatgcggcattcttcttcttgccaatcttggttgctgtttcagcatcaaagaagtttggtacgaacacgtacttggcggttgccatcgctggtttgatggtgcacccagtgttcatggacttgatggcgaaggctgctgaagggcaagccgtaacgttggcaatgttgccaatcacgtcagttaagtacacgtacacaattattccagccatcgttatgtcatggttgctacgttacatcgaagctggtgttgatcgcatcacgccacttgtaacgaagaacttcttgaagccaatgttgatcttgttggttggtgcggttatcgcaatctcaatcgtcggacctgctggtgtttggctaggtaacggtatctcagcagttgtttacggtattcacggtaagctaggttggttggctgttgcgattgttggtgctatctggcctttgttggttatgacgggaatgcaccgtgtgttcacgccaacgattgtgacgacgattgccgagactggttcagaagccatggttatgccttctgaaatcggtgccaacatgtcacttggtggtgtctcattggccgttgcctttaagacgaagaatcgcgaattgcgtcaaactgccttggcagctgcttcatcagctttgattgctggtatcactgagccagccttgtacggtgtggcaattcgtttgaagcgaccaatgattgcttcagttattactggatttatcgcaggtgccgtggctggtttggccggcttggcatcacactcaatggcagcgcctggtttgttcacgtcagttcaatttattgataaggacaacccaacaagcattttgtggattgcagcagttatggcaatctcagttgttgtttcattcgcattgacgttgattcttggcttcgaagacattcctgttgaagaagatgaagctgatatggttacgccagctagcgttaagttgatggctcctatgaagggtgccgttatgggcttgcacgatgttgctgatgaagtcttctcaaagggcttgctaggtaaggggatggcaatcgagccagttgacggtaaggttgtttcaccaattgctggaacggttacgacggtcttcccaacgaagcacgctatcggtttgactgatgatcacggtatggaagttttgattcacgttggtttggacacggtttcactaaacggtgagccattcgaagcattggttgaagctggtgaccgcgttgaagttggaactgaattgttgcaagctgacttggacgccatcaaggctgccggcttgcctacgacgacggttgttgttattacgaacacagacgaatttaaggacgttacgccagtagagcctggtaacgtttcatttaaggatcatgtcatggaagtcttccaccacgagaaggaagacgatgcacaaacggctgttgcagctgacgcatcattggcataaacgagagattaagagaattaaggggaactggttaaatgactaagaatgtatttccagaaaactttttgtggggtggcgcaattgcggccaaccaaactgaaggtgcttggcacgaaggtggccgtggcacaagtaacattgacatgttgccaatcggcgaaaagcgcatgccagtgaagttgggacaagtggcacatcctgaattggatgacacgctttactacccaagccacacgggtatcgatttttaccaccgctacaaggacgacattgcgatgttggccgaaatggggttgaaggtcttccgtacatcaatctcatggagccgtttgtacccaaatggtgatgaaacgacacctaatgctgaaggaattgcatactaccgttcattgttcgaaacttgccgtgaacacgggatggaagtcttggtaacattggcgcacttcgacgtgccaatgggcttggtagaaggctacggttcatggcgcagccgcgacatgattacgttcttcacgcgttatgccaagacatgtttcgaagagttcggtgacttggttaagtactggatcacgtttaacgaaatcaacatcatcttgcacagcccattctctggggctgggttggccttccaagagggtgaaaaccaaaagcaagtgacgtaccaagctgcccaccacgtgttggttgccagtgcgttgacggttaagatgattcacgaaatgttgccagaagcacaagttggctgcatgattgccggcggaagcttctacccatacacaagtaagccagaagatgtttggcaatcaatgcttgatgatcacgacaacacgttcttcattgacgtgcaagcgcgtggttactacccttcatacatgaagagtttgttgaagtctaagggtgttgacgccatcgaaatggccgagggtgacgaagaaatcttgaagaacacggttgatttcgtgtcattcagttactacgcatcacgtacatcagcacacaacttggatgagttggtagcgaacgaaggaaacgttgttaagtcagccaagaacccatacttgccaacaagcaagtggggttgggtaatcgacccacttggattgcgtattacgatgaaccaattgtacgaccgctaccaaaagccattgttcttggttgaaaacggtttgggtgcggaagacgtggttgaagctgacggttcaatcaacgatgattaccgcatcgactacttccgtgatcacatcaaggccatggccgacggaattgaagatggtgtgccactaatgggcttcatcgcatggggtgttatcgacttagttgctgcttcaacaggtcaaatgacgaagcgttacggtatgatttacgttgataagaacaacgacggatcaggaacgtttaaccgctcaaagaagaagtcattcgactggtacaagcaagttatcgcatctaacggtataaatctttaatatattgaacgcagtgtctcgcatatggggcactgcgtttttattttttcttacaacatgttagactaatgaactagtgagatttatgtggattagatttattgggagatatatacgatggtaggaacgattttgacggtacttgtcgctcttgaagccttgtacattatgggattggaaatgtttggcaagccagcaaagcaagccgagacatttgaactagacgaaaacatcacgaagatgcctgaggtacgctcattgttgggtaaccaaggcatttacaatggtatgtttggtgtgttgattttgttgacgttggttgttattcacggatcagcacaagacatcatgttgaagttggagatggcttacattgtgattgtagctgtgtacggtagtttgacggctgcacgcaagattatcttggtacaaggtttgccagcattgttggctttgattgccttggcattgcacatctaaaaattaaatcctggtttcgagacatattattagcaaaataaaaagggggtctatatactatagttattccccgtggtagttacgctaatgactatcttgtacaaccagttgtacagcgcgccgtagatatacggcgcgttttttaatgcagttttgtggtttgtgtcgacgcgttgcgtcgaggcatgagggcttgggactatctccgttcttcacacaccgttcacatcttaaattaaattcttcattgacttagattagaaatacattagaataataaacaataacaagtaaggggaagcaaaaatgatgattaatgcaaagacaacaattgcaaactcatattacttttggttttttggatagctatccgaatcaaaccaaaagcatttttgcatggttctcggatagcggtaaacttcccaggaccaaatacacaacctgaattgttaggacaacaatcggttatgaggttactgggtggtttcgaaatgaaatcgcccagttttttattttaaggagttcggttatgccacacatgaaagcaacactagcaaatcgcttgaatcaagatttgaagaagattcaacctaatgaaattcgtgcatttgatatgcaagttagtcaaattcctgacatcatcaaattgacgttgggggagcctgattttgatacacctgaagtcgtgaagcaagcagcgattgatagtatcgccaacaatgattcacactacgcgccaggtaatggaacagtggctgttcgccaagctgcagcgcatttcttgtcagatcgctacgatttgcaatatgacccaatgacagaaatcgccgtgacggttggggcaaccgaagccatctatgcttcattgacggccgtcttgaacccaggtgataaggttttgattccaacaccaacgttcccattgtatgacccaatcacattgatgaacggtggtgagccagtccacttggatacaagtgccacggacttcgttttgacacccgagatgttgtcagctgcgattgctgaacacggggatgcgattaaggcaattattctaaactatcctggtaacccaactggggtggcctactcatctaagcaattgcttgagttggctgccgttttggctgacaccgacattattgtaattgccgatgaaatttattcagagttggcttatgacagtgagcaccgctcaattgccacgtacttgccagaacaaatattggtcttgaacggcgtgtcaaagtcacacgcgatgactggttaccgtatcggctttatcgctggaccggctgagttgatgcgcacagtgggaatggtgcaccaaatgacagtgacgacaccatctaatccagcgatggccgctgcaacggtcgcgttgggaaccgaagctgggcgtcgggtaacgttggaaatgaagtcggcttatcgcaagcgtcgtgattatgtggttgcgcaaatgcgtcgtgctggctttaaggtgatgaacccagatggtgccttttatgtctacgctggtattccagaaacgcataacacaaacgatcgtgaatttgcgttggccttggctgaaaacgcagcggtcgcagtgattccgggttctgtttttggacctggtggggaaggttatatccgtttgagctatgcaacgagcgacgcgcaactacaagaagcgatggcgcgtattcaaaattacatgcaacaagtgcaagaagtcagtgaataaggatggggatgcttatgaataatgtgaaacagtacatgcttgccgttttgaacggtaatgcgttggcaattatggttgctttggtaccagctgcgttggtgaatcaattgttgggtgccatgccacaaaatggagtagtcacatcattggcgatgatggtcacattggcgcaaagtgcgttgccgttgattgcagcgtttgccgtaggaacgatgttgaagttgggtatgatggagacggcctcaatggccttggctacgttggctggttcgggcgtaacgacgtttaaggatggtgccttcacgttggctggttcaggggtcatcttgaacgtgatgctaacaacggccgtggctggtttggttgcgatgggggcaaccaaggtacttggccaattgcgtgtggtatttgagccattgattgtcttggttgttgccggtggtatcggattgatgacattgccaggcatggttgcggtccaagcggccgttggtcaagttgtcgcctcagctacagcagctgcaccattggtgatgggtatcttactcggtgtcattttcgccttgttgattgtgtcaccaatgtcttcagttggtatcgcaacagccattggcttagtgggaatcggttcaggcgctgccaacgctggtatcgtcgcagccggcttgacgttggcggtcatgggggcatcagttaactcatggggtgccacaatcgcgcactttatgggctcgcctaagattcaaatggcgaacttgttgtcacgaccaaagctgttcttgccagtcgtgattgccgctgctatctcaggtggggttgcctcattgatgatggttgaaggaacggccttctcagccggattcggtatggctggcttcattggacctttgacggcgatgacggagtctactggtagtgccctggcagtacgcgtgttggttgcctttgtggttgtaccactagcagctgccttcttgatgaagttgatctttatccaaaaaacacaattgattaaggcagaagaattgaagttgcctgaagtttaaaagtcacggaggcgtcgagcaatcgacgtcttttttactggagaaaattatcgaaattgacatattgttttgacatcttatattgtacgttgtatagtattgtttgtaacatgaatgaaacatgagattggggattaaaaacatgacagaaccagtattgattgcaaacaagttgaacaagacttataccagtgcagccggggtagaccagcacgtccttaaggatttgtctttgacggtgccacaaggggagttcgtggccatcatggggccttcaggatcaggaaagtcgacgttgttgaacgtgctttctacgttgatgaagcctaccactggtgaagtcatgattaacaacaaagatattttgcacatgacagatgatgaaatcgcaaacttccgtggtcgcgatatgggattcatcttccaaagctataatttgattgaaagtttgacggtcagcgaaaacattgcgttgccactgactttgcaaaagacgaagcctgcccaaatcaaggcagcggtccaaaaggtggccgatttgctacacatcagtgagtacttgaacaagtatccagctgagttgtcaggtggacaacaacaacgtgtcggggcagcccgtgccttggtacacgagccagccttgatttttggagacgaaccaactggtgcgcttgattctgaaaatgcccgcgagatgatgaactacctaacgaagattaatgacgaacgtgacatttcaatcgtgatggtaacgcacgatccgttctcagcatcattcgcatcacgcattctattcttgactgacggacaaatcactaagacgttgacgcgcgatgatcgttcacgtgaagatttctacaactatgtgttgtctgaattgggtaactttgaataagggggcggatgaccatgttttctattgcaatgaagtcactccgctcaaagtggcgtgactatctcgtactatttgtcggcctaatggtgtcggcagccatcttctatatgtttagcgcgattgcgttgaacaaggagttcttgctggctaactcaacgaccgggattatcgtccttgtgtttacaatcggtgaattcctactaggattgattacatttgtttatttgaattttgcaaacagcttcttgctgcgtttgcgtcaagctgagtacggattgatgtcaatgcttggagcgaagcgcaagcaaatcgggatgatgttgatgcaagagacgctggcattgggtgttatctcaacggtaatcggaatcgttgctggaattgcattgacgtcattcagtggccaattcttgatggacctgctgggcttgcaactagctcattggacaggtttctcattccacgccatcttggtaaccttggcattctttgtgatcttgttcttcttgaacggcctttacaacagtgctcgtttgagtcgccaagatacgttgacattgttgacggctgacaagcaagttaagcaaccaaagcgtcgcaagattttggatccactacttggtttgattgggttggccttgttgattggtggttatgccatgatgccaaacgtgttgagcttgggtatcacagggttcatcttgattttgattatcaatgttttgggaacgttcttctttgtgagtcgttcattgaagatgttgatgtacgccttgcgcggttcacgttttaacagccgtgggttgcgttcattcttgaatggacaattgatgttccgtttgcctgattaccaacgtttgttgacggtgttgtcagtcatctttggattggcacttggagcgatgtcagttggacaaggtttctaccgtgcattgccggaacaagcacaatctagccaaccttacacggccgcctatacaacgaacgctgatgtgaaggacttgaagaacattaagtggcaagcaagttatcactacgttaagggtgctgataaggttgtttactttgatggggatgagattaatgcgcaccacatcccaacgatgatttatgatggtgtaccaaacagtacgccaaaggttaagtggatgtctggggatgagatgattcaaaaccctgacgcaacaacggatacgttgattggcttggcaaatcaaatcaacggtgtgcaattcgattctaaggcggtggtgcttaagaacgcggatgagttggcagagaagggaacggttaagtcagctgaactggtgaaggtcgctgacttgcacgaaaacgaaacggtcttggtcaagaacgctgaacgtgaagcgaaggctttggattcaacggtgcaaaagttgtcaggatcatacggtttctatgcattggcaaagagttactttggcggctttgagtttatgggaattttcttgggaattggtttcttagcaatgttggcatcaactttgatgttcaaggtgttgtctggtgttgctgatgataagcgtcgttaccgtattctaacgatgattggaacaagcgaacgtcaagtgacaatgacggttgcgaaggacttgggaaccttgttctttattccattaatcatcggactgcttgacgttgtatttggattgaatatgttcaaggcaatcttgagtgatccatacgtcggcttcgtaccatcactaatcggcattttggtcttgtacttggcgtattatttcttgacggttgtgatttaccgtcgcttgattaaggcctagttctaaaaatgttcatgtttttttgacggtggataaggtataatataagtattcaaaatgctgtggagtaaatgacaataaaaacattttattgagacatctacgacacctaaaaggcggctacctaaacgcgcaaggtagccgccttttttcatgtaaaaattagggtaaactaaaacccgcgcatatactctggaaagtgatcacgggtaactagtttattcgtagtgtcggacatccggttaggatgtgcctgacaaactcagtataacctgattttgcgccgcgagcaaagaactacagcaatccgccgttccatggtatgattgcgaaaatagcagtgttcgggggtgctgatatgagacttgagacagaaattaatgcgacgattcaaggaatcgacattacctttaatgagtatggatctgaaacgacaattagtttgttcagaacggtgcttggcgaaggcgtactacggttcgttgggccgaacagtgagcgtacggtcgttttgaccgcagaacagtatttagactttatcaactacgtttatttgccggctaatgttgctgagtggcattcagtgccatgggcatttgaggccgaaacttggtggcgcgtgatgattcatgatggggacaagagtcacaacatgcgtggtagtgaagagcaagaagggtatgcccactttaaaaagtggttggaactgtggttggcaagatttgatattgagctaggcaatattatctacaagccaatcgaggttatctatgaagacgcagttcatttgcgtacgctaccggtagttggctatgcgtatctaacttacaaagagcggtcgatttacgatggcctagttgaagatggcattgtggatgatgcagcaccacaagttgacttggttcgtgatccaacaaatgcgcatgatgaaaatgccattttagttttgtataaaggtacaaagctagggtatttgcctaagaataataacaaaattttggcgcgcttgatggatggtggcgtcaagttgcaggcggaagtgaatccggacattgatgacgaaaaagtttgggtgtcaattgcgttggcaaagtaaaaaccagaggaacgtgtgtcctctggttttttcgtgttcttacaagattgatccaacccacttcttcattgcgatgttcgtgaagtcgaacttttccaaagcttcaaagccttcagtttccaaatcaacgtttgaaacggcaccgtatgataacatcaagttaactgggtgcacgttacgatcaccaaccgttaccaagatggcaggcttgtttgaagctgtcatgtagccgatttcgaaggctgttcctgaatcagggtctgcagcgtcaatgaaggcaacaatcaaatcagcgttgttcattgccgtgatgtcagccttgtacgtcatcgttccccattcgaagtcaggctcgaaatcaccatcagcttcgataacttgaccaccgtattggttcaacaatgggacgtagatgtcgttaatcgtagggttggccttcaatgcttggtaaccttgcatcaagatgttttgttgttcttcgttgaaccaaccagcacccaagtaaatgttgcgcgtgcgttggccaaccttttcactagcttcagcgatttgagcaagttcagcaatcaattggtgttcagtaagcattagaaattccccgtgtttctttgtttgtaaccaggataccaaatttccgtgacgattttatgaaaatgtagaatgatgcattatgtcatatttgaaagttaggtctaaccgtgctatattaagtttaacttaatcataaagaggtagatgcatatggcagataagcagactgaatatcgtatttggcacggacgattgtcatctatgttagaaggggaaatcgaagatattagatatgacgcgtttaatgaatttgatgccaaagtcgcaagtggtttgattccggtgttggcgtttaagacgatgcaacgtgattttgtgttgccgattattcgtgatcacggactagatatgagtgatttttatgatgcggaggctagcgtgttgggggctgcgtcattgtcagacattcgtttctgggctggcttggctaagaaaatcggggtgagcgctgccaacggtaactggcgcgcacgtgacaaccgcatgtatgtataaaaaaatacaccccaagattgaggtgtacgaatcactaattcttcttaactgcatcgccgtaagcggtgtaattttcatcgcccatcaagcgaacgttcaatacttcatcagcgccaagcttgtcagcttccttggccaaatcagctaatgcgccagtgggtgacatagcgattgatgtgacgatttgaattgcttcaaatccggctggaatatcaccgaccgtcattggcagtgagaaatctttgtttccgaaaagtcccatagtcgtggaccacctttctacctaattgttgccttcattatacaaattccggtggtaaaaagggtggctggtgtcttagcgcgaaaccgagatttctagcgtaacgtcaatttcacgacccaaggcatcatagtggccatacgttgggtaggtggcaaagaatccaatcgcagtgggcacttcatctgacaattgggcagtcagatcacgaattaattgttgcgttttctccaagtcgaaggggatgtcgcgaatatcagcatccaactcgacggccccaagaaagccatcgatatcattatcggtgaacaagggctcacgttcataaaggtaggtataagtcatgcggtaccatccgtctgatttttagttagtaaagctattatagcccactttagccaagggtgcttaattctgaagaaataagcgcttacatggtaaaatgtaagtacaaaagaacgtgactacggaggaaatgattatggttgatgttgcacaccaagaagcgattgagcaagttattttgaacttgaaggcccaggtggctggtttgaaccaacaaatcgaagccttgtctagcttgcttgaaatgaagacagaagatgttgatatccacgatgtgccaggtcaaattaagcgtgcagcggcagcggtggctggcactgatcacttgaacatgattttggtccgtggtgaaagctacgagatgcgtgagcgcatgattaaggaagcgttggacgcccaagtccacgtgactggcgttgaacaatttgtagaagactacgaggctggtttgcgtggtggtcaagttgggacgcaaaagttcaaggatgaatacgatggctacgaagtattggtcattgaaaacttggagcaattggctggtgataaggctaagttgcaagaagaactcttcgatcgcgtttaccaacgttcagaagaaggcaagttgactatcttgtcaggaaacgcagcgttcattatcggaactgaatcagaagaatacctacacatgttgagtttgggaaagaacgtcttcgtgggttaatgattaagggatatgccaattcggcgtatccctttcttgtatcattcaaacattcttgtcatactagtaccgagggagtcgaggaaagcacggaaagactgggggacttttgatggcatttccaaaactaattgcagttgacttggatgggactttctttgataagcaccaacaagtgaatgcacacaaatttacgaagctactggattacttggatgagcgcgattaccattttgtggcagcgacgggtaatgatcgcgcaacggtggaccgctttttggcaccgtttgtgggacgatttgattacgttgtacaaaatggtggccaagtcatcacgaaggataacaaggaactggcgttgcacagtttgtcacgtgaacacatggaaatcgcgatgaaggcggtggctgaatcaccactgtcaccgggtcacggaaatgtttatagcaccgcaactaatgggtacatgctacgtgctgataagggccaaggggaactttatcaccacatggtcgctgagtttccgaacttgattttcattgacagcttggacgaaattactgagccggtcgtgaaaatcattgtgaactggccggaagtacatgcggagaccttcatggcgcagctaaaccgtgagttagctggaaccgcgcacgtgaccacgtcaggcttcggcatgattgatatcgtggcgccaaacatcaacaaggcagttggcctgcaggaacttggtgcctattatggtatcgaaccagaagagatggcagcgtttggggatggtggtaatgacatcgagatgctacgcctagttggccacccatttgcgatggccaatgcagcgcagccgttgttggatgagttcccaccaacggtttcagataataaccatgatggtgttttggacacaatcgggacatggcaataaccataattggacggcttgaaaaagtcgtcctttttctatgcgacaaaacggctcacttatttcgttagtataggtgtcgacaaaaacaggtggccacctaaatgaatttggaggaatgacgaaatgacgggacaaatgaaggtacggtatgtgacgaaggcagcagagacgggagctgaatacgtccgcatgttcaacgtaaaggtgggcacaacggatgatcaactgcgtcaacttggtcaggttatcgtgaaccttggtgttgaaacggaaatcgtgtcaatttcggcgacggaagtgaatgcgtatgatgcaggcttggcagaataatcggaggtagcgaagatgaagaagttggatttggtatttgaagggaagtttgcgaagattgcgggtgcgaaggtgcatttgaagatggtgaacatcgatcctgacttgacgccggaacgcgttaaggctgcgatgacggagttagcatcgtttgatttcttggttgatgttgccggcgtgccgatttacggcaagccattaggtgccaatgtgattgagaccacgacggaagaattggttgcataattttgaaaatggaccggtctgcatagaccggttcttttcgtattgggtgtaaaactaggcagaagtggggtaaaaacggtataatttactttatgaaagtgaaacttaagagaggggctcaagatggtaactgtaattaagcgttatgaagacgcagacgtgatggcgtttgattatttcatcgaagcccatcatgacgtttacgaagatactggtcacattgtcatgaaatcaagcggtggtatggcgacttggcgtgcggtgaacgatggggatgaaatctatcttaagacagcgctaacagcattgtttgaacgccgtgacgaaaatggtggtgtgtacccagaacaagttggggcagcaaccgcctagcgtgtgatttgactaggtgggaaaattttggcgataaaagcggtcaatcttatacctcgtttaagtttggcatcttaatataatacgtgttgagagggggaactcctcaacatacccatagcaaataactactcatgctgattgaggcccacctcaatcgaaccctactcctaaacaattagcggacgcccatctgctgatttcaaacgtcactggattgcccgtccggtggcgttttctgttggttaaaacagaaaatcggaatttaagctacgtttcaggaatcgttattactcctttaaggttccggccttattattaatcatgtcgaaaggggataacccttaagacgcgaaacccatagcaatgaaaacatactcccgttttaagcttgatatcttaaaacactcctactccttatataaataacgaacagatcgctgattgcccaatcagctagatccgaaaacgccactagtatcccagctagtggcgtttttgtttgcaaccgagttgagaagcaatttggacaatacccaaaattaagctaactttcagccacagttatttctgagttaaggttccagctatattattaatcatgtcgaaaggggataacccttaagacaagaaacccatagcatagcaatcaacatatctcatactccttgtctgtgaatcccatcgcagacaaccctactccttaaaaataacaaatagatcgccgacctcccaatcggcttgatccgaaaatgccactagtttcccacctagtggcatttttgtttcccgttaaacgtttaattaaaattaaattagaaaatagtgttgacattatcattttggttcgctattcttaacacatcaaataaagcaggaggcattatcatgaacaattcagtacaaacaacagcatattcagttaatgcctttacgtcattcacgtttttcttttttaagaagcggtgaatgatggcttttaagcaagctagctttcaccgcgataggtgaaggctagtggattattcgatattacacacgagtaacgactagtatcttccggatggatactggtcgttttttattttgactaaagcgctttagtaactcgccaaaccatgaggagttacgaacatgaacacaaagacactagcattgatgacacttgcaacggcaacgcttggatggatggttacaccggcgggggatgttgcagcatcagacaatattattaactggacgcaatcggctgacttgagcacacttgatccatctcgtgcgccagatgtcgcctcatcacaaattattgaccagtcggggcaaggcttgtatcgctctggcaagaacaacgagccaaagctggcggatgccaagaaaatcgacgtttctgaagatggcaagacttggacaattaccttgcgtgataacttgaagtggtcaaacggcgaccctgtgacggcgcaagattacgtttacggttggcaacgcacgattgacccgaagaacgcgtcaacctcagccaacttgatgtacaacatcgaaaacgccaaggcacttaatacaggtgagcaaactgatttgtcagcgttgggtatcaaggcattggatgataagacgttgcagattaacttggtggcacccgaaccgatgatgaccaagattctaacggaaaagggcttttacccacaaaaccaagctttcgaagcgaaggttggcgacaagtatgggtcaacgtcaaccgacacactctataacggtccctttaaggtcgtgggttggaacggttcaaacaagtcataccgcttggtcaagaacaaatactacatcgatgccaagcaggtgaagcctaaggaagttcacttccaaacggtgaccgactcatcaacgggttacaacttgtaccaatcgaacaaggtcgattacaccgagctgtcagcaacccaaatcaagggcgtgaagggcaagaccggttatcaccaaatcaagcaagcgcggacgcaatacttggccttcaacgtgaagacgggcattttgtctaaccaaacggcccgccaagccatgcaacgtgctatcaacaaggccgcgatggtgaagaatgtgatgtctgattcagcgacgatgagcaagacatttacgccggtgggtattgtgacggacccaaagacgaagactgactttgccaaggtgaacgcggttaagaacacgggttacaacacaaaggaagctaagcgcctttggcaaaaagcgatgaaacaagaaggactcaagaagacgtcactgactttgctggctgacaatgatgattcatcaaagaaccaagcccaattcttgcagtcacagctagaaagtcacttaccaggtttgcaagtgacggtaaagacgcaaccgaaaacagctcgtgtgaaggccatgttgtcatcacaattcgaaatggttttggtgggctggaacggtgattacgccgatccactagcgttcttggctaactggcaaacgggtgcaacggccaactttggtaactggactgatgagaactatgacgctgcgttgaccgcggcccaaacaacagacgtgatggacaacgaagcccgcatggctgacctgggacgcgctgagaagatttatcagacgcaagtgccagctacgacgttattcgatgtaacgaactcagtgatgattaaccctaaggtaactggggtgcagattaatacagtcggcgcaacattcgactttacaaaagcagttaagaaataaaagcgtggggataatgatatgacaattgttaattatgttggtggaaatgtgtatgtgacgaacgaggggttcaagtcacaaacggtgtcagtggacacggtatctggtcaggtggttgagaccgtacgtgaggctgatcaaatagttgatgtgcaaggcaagtatttggtgccgggattgattaatgcgcatacgcatattgtaatggcagctgacggtcgcgaacgcgcgggtcaggatgtcacgttggatacgctggttgcgttgcagaatttgcaggatgcgattgcgagtggggtgacaaccattcgtgacgctggctcaacggataatatcgatttgaagttggcgaccaagattcgtcagcaacgcctacaattgccagacatcatcggtagtggtgcagcgttgacgatgactggtggtcatggttcaaagattggtatggaagttgatggtgttgatgaagtgcgcaaggcagcccgttggaatcttaagcacggggcgcaaacgattaagctaatggcgaccggtggcgtgagcttggatggtgagcaaccaacggatgaacaactatcagtggaagagttgacggcagcagtacttgaggcacaccacaagggcaagccagcgatggcccacgcgcaaggaacgcagggcatcaagaatgccatcctggctggtgttgattcggttgaacacgcggtgtatttagatgacgaaacgattcaaatgttgttggatacgaacacagcaatcgtaccaacaatggctgcaccttggcagatgttgcaacacaaggatgatattccagcttatatgtacgataaggcgtcagcgctatgggaggcgcatcaacaaagcattcgtgacgcagctgcggctggcgtgaatgttgtgatggggacagatgctggtacaagttataacgattttaagtctggacctggtgtggaaattcgcttgttggcgagcgtggggatgacgccggaacaagtgttgctcgcatcaacggttcgcggggcagaattgttggggattgcggaacgcgttggtgaactggtgccaggcaaggatgcggacatgttgattttggaccgtgatcctttgcaagatttggctgtgttaacggacgcgccacgtgttatcaagcgtggtcaggctgtaactggtagtttgaattaatcgagaaagcgtcgttagttgggggactagcggcgtttttatgtgagctggaaaccagcatgttttggggatgacgcgtaaaattgatgtgatattaaataaagaggtgaacagggatgtacatcattgaaattaatggtcagtacgtacaagacatcagtaacggtatgccacgatttgtctttggcaagttcggcgcccgtcagttttttagcgaatgggaagcacaaaattatgccaatatgaatgggtactatggcttcatgaatgtagttagtgcgtactaattaagctaactttcagccccagttattggtgcgttaaggtagcaaccttattattaatcatgtcgaaaggggacaacccctaagacaatccctaagaatgactcatattcccgtttgagaatcccaactcaaactctctactccttaaaatgtagatcgccggtaacccagccggcttgatccgaaaacaccactgatcgttttgattggtggtgtttttgttttgaatgaaaaatgaatatgaatgttgtttgtatgaatagtagactgattatatatgaggaggtatttatgagaagtattagtaagatagttaagcgattgttattgttgtttgggctatttgtgttagaacaaatagccacgataccatcgttttttgcggctgatgaagctaaaacgatggccggtattctaattggcgttggtctaacggtattattgagtgcattatttatccattattcatggccaaaacaattgtggccatcgctaaagaatattgattggaaagcagtgggcattgcatttctgataattctagcttttcaagttttgtttggggtactagctgacctgtggcatatcccgacgaatgagaatcaaaagttagtcatggatgaacttcgtaaaacatattatttggcggcagttattgatattgtgatggcgccaataatggaagagattatttttcgatttaaattttttgagtactttggtgagttcatgagtaaatgggttggcattatcgtgaacggtattttgtttatggtcattcattcaactgatttgaacgtcgtgacactagtgtattttgtaattggtgccgtacttgcatatgtctaccgacgtcgcaacaatttgggtgattcgattgccgttcatatgctgaataacgcatacgctattcttctttaatattatttttgaaacactgctgatcgttttgattggtggtgtttttgtgttgaaagaaaatttgaatgtactttatctagtgagtgaggaaacggagaatttgtttgcctctagatctaaataatgatctaattattatagttaacaattatgggggggatatgtaattatgggtgttccaattaaaattccacagccagctggactaacgatggagatgctttttcaacaaaacgttttttctattccggtgtatcaacgaaattattcatggaaacaaaatgaagttttggacttctggagagatttagaagatctaattgaagaacgacgcaataaccacttttttggtcaggtggttacatttaatcatgacaatattcaagatttaattgatgggcaacagcgaatgaccactagtacgattttcttggcagttattcgagacacagcccagaagatgctgacggatgaagcagatcgattaacacaagattcaagagatacgctccgtgatatcatgcgagatatcaaccaacgattgattcgtggcgaaaacggagagcaggctacgctgaagttgcaagcatcctctgaatctgatcgagaattgcaagattatttttacaagcggacgcattcacaagacgtgaattatttggataatagtcaaaagactgaaccaatgaaaaacatggatgcagcgtacttggaatttcagaggggaattgataagtcgctttcgcagaagaagacattgggtgaacgcatcaacttgcttgatcgaactttgagaacgtttattgaaaaattctacgttgttatgatctcagcaccaacgcaaagggatgcattcattatttttgaaaccttaaacagtcgtggtgcagacttaaagccatctgatattatcaagaatcacattatgttcctgttggaagatgatttggaaaatactaatttgctttgggcaaaggtttcggatcaattgaatgcagatagtgatcgaattacttcgtatattcgttcttattggacggctacgcgcaggttagtaacagagggcgcattgtatcgctctttaagccaagagttgaattctaagtcagaaggcaaggactttttggatgacttggttgaacttgtacatgcgtatgatgtgctagaaaatccgtggagtccagttgcaaaccgagatttatttaagaaccgtatgttgcacgctgaaatagatattttggacaagatgagcgtaaagctgtattatccaatattcttatcaatgcggaagcaacgttttgatgaaaaacaaattgcccaagtgcttcatcaggttatttcaatctttgtacgacaccgcaccattttgaacaatggaactaacactttggaaagcggattcgcaacaactgcgaataagatttatcgaggtgagttaactagtgtcgatgatatcaacacggatttgaagcgacctgttatgcttcattctgatgcagatgtactcgctgccttttctgttctctcaaaggatggcggacagcgcggacagaaaaaatgggcacttacgtatttgttgagcgagctcgcatatgccgataaggaagaagattactatgaagatgtattccgagaagataagtatgaactagtccgtatcgctgagttaaacgatatgactgatgacgtagatacagatcatgaatctcgaattggaaattggacgcttatcgagaaagcgtataagtttgacgagcgtgatgcggatgggaagtaccaggcattacacggatcactgttcccaggtaacgacgtcttagctgagcaagttaaaaaaggctggaataatgatgctgtggaagctcgacagaacaaaatgagcgaccatgttgttgtgatttggcaatgagtggtaaaggttggtagagagataattggaatagtttaatctaaaattgaattcgtttgatctataaggtaacttgatcaacaattaagatccaaaattgtatttgacaaggaaatggatctagatcatgcttaaccaaccaaccaaccaaccaaccaaccaaccaaccaaccaaccaacgtggtgtaaggctcaaacgaagtttgatttacaaattatgattcagttttgagagagctaatattttctcaattaaataccgtgtcgtgatgatggcattgaggccacacctgttcccataccgaacacagaagttaagctcaatagcgccgaaagtagttggaggatcgcttcctgcgaggataggacgtcgcgatgcacatggacgtttagctcagctgggagagcacctgccttacaagcagggggtcacaggttcgatccctgtaacgtccatcctaaccaccagttacctggtggtttttttgtgccatcaattatcacaatttacacacaaagttcatttattctggaaattgcgcataagacgggcgttctttctgatataatagttcttagttagtttttatttaccgctttagttagcgggtgaaaatagtatgctagcacatttaacagatgtgtcaggaaggaagtcgaaacatgtcagattatgctgtgaagtacgaattgcttcacgttgaaaagcatactggtgcacgtttgggtaagattacgacaccacacggtgaagtaatgaccccaatgttcatgccagttggtacacaagcgaccgttaaaaatgtctcaccacgcgaattgaaggagattaagtctcaattcattttgtctaacacttaccacttgtgggtacgtcctggtgatgagttgattgctgaagctggtggtttgcacaagtttatgaattgggatggcccaattttgactgattctggtggtttccaagtttggtcattgtcagagcgtaacaacattaaggaagagggtgtcactttccgtaaccacgtgaatggtgaagaaatgttcctttctccagaagttgcgatgcgaatccaaaataacttgggttctgacgtgatgatgcaattggatgaagcgattccatacttcgaaacgtatgattacgtgaagaactcagttgagcgtacatcacgctgggctgagcgtgctatggcagcacaccgtcgtccggaggatcaagcgttgtttggtatcgtacaaggtgctggattccgtgagctacgtaagcaatcagctcgtgacttggtttcacttgatttacctggttatgccgtaggtggtttgtcagttggtgaaacgaaggaagaaatgaaccgtgtgctagacttcacggtgccattcttgcctgagaataagccacgctacttgatgggtgtggcggcacctgactcattgattgacggtgccatccgtggtatcgacatgtttgattcggttttgccaacgcgtatcgctcgtaagggaacgttgatgacatctaagggtcgtatcgtgattacgaactcaaagtacaagaatgatttttctttgattgaccctgagacggaagactacggttcacaaaactttacgaaggcatacttgcaccacttgtttaaggctgatgagttgtatgcacaaaacatcgcctcagtgcacaatttgcgttacttgttgaagctcatggaagacatgcgccaagcaattgcggaagatcgactacttgagttccgtgaagaggttatggccaactacggttataacaacgcaaatgcccgtctgttctaattactgttattaaaattttaggagatttactactatgtcaatgaacattttgattttgattgtcttcgtggcagctatgtactttatcatgattcgcccacaacaaaaggcgcaaaagacgcgtcaagagatgatcaacaacgtacaaccaggtgccgaagtggttactatcggtggtttgcacggtaagattgctggtgttaacaaggaagctaagactttcgatttggatgctgaaggtgttatcttggtattcgagttgtcagctatccgccaagttgttaaggctgctgagactaagactgaagctgttgaagcaccagttgctgaagaagttaaggctgaagagccagcttcagaagacgaaaagtaattttttagaattcgagttgcaatgcgcaacttgaattctttttattagctggcaagaaaggaggttatcatggctgatttgctagagataccagtgcatttaaaaacagatcgacaaattattcacgtggatatggatgcattttatgcccaagtggaaatccgtgataatcccgcgctggcaaatgtgccattaattctggcgcatgacccgcgtaagaatggtggccgtggtgtggtggcgacagctaactatgttgcgcgaaagttgggcgtgcattcagcaatgagtgcagccgaagcattacgattagcaccgaacgcaacgttcttagaccctaactttgaaaagtaccgtgctgtgtcacagcaagttcatgatatttttcatcgttacacagataaggttgaaccaattgcgtttgatgaggcttatcttgatgttactgagaataaaacggggcataccaatgcagtggcactggcccacgaattacagcaaactatttttgcagaattgtcattgacgagttcagttggtatttcattcaataaattcttagcgaagttatcatctgaacataataagccggttggtctcacggttgtccgtgaggcggatattcgtgcatttttagatgcgctaccaattgaagatgtgcgtggtgtgggacagaaaacggcgataaagatgcacgaacttggtgtggatacggggcgtgacttatacgagatggaccagacaacattgacccagtattttggtcgaatgggctatgatttttatcgtcgtattcgtggtgttgatgatcgcccagttgaatggcagcgtgagcgtaagtcaattggtaaagagcatacgtacgggccattcttagacactgaggagcagattgaggcagagtttaaacgattggccgagcgactagaacagtcacttaaacgacgcggtatgcacggtaaaacactggtcttgaaagtacgtgatgaagactttgatacagagacacgtcgctttactcagacggatttcttaccgaatgacgctacggaatttgtgcgtttggcgcaggacatttgggaagagctaggtgggtatcaaaagccgattcgcttgcttgggttaacgatgaccaacttagcgccactgacctttgaaaatattccactgaatctgtatgataactaaccacaacgcgtttttacggccattttctgctatactaataaaagcaacgtaagtaaactagatagaatagagaaagcaacatgacagcgcaaacagcaattttagcgcaaattaaggcggcggatacgattattattcaccgtcatcaacgtccagaccctgacgcatttggttcacaacttggtcttgctgaattgattaagacatcattcccgaataagcatgtccatgttgtgggtaagcaagtgcctagctcagcttggatgggtgagatggaagatattccagattcactttatgataacgccttagttattgttaccgatacggctaatgaaccacgtattgatgaccgccgttttgattacggtaagacgttagttaagattgaccaccaccctaatgaagacccatatgcagattttaattgggttgaagagggtgcgtcatcaacatcagctttgatttacgccttctacaaggaatttgaagacgaattgaagttgtctgatgcgggtgcgtcatatttgtatgctggaattgtcggcgatacaggccgctttttgtatgcaacgaagtctgaaacgatgcaggttgtggcagatttgatgaaatacgattttgattggttcgagattaaccaacgaatggatacgatttcacttgaagctgcccgtgcatcagcttacgtttatagcaatatggtcatgactgaaaatggctttaactatattattttgacgaatgaagtcgtagagagtttcgatcttggcgaatttggtaccgcatttatcgtgccattgctaggaaagattaacacggcgaaggcctgggctgtttttgagcagcaagatgaagggtacttccgcgtacgactccgttcacgtaacacggtgattaacgaaattgctaagcgtcacggcggtggtggacacaagtttgcctcaggtgccttagcaaaggatatggatgaaattaacgatatcattcgtgaagccgatcaaacattgaaggagcaaacagaagcataatggcgaagtttactgactacaacctacgatcagaaatttacacagcgttggaagaaattcgtttcacaacgcctactaaggtgcaagaacgcttgattccagttgtcatgcaaggacgttcagtcgttggacaatcacaaacgggatctggtaagacacacacatttttgattcctattttccaaaagtacgacccatcagttcaaaaggtgcaagccgttattacaacgccttcacgtgaattggcacaacaaatctatgcagcggctaagcaattgggaactggtttcccagttgatcaacaaccacgcattggtttgtacgttggtggtactgacaaggcgcgtcaattgcaccaattggaaagctcacaaccacaaattgttatcggaacacctggtcgtatcaaggacttgtatacggctggtgcattggatatccacacggctgacacattggttgtcgacgaagcggatatgacgatggacttgggattcttgcctgaagttgacgcgattgctggtgcgatgccagaagatttgcaaatgttggtcttctcagcaacgattccacaaaagttgcaaccattcttgaagaagtacctaacgaacccagttattgaagaaatcccaacggaaacggttatcgccccaactatcacgaacttgttggttggtacgaagggaatgaagaaggacgacttggtatacgagttgttgacgatgggtaacccatacatggctttggtcttcacaaacacgaaggaacgtgcccgtgagttgacgaaggctttgcgtaaccgtggtttgaaggttgctgaaattcacggtggtatccaaccacgtgaacgtaagcgtaccatgcaacaaatccaacacttggattaccaatacgtcgtagccactgacttggctgcccgtggtatcgatattcctggtgtgtcattgattatcaacgatggtattccaactgaattggagttcttcgtgcaccgtgttggtcgtactggccgtaacggtatggaaggaactgcgattacgatttacaaccctgatgaggaagatcgcgtgcaagcggttgaagccatgggtgttgaattcgagccgatgacgtactcacacggtgagttgaagcctggttacgaccgtcgccgtcgtaagcaacgttcaaagtcaacggttaagcttgacccaacgatgattggaatggtcaagaagaagaagaagaacgttaagcctggttacaagcgtcaaattaaggcagcgattgcccgcgacgcaaagtacaagaagcgtgtcgaagagcgtcaatcactccgcgctgcgaaaaaggcgaagaagaaggcgaacgagaagtaagtttttatagttaaaaacaggttcacacttagagtgtggacctgttttttggttaataatcaatattgagttggttcaaggacctgttttagtgccacattgagttgttcatagtctgcaagtgagaactcaagatatattttttctaagtactgaccatgtccatcatcgcggtatacaacctgcatatgatagattgggccgtttacctggctaatgtagttattaattgcctgtagtaaatcgaatccttgaaaatagttatctctagcaaataaatgagagatatgaacgaattgagaatcatttaatttgactatccgaactgtatttgtggggatgttgttcatttcttgatagctagttatcaatgatttgaaataatccatctaaatgactccttataggtcgtaataaaatataagcaactatcattttgagtccttagaagccagtacaacaatgacaataattgcaattgcagacgttgacttaaccaaaaagtgccatattgaaggccaggcagggtttataaaaatatcgattaggaaatcgaaaaccaatattaatgcccaaaataagatgggtctcattattttgcccctttagttatgtgatattctttgtacatattaccgattaggacggcaacacaaaatacgagtaaatagattttgcggcagttagttaactcggttatgcctgggaaaaagagacccaaaatcagcattgctaaaaacaaagtacccatgactgttgcgcttttacgtaaactgtatataaaccacatctaacgactcctttgccttgctaaatcatacttaaacaatatcaaaaggaagtaagatgcaactatgcattaattaacacgaagtcaatagaaagttatgcgtagaaaaaacaccgcgaccgctcgcggtgttgactgtttaactaaagggtgaagagtgacgcataatttggtacgttcgatggtttggcttatggtaggtcttactgatattagcactaattggcttagggacatcggttagatcaatccaacgcgatgctttcacgtaagacccgcgatgctgcaagacgataatattgtctttgtgtggtgagtcaatcaagcccattgttacgcttacaatttctgtattttcaccaaacggatcactaattgcttcggtcgcaaattgtttacctggtgttgaccagtgttttggacctgttgcatatgaagttttcatgggtaagaatggattgaatcgatcaattagaccgatttggaaatatcgacccattgatagcgtaatcaaaaatgcggtaacgacactaattatcaaccaaaatccaaatcggtaccattttgaatgcttaatatttgtgtcgattttggttgcagtttggtatgcatcggatttaaagagttcgctgatttcaacagcgtatgcatctgctatttcaattaaagtcatcaaactgggtgtatctttgttattctcccaacgcgaaattgcctggcgcgttacgtgtaatttttcggcggcttgttcttgtgagaggtgattcgccaaacgtaactctttcaactttgtccctagttccataatgtcctcctgacatatcacttactgataaatagtctgccggaatgacgcatatagtacaagcaagtaataagttacatcgttgaccagccttgatttggcgcgcttttcggattacgataaacccagtgaggaaatgatatgaaatttgtaattgcaccagattcattcaaagagagcatgacggcgaaagcggcggctgtagcaattcaggccggcttacaaaagatttatcccgatgcagactatgagttagtgccaatggctgatggcggtgaaggaactgtccaatcccttgttgatgcaacggagggcgaaatcatcactgccgatgtccaaaatccattggatgaaactgtttcggcattttatggggtgttgggcgaccaacaaacagctgtaatcgaaatgtcagccgcatcaggtattcaattcgtgacgacagagacgaagaacccattgattacgacaacttacggtacgggtcaattgattaaagatgcgttggaccgtggcatgcgtcgcttcattattggactgggtggatctgcgactaacgacggtggtgccggcatggctgaagctttgggggttcaattccttgatgaaaatggccaacaaattgctcgcggcggtgcggcactagcaacgttgcatgaaattgatatgagtaatcttgatcctcgtgttgccgaatctgaatttttgttggcgtcagatgttaccaatccgttggttggcgaaacgggggcgtcagcggtattcggaccgcaaaagggtgccacaccagcgatggttgccgaattggatgcggcgttgacgaattatgccgcagttattaagacccaacttggcgttgatttggctaacacaccaggtgctggagccgctggaggtttaggcgccggtatgttggcgttcacacaggctaagatgcaatcaggcattagtttggttgttgaagcgactgagctggttgctaaagctgcgaacgcggacgttgcgtttgttggcgaaggcgcgattgatttccaaacgcaatacggtaagaccccaatgggtgcagcccaagcgattaagcaagcctcaccaaatgcaaaggtgattgggcttgctggttatgttggggatggcattgatgccctgtatgatttgggtatcgatgcagtgttcagcattgtgccgggtgcagttgatttgccaactgcaatgaagactggtgaggccaatctaacacgaacggctgagaacatcgcgcgattgttaaataccaaataacttttacaaaaacatttcaagcaaacaaaaacggctattagaagttcttaatatgttacaataatgaacaaggacatatcatttaaggtttgagagccaacagaaacgttgtggatgatgcaaacaacgctcaaccttttctggtgctaccttctagctgcttgtgaaaacaagccgtgcgcccgcgttaacggcatcctaagaggtaatgatgcagaccatcattgcaagcagagtggtaccgcgtgttagcgtctctgttatgcaatggcggtctgtttttatttagatatttatttaagtgaggattggaaagatgaagccattatcatcagctgagattcgcgatatgtttctacgtttctttgagagtaagggacacagcattgagccatctcaatcattgattccaaaggatgatccaacattgttgtggatcaactcaggtgtcgcaactttgaagaagtactttgacggtacggttgtacctgaaaaccgtcgtattacgaatgcacaaaagtcaattcgtacgaacgacattgaaaacgttggtcacactgctcgtcaccacacgttgttcgaaatgatgggaaacttctcaatcggtgactacttcaagcctgaagttattccttgggcctgggagttgttgacgagcccagagtggtacggcatggaacctgaaaagttgtatgtcacggtttaccctaacgatgaagaggcaaaggatatttggttgaacgtggttggtttgccaaaggatcacttgtacgaagagccagataacttctgggatatcggtgaaggaccatcaggacctgacactgaaatcttctacgaccgtggtgaagaatttaactcagacgatccaaaggaaaactaccctggtggtgaaaacgagcgttacttggaaatctggaacatcgtgttctcacaattcaaccacttgcctggtttgactgacaacaaggactatcctgagttgccacacaagaacattgatacgggtatgggactagaacgtgttgtctcagtgttccaaaacgctaagacgaactttgaaacggacttgttcttgccaatcatccgtaagacggaagagatgtcaggtcaattcaagtacggtgaggatcctgaaaaggacatctcattcaaggttatcgctgaccacgcacgtgccgtaacgttcgctatcggtgatggtgctttgccatcaaacgaaggtcgcggttacatcatccgccgtttgctacgtcgtgctgttttgcacggtcgcaagcttggtatcagcaaggtcttcttgaaggacttggtaccagtcgttggtgaaatcatgaagtcatactacccagaagttttggagaacgcagactacatcgcttcagttgttgaagctgaagaagttcgtttcaacaagacgttggctgatggtttgtcattgttggatggtgtcatcgaagaagctaaggctaacggtggtgttattgacggtgccgttgccttcaagatgtacgacacgtacggattcccatacgaattgacggaagaatcagcagctgatgctggtttgacggttgatcgtgaaggcttcgatgctgagatgaaggcgcaacaagaacgtgcccgtgctgctcgtggtaacacagcatcaatgggtgttcaaaacgctttgttgacagatttgaagacggaatcaaagtatgttggttggtcagaattgacggttgatgccgctaagttgacggacttgattgttgataacgaattggttgactctgctaaggacggccaagctgaagttatcttcgacgtaacgccattctatgctgaaatgggtggtcaagttgctgaccgcggtgttgtcatcaacgctgctggtgaagtggttgccgaagtggttgacgtgcaaaacgcaccaaacggacaacacttgcacacattgaacgttaacgctgaaatcaaggctggcgagacttacaagcttgaagtgaaccgtgcttaccacgctgctgtgtcaaagaaccacacggctacgcacatgcttgaccaagctttacgtaacatcttgggtgagcacacgacgcaagctggttcattggttactgaagacggattgcgttatgatttcacttacaacggcgctgtttcagctgaaaagttgcaagaaatcgaagacttgatcaacgaaaagattattgaaaacttgccaatttcatgggttgagacggatatcgaatcagctaagaagttgggggctgttgccgtctttactgaaaagtatggcgagacagttcgtgtcgtttcaatcggtgacttcaacgtcgaattcgacggtggaactcacgcaaactcaacggctgagttgggaatgtttaagattgtgagcgagcaaggtactggtgccggtgttcgtcgtatcgaagccgttactggtaagggtgcaatggacttgttcaagcaacacgatgcttggttgaacgaagctatggcacaagttaaggcaccacaattgtcagaagtaaatgacaagattgctgccttgcaagcgcaattgaaggatgccgagcgtcaagttgcatcattggagcaaaagttggctaaccaagctgctgatgctgcctttaacgatgttcaaacggccggtaacttcacgttgattgcaacggaaatggccgttgaatcaatggatgccttgcgtgcaacggcagataactggaagcaatcaacaccatcagatgttcttgttttggctgctaacttgggtgaaaaggttaacctattggttgctgcttcacctgacgctatcgcaaagggtgttaaggccggtgatttgatcaaggccattgcacctgctgttggtggtggcggtggtggtcgcccagacatggcacaagctggtggtaagaaccctgctggtattaaggatgcctttgcccaagcaactgaatggttggctgcaaagtagcatttgattagaggataattcctcagaaggaggctgcatatgagttcattggataatacagctgtgtttgattttggtaacaaccaagatcacgacgtgcgtaagacgcttgaaattgtatacgccgcattggaagaaaagggttacaacccaatcaaccaaatcgttggttacttgatttcaaacgatccagcgtacattccacgtgtaaatgatgcacgtaacttgattcgcaagttcgaacgtgatgaaatcattgaagcacttgtgaaggattacttggctaagtgatctgattcagaaaggaatggtcgattaataatgggacgaattatgggacttgatgtcgggtcacgcacagttggtgtggcagtttctgacctacttggttggacggcacaaggtgttgaaatcattcgcattaacgaggatgaaaaagagttcggtatcgaccgtatgaaggaactagtagcccaatttgagccaactggctttgtacttggtctaccaaagaacatgaataatacatctggtccgcgtgttgaagcagcgcaagcctatggtgaattgctaacggaaactttcgggttgccaatcgatttccaggacgaacgcttgacgacggttgaggcagaacgtatgcttgttgaggaagctgatgcgtctcgtaagaagcgcaagcaggtgattgataagttggcagctgccttgattctccaaaactatttggatcgcaaaggcccacttgtaaagtaagaggtaaattgagatggacgaagagcaagacattatcacgttgatcgatgacaatggcgatgagcaacttttcgaagtattgttcacgtttaagtcagaagattacggtaagtcatacatcgttttgtacccagctggtgcaggcgaagacgaagaagtagagatgttggcatacatctttgacccagacgagactgcagagtctactgagggtggtttgacgccaatcgaagacgacgatgagtggtcaatggttgaagagcgtttgaaccaattcttggacgaacaagaagactaattttagtacaattgatggccggtgatgaatcggccattttttgttaagtgcgaaaggaatccgacatgaacgaagctgaattgtttatcttgactgacgaagaaggtaatgagcacgaatttattgagttgttctcttttgattcagaagactttggtaagtcatacatcatccttggccctgctgatgcagctatggacggtgatgacgaagaagaagttggtatcatgccattcatctacaacaaggatgacgaagaaggtatgttgcaaccaatcgaaacagaagaagaatttgacatggttgaagaggtgatgaacaccatcttcaacgatccaaacttgcaataaaaatgatttgcgacgaattttgcgattcgtcgcattttttttggactttttgccggttttcacctctttattgttggagggaaaataaatgacgacttttaaagcactttattatcggttccaacatgtgattttctttttcggcggtctggttgcggtgggtatcggcttaattgtttggtggcagtgttcacagacaaaaccggtcttgcctcatgacgtgtcaccgagcatcgcagcggatcagtcttcacaaacgccaagtagtgttagcaaatcagtgagttcaactactgccaaagtggtgattgatgtcaaaggtgcagtgtatcgaccgggcgtttataaattcaataatggaccgattatggctgatgttcttgaaaaagcgggtgggacattgccgacggttgaccgaacacggcttaatttagcagcaccattggtgaatgggcaggtgttatatgtaccaaatggaacggaagacgttcctgaacagtacccgttacctggccaagcgacgacaatgagtgcgacgggtggggatacaagtagcgagactatcaatctaaatacggcgacattggcagagctgcaaaaactgcctggtgtcggtactaagcgtgcacaagatattattgaccaacgtgaaacgatgggtgggtttaaaacggtcgctgatctacaagaggtgtcaggtatcggcgagaaaacgtttgcgaaattagaaccgttggtcacggtgtaatgaacggctattggttagtgactggattgctagttggcacactaaatgtcatgatttgttatcaattttggtgggccgtaccaatgtttgcatggttgctgattttgttggtgactcgttttaaaaagcgactgtgtttgactgttttgattatagggagttacgggacgttttttggtgcgcatcaggttcacctgaatcaacttggcgaccggccgataggtgatgttaaaacaaccgttatggtgcatccggacgaattgcatttcacaggcacaacaattactggcttcgccacgttgccaaataaagaacgtgtccgtttgacttggttctgtaaggacaaaaaaccgtttcgcgagttacaacgacgtcatgatgcggtggtgatatcgggtagcggacaatacgaaaagattgcaccacggcggaatgcatacacctttgatccagtggggtattggcggagtcgtggtattatgcaccaacttgttttgacacaaggtgaggtgaaaagcgcgtatgtaccaactaatgcgggtgagtttgttgttttgcaaatccgaacctggcatcgcctgctagtacaatggtttgaacggttaccgcctggtctacgtgattacggcgagacgttgtttcttggctatacgcggcgagatttttatgacgacaatctgggtattcagaaaatgggattggttcatttgtttagtatttccggttttcaagtggctggtttgtatgtgatttggcgtcgaattggccggtggttaggtattacgcgtgaacggtcgttgttgattgtgcagttgttgttacttgggctgctgctatttgcgggtggcgtacaatcgttagtcagagctgttttgttggccctgacccaagcgtggcgcgagttgggatggttaaggttgtcagccgtcgatgcctggggaattgcgctactgggtggccttctcttagaaccaggtgttttgcataacctaggtggccaattgtcctacttgttgacgtttggtttgttatggcttgaaggtaaaccgggatggtggcagtgcgtcttcttgtcgttgctgattttgccgttgttgctgtggcatacatatgcgtggcacccaattggtatcttagcgaacttgattgccatgccactgtttacgtggcttgtaattccagttctaaccgtaggcatacttgcagcgtggttgaacattacggatttaactaattggtgtaatgcatttgttgatggggtgcgttggacgattgcacaaacggaaggcttgccaggtgaattaacgtttggacagccaccggtgttgttatgcgcgattattttaatcggcacgctagtttggttggccgttcgacggcggtggttattgggcattttaggcactgtttacgggattacgctgttgttgcctaatttgctaccgggtggttttgtgacattcgtggatgtcagccagggcgatgcaaccatcattaaacaacgcgctaatcaagtgatgatggttgatgtcgggggtaagctgcagttgccacaaccagattgggcagcaccccgcaagacggattttcaagcacaacagttagcgcagtacctaaaaggtaacggtatcactaaaattcagcagttagtgctgactcacaaggatgtcgatcatattggtaacttgccgcattttctaaaactagtacgagtggagacaatttatgtgccgttggggatgcaacagattgatgcgtacaaacgattggttgcgccttatcttggaataactgaggtccgagaagttcgcgctggcatgcgcttaaatgaatggacaacggtacagcatccattcgaagcgggaactggcgaaaatgaggattcggttgcattgctcgtgaacgttggtccaaaacagctaatgatgacaggcgatttagaccaggctggtgaggaacgaattatccagaacaaccaatgccgacaagtggaacttctgaagctaggacaccacggttcaaaaacgagtaccgcacagtcatttgtgcacgcgttaaagccacaaattggtattgtttctgctggtgtgaataatcgatttggtcatccgaacaaagaaacgctgtcaacgacaaaggaggcggggatgaccgtgtttaatacagctgaaaacggcatgttgcagtaccattggcgtggtaatcgggattggtggcaagctgaaattaagtagctattcacgttcaggaggcaacatgatacagtagagatacgattaaaacgaggaggcgtgggcatggcttatacgctgaaagatgtgcaacaagatgttgcaaagcaaacattgcagccaatttacctaattcaaggtacagaccaatatttgcttgatcaagttcgtgcggcgtttgtgagtctgattccagatgaagaccgcacgttgaacttggcacaatttgatatgcgtgaaacggcgttgggtattgcagtagatgatgcgcggtcagtaccgttttttggtgaccgacgtgtcgtgattattgacgatgcttacttcctgaccggtgaaaatccacgaactaagctggaacatcacgtcgaagatttattggcctatattgaacacccggagccacagacggtcttggtgatttttgcaccatacgagaagctggatagtcgcaagaaggttgttaagttgctgaaagagaaggcagcttacttggcctttggtgatttgactgaaaaagatgtgcgaaacatgattaatgataagttgcgccaaggcggttttgaaatgtcaggacctgccatgcaactactaattcgtttaacgaatatgtcgttaacgcaaattatgtctgaactcgataagttgatgctttatgcgtacgatacgaagcagattgacgagcaagctgttgatgccttggtaactcgtacgttgagcgaaaatatcttcgacttaattaatgcgttgttgaaccgcaagttaacacgcgctgtggagttgtatcacgaattggtcgagagtggtgaggcaccattgcgattgcacgcagcgttgttaggacaattccgcttgttgttacaggtgaagtcatcaactcaaagtgagtctggtacggcatcaatgttgaaagtgaatccataccgtgtgaagcttggccgtcaaacggtacgccgcttcagttataccgcactagctaaggcttatctggggctagttgatatggaagagcagctgaaatcaacggcacgtgaccctgaattactctttgaattattcgtgttgcgttaccaagctgatattgcataggatttctacttgcatcaagttagaaagtttagtattatatttgaagtgcaaaagcacacgaccttttacgatgtttgacggttcaccgtcgtcctacgttgttttaggcgactatatattaagaaaggtggatatccaacatggctatttctgcacaacgcaagaatgaaatcatcaaggaattcgcacgtcacgaaggtgatactggttcagttgaagttcaagttgcagttttgactgccgacatcaacgaattgaacgcacacatgtcagagcacaagcacgacttccactcacaacgtgggttgatgaagaagatcggtcaccgtcgtaacttgttgcgttacttgcgtgacaacgacgttcaacgttaccgtgagttgatccaaaagcttggattgcgtcgttaatttttacattaacaacgtacgttattttgacatttatcatcggagggaaaagcgatgccaattattgagtcatcaatccaacgtgcccgcttgaacaaggtgcaacgcgagcgtaacatctcacaattgagtgcataccgtactgaagtgaagaagttccgtaaggctgctgaagctggtgcagacaacttgcaagagttgtttgttaacgctacgtcagctatcgatcgtgccgcatcaaagggcttgattgctaagaacaaggcttcacgtgacaagtcacgtttggcagctttgttgaacaagtaatttattacttgcgatagcaaactgaaaaaagaccaacatcttcgggtgttggtcttttttgttgtctaaaggtttataattagtatgtaatatcaatgaggggggacgtagttattaaattacggtatgagtagagagtatgaaaaatcaaattgataagctgttatgggctgttctgccagtggctgttgtattgtttgttttaagtgtggtttaccgagggtggtttaacgttgctttcaatgtactaatgtcagttatgtttatctacgtggctaagaaaagtaggcagtcttggaacctatttgtaggagttgtttttggattgttggcgttgttaggcacatggcaggggttaagataattatcaacgggcgagcaatcgccttttttgttgtgttcataaaataacaaaaactgaatgctaaactgaatcacctataaggggatcagaaaatgaaattcaaatttgccttaggcattgttataacaatgatattttcagtgataattaccattgacgtactttatatgccactaaagctagcactcgaaagctctgggaattttttggaaccgtcaacaccaccgacgcaatctgaaaacttcaattttttcgcgaaactattgttaattgagattgtgccaccaatcatattgacggtgattaatatcatcatcacaaaatcaatcggcaaagagagtatcgaaatgcaaactaggtttgtgattagcagttttgttgctttctgggcggcaccgattttgattgtgattctagggcgaaaggtgtcagaaatattgcagatataattttctcgttgttggtagggtaggcattgtgtggtaaactgttaataaatcatacaaacgtttgggttgtgctgacccgtgaaatataacgagaataggaacattatggctacgacattaagtattatgccgttcggtggtgtacgtgaaaatggaaagaacatgtacgcagttaccgtcggtgaagacatttttattttggatgcagggttgaagtacccagaaagcgatttgctaggagttgacgttgtcattcctgactttgcctacttggtagagaacgcagataagattgccggtgtctttttgacacacggacacgcggatgcaattggggcattgccttacttgttgagtgaggttaaggtgccggtctttggatcagaactaacgattgaattggctaagttggctgtggaagcagagcctgaagcaaaggggtttgatgattaccacgtggttcgtggtaactcagaagtatcatttggggatgtgaccgtttcattctttgagacgacacacacgattccagaatctcttggaatcgtaattgaaacgccagaaggacaagttgtctacactggtgattttaaaattgatacaacggcattgccatactaccgtactgatttggcacgtttggcacaaattggtgccaagggtgtaatcgctttgcttgctgatgcagcaggtacagctagctatggtttggcagcccacgaatctgaattgggtagctacgttttggatacgttccgcggtcacactgagggtcgtattatcgttgctgcagtcgcttcaaacatccaacgtatccaacaagttatcgacgcagccttcaaggttggtcgtaagattgtgatttctggaaacgacttggaaaaggttgtacgtactgctttgcgtttgaagaagttgcacttgccaatgcctgaaaacgaactatttgtttctttgaagaacttgagcaagttggagccaaacgagacggttatccttgaaacgggtaagatgggtgagccaattcgtcacttgcaacgcatggcgcaaggtgatgatcgcaacatccaaatccaagaaggtgacttggtcttcattacgacgacaccttcaacggctatggaaggttacgtggcacgtacgcgtgacatgttgttccgtgccggtgcaacggttaagcaaatttcaacggataagaagtcttcaggtcacgcatctaaggaagatttccagcttttgttgaacttgttgaagcctaagaatgttatccctgtgcaaggtgagtaccgtgttttgaacgcggcttacaaggctgctgaacaagtcggttacgatgacaaccacgtcttcttgcttgctaagggtgacaaccttcgctgggatggcgaagaaatgtacttgggtggctcaatccaagttggctcaacaatgattgatggatctggtgtcggtgatatcggttctatcgttttgaacgaccgtcgcatcttgtcagaagacggtgtcttcatcgccgttgtgacgattgatcgtaagaagaagaagattatctcaaagccaaagattgattcacgtggattcgtttatgtgaagacgtcacgcgatttgattcgcgaggctggtgacctggttgagacgaccgtcgctgaaggtatcaagaacgctaaggaatttgactggggtaaccttaagaactctgttcgcgatgcattgggtaagttcttgtacgagcaaacgcgtcgtaagccagtgattttgccagttatcatggaagctaaccaaaatggtcgtcgtcgcaagcgctcagcaagcaagacgaacgctaagaaggctgaagctcctgaagtaaacaagtcacaaaagcaaaacaacaagccaaagaagaagcagaacgcaaacgctaacaagccagcgcctgctaagaataataataatcaacctgctaagccagctgaaaatggagcggaggtcgctaagaaaaagaagcgccgtccacgtcgtcgtaagccaaaggcaacgcaaggtgaatcagcaccatcagctgaataaaacacaagcgtcgattctaacgggtcgacgcttgtttgttaggaaggatgcatcatgaacgaagaacaaacgcaacgttatgagctgttattagcaaagggaaaagaagcctatgagaatcatgcattcggtccagcactagatgcatttgatgaagcgtatgatttgcaacaaacgccagaacttaatcaattgattacccgtgtgttattagccgatggtcagttcaagacggcgcaattgtttgcggatgaattcattgattcatatctagaaagtgccgaattggctgaactatatgtcacggtggcattaaagaatcaacaatttatcgcagcgcgagaatttgtaacctgggttgcaccagatgttgctacaccattaacaacagagattgagacggccgaagaaacctttagaacagaacaaaaggcgacattaaatacaattgcgcgccaattctatcatttgagcgatggggatgctatcaatcaaaaggaacgcctgattgcggctgacaagctgccattacgcgaatacctggttggcgcacgctttgcattagttgatccattcctgccagccattgcgcgggtaacggttttggataagttacgtcgtttgcaggtaactgagtcggtagacatgacctggttagacgaaaaggtaatgacaatcgtgccaaaggacctgcaatcactagatgaaatgccacttttccaaacggtggtggcgacattgtcgggttatgaacatgaatttggcccagctacggtacatgccttagttgaacaagcacgtttaatgttgatgattgcttatccagcgattgatcgggttgttgagaatccgcgtgcttgggcagcaggcttaatggccgaagcaatgggggaaaatgccccaacggagccggttgagcaacaatcttggcgggcgaaattagggcaagaaatgatgggattaatgccctaaaaaaactaatttgaaattgatagtcgaatttaggtaaaaaatatttacaaaaatcgccaagttatatataataattccagtctcatatagagaaattacaaagattttcgcaccaagttgttttagttctgtaaggaatgtagtataatactatttaagcaataagggttagcccatttaagggctaacatgcgaatattaggaggacaagcttttggctaaggaaaatttcgagcgcactaagcctcacgttaacattggaactatcggtcacgtcgaccacggtaagactactttgactgccgctatctcaaaggtattggctgacaagggattggctgagcaacaagactttgctgctatcgacgctgctcctgaagagcgtgagcgtggtatcacgatcaacactgctcacatcgagtacgagacggaagctcgtcactacgcccacatcgacgcccctggtcacgcggactacgttaagaacatgatcactggtgctgcccaaatggacggtgctatcttggttgttgcttcaactgacggtcctatgccacaaactcgtgagcacatcttgttggctcgccaagttggtgttgactacttggttgtattcttgaacaaggttgacttggttgacgacgaagagttgattgacttggttgaaatggaagttcgtgaattgttgtcagagtacgatttccctggggacgatattccagttgtccgtggatcagctttgaaggctttggaaggtgacgcagaacaagttaaggttatcgaagagttgatggacattgttgactcatacattcctactccagagcgtgacactgacaagccattcttgatgccagtcgaagacgtatttacgatcactggtcgtggtactgttgcttcaggtcgtatcgaccgtggaactgttaacttgaacgatgaagttgaaatcgttggtttgcacgaagacgttcgtaagactgttgttactggaatcgaaatgttccgtaagtcaatgcaacaaggtcaagctggtgataacatcggtgcattgttgcgtggtgttgatcgtaaggaaatcgagcgtggtcaagttttggctaagcctggttcaatccaaacgcacactaagttcttggccgaagtttatgttttgactaaggaagaaggaggccgtcacacgccattcttcactaactaccgtccacaattctacttccacacgactgacgttacgggtgtagttcaattgccagaaggcgttgaaatggttatgcctggtgacaacgtaacattcgatatcgaattgatcgcaccagttgccatcgaaaagggattgaagtttacggttcgtgaaggtggacgtactgtcggtgccggaactgtatcagaaatcaaggactaattttacggttaacgtaaaattttccaatgtagcttaggctgctcaaaaaagagagttatgacatattcgtatgtcataactctctttttgtttactcaggcagattgttgggactttcgtctcgtgaatggtattctgacggaaattactaggtactgggggaaatgaccatggcgagaccaaagacaaaagcagagttgttaactgcatcagaacagcgatttgagaagatgtggcagttaattgatgccatgccggatgaagaacaagcatccacctttgcatttggtgcagagatgggtaaggaagcgcactggggacgcgataagaatatccgagacgtgctggttcatctttatgaatggcaccagctactactgcggtgggtgaatgccaatctaaatggtgatcagaaaccaattttaccggcaccttataattggaaaacgtacggtgagatgaatgttggtttctgggaaaaacaccaagagaccacgttagcagatgcgaaggtcatgctacatgacagtcatgacaaagtaatggcacttatagcagagttttctgatgaagcattgtttaccaaacaatatttctcatggactgggaccacgacgctagctagttattgtatttcagccacagtcgcacactatgagtgggcaataaagaagcttaaagcacatcagaaaacttaccaggcgtcatgactggtatgacaaggctcttggcattcacatgaattcaagagccgtttttctgcaaattttgttgctcacgaccaacgcaaatgtgatagagtagcttatacacttttttcaatgaagaggagctttaaacaatgcaaatttatttggcagcaccattctttagtgatgagcaaattgatcgtgtcgcacgtatcgaagcagccctagaggctaacccaacggtgactgatttctactcaccacgccaccaccaaaagacagataacccagaatacacgccagcatgggctgcagaagtattccgtcgtgatgtcacacaagtgttggacgctgacgcattggttgttgttgctgatttccgtgatgatgatgctgattcaggtacagcctttgaagcaggtatggcatgggcattgaagaagcctgtaatcatggttgaagagacggactacaagactaacttgatgttgacggagtcattgacggccttcgttaacaaggctgaagatttggcaacttatgactttaagaactacccagagtcaaagtttgaaggtcaacttttctaagttcgtttttgtcggaaaaatgtcgtgttttggcctacatttattgccaaataacggtttttccggtaaacttataaagtatgtaaagataatatatgtcgtcggtctttaaccggtgactattggaggaataaacatggcaaacgcagttttcactaagggtgaaggcaacaagggaacgatcaagttcgaagttcctgttgacgtatacgaaaagggtatcgacgccgcatttaacgacgttaagaagcaaattacggttcctggtttccgtaagggtaagatgcctaagcaagtctttttccaaatgtacggtgaagagtcattgtaccaagacgctttgaacgttgtattgccagatgtatttgctgatgcagttgctgaagcaggtgttacgactgttggtcaaccaaagatcgacgcagagtcaatgaacaagggtgaagcttgggttttgactgctgaagttgaattggcaccagaaatcgaattgggcgagtacaagggtgttaaggttcctgcatcagacgttactgtttctgatgaagaattggacgctgaaatcactcgtttgcaagaaggtcaagcagaattggttttggttgacgctcctgcaaagaacggtgacacggttgttatcgacttcgttggttcagttgacggtgttgagttcgacggtggaaagggtgagaactactcacttgaattgggttcaggctcattcattcctggcttcgaagaccaattggttggtgccaaggccgaagacgttgttaacgttaacgtaacgttcccagaagaataccaagctgctgacttggcaggtaaggacgctttgttcgttgttactgtgcacgaagttaaggctaaggaagttccagctttggacgacgagttcgcaaaggacatcgacgaagaagttgaaactttggcagaattgaaggacaaggttaaggctcgcttgacgacttctaaggaagacgcagctaaggatgccaaggaagacgcagctatcgcagctgttgttgacaacgcttctgttgaaggtggtcaaattcctgactcaatgattcacgaagacgttcaccgtcaaatgaaccaattctttgcttcaatgcaacaacaaggtatctcaccagagttgtactaccaaatcactggttcatcagaagatgatttgcacaagcaatacgaagaaggtgctgagcgtcgtgtaaagacgaacttggtattggaagctattgttaaggcagaaaacatcaagccatcagctgacgacattgctgctgaagtaaagtcattggctgaccaatacggtatggacgaagctgctgttcgcggtgctttgtcagacgacatgttgtcacacgacattgctatcaagcaagttgttgacatgatcgttgataacgctgttgaagcttaattcaattaaacgttaaacaaaagaggttagactttttcgagtctaacctctttttgcagtgttacactatataaggtctaagaatatcgtattaaaaaacacaaaatctctggtacaatagtaggtaacttacgtttagtctaacgtttaaaaacttacaggaggttgaacagtgtttaatacaaccgataattcaaacggcattgcctactgttcattctgtggtaaggcttctactgaagtgaagaagcttatcgcagggcctggcgtatacatttgtaacgaatgtgtggctttggcacaagatattattaatgaagatttgcaacaagatgcattggagcgcacattgactttgaaaacaccacgtgaaattgtcgataacttgaattcttatgttatcggacaagacgaagctaagcgtactcttgcagttgccgtctacaaccactacaagcgcgttaacgcgatgttgacgggcgaaactggggctgaaggtgttgaactgcaaaagtcaaacatcgccatgatcggacctactgggtctggtaagacgtacatcgcacaatcaatggctaagctattgaacgtgccattcgcaattgcggatgccacgactttgactgaagctggatacgttggggaagacgttgaaaacattcttttgaagttgatccaagccgccgactacgatgtcgagcgagctgaaactggtatcatctacatcgacgaaattgacaagattgccaagaaggccgaaaacgtttcaattacccgagacgtttctggcgaaggtgtgcaacaagcccttttgaagatgctagaaggtacgattgctaacgttccacctcaaggaggacgtaagcaccctaaccaagagttcattcaaatcgatacgacgaacattttgttcatcgtcggtggtgcctttgcgggtattgaacaaatggttaaggagcgtgttggtgcgaaggttattggattcggaacggattcaaagacgcaacaattcaacacgtcagacaagtcaatcatgcaacaagttgtgcctgaagacttgatgagctttggtttgattccagaattcattggtcgtttgccaattttgacagctttggaagaattgactgaagatgacttggttcgcattttgacggagcctaagaatgctttggttaagcaataccaagctttgttggccctggaaggtgttgctttgacgttcacgcctgaagccttgaaggcaatggctcacttggcaatcgagcgtgagacgggagcccgtggtttgcgttcaatcatcgaagaaacgatgcgtgacgtgatgttcgacgtaccttcacgtgatgacgtcaacggcgttattattacggaaggtgccgtattgaaccacgagcaacctgaattggtcactgaacaagcataattaaacggaggatttatcatggaagtacacaatgtcgaaatggtaatgtctgccgttcgtgcgagccaatacccaactgatgggttgccagaggtggcttttgttggtcgttcaaacgttggtaagtcatcattgacaaacgttttgattaaccgcaagtcatttgctcgtacgtcatcacaaccaggtaagacgcaaacattgaacttctacaaggtagaggatcaaattttcttcgtcgacgtgcctggttacggttatgccaaggtgtcaaagaaggcccgtgaagaattcgctgtgatgatcggtgaatacttgcgtacacgtgagcctttgaagggaatcgtgcaactagttgatgcccgtcacatgccttctaaggaagacatcgagatgtacaactggttgacgtcagatgacattggcttgccagtgcttgttgttgcaacgaaggccgacaagatttcacgcggtaagtggaacaaggctgaagctgacattaagcgtgggttgcaattcaaccccgatgtttctgattttgagattttctcatcagaaacgaagtatggtaaggacaatgtttgggattggctagaagctcgtatgctagatggtacggacttcaatcctgaagattacgaagactaaaaaattatacccatgtcatttattggcatgggtattttttgtatgtaaaaacagtagattgcaaccgttttcagatgcaaatttgatgaaataagagctattctttgaattcactttcactcggcggtactatttagtcatcgtttaggagggcattcgagtatgaataaagtagttaagggagcagcgcttgcatcagcaagtctaattttgggatcaatcgtggtaccaacggcaacgcaagccgccacatataagacaatcaattggacggagactgcgcaactcggcacgatggaccaagcgaagtcgtctgctgctgttgattttgatgccatgcaagccattggggacggtttgtatcgtaatgataagaacagcacaccacaattggcattggctgaatcagttgaaaagtcagatgatggtttgacatatactttcaagcttcgtccaaatttgaagtggtcgaatggtgatgcattgacggccaacgactttgtttatggttggcaacgtactaataatccaaagacggcgtcaacgtatgcctacctattttcaggtattaagggtgcggatgacattcagtcaggtaaggacaagaacttggatgatttgggtgtaaaggcgctcgacgacacgactttggaagtcacgctcgataagccaatgccacagttggaatcaattttgacgatggcaccattcttcccacaaaataaggcgttcgttgaaaaggccggtagcaagtacggtacgacgtctaagtatacgttgtcatctggtccgttcgtcatgaagggttggaatggttcgaacaacaagtatacgttggtgaagaacaagcaatactgggatgccaaggcagttaaaacgcctaagattgtggtgcaagcgattaaggaccaaaacactggttataacttgtacaaggctggtagcgtcgacttcacgaacttgtcgcctgaccaagtcactgcgtcaaagaactcaaaggcctacaaggtgattccatcagccacaacggcttatgtagaattcaatcaaaagaattatccggtctaccagaacctgaaaattcgccaagccatgtcatatgccattgatcgtaagacattggccaataagattttgaccggaacggcaacaccagctacaacgtttacagcggccaagttggccaaggatccgaacacgggtgaagatttcgccaagtcagcagctgtgcctggtgcaattgcttatgacaagaccaaggcaaagcagttgatgaaggaaggacttaaggagactggtaaaaagaagttgtctgtccaattattggctgatgacacagatgcctcaaagcgtatggcccagtttatccaagcccaatggcaaaaaatggataacgtgaaggtgaccatcaaggtggtgccattcaagcaacgtttggctttgtccgaagccaagaagttccaagtggtgattgaccgttggggtgctgactatgctgacccatcatcattcttggatttggccacgacaaattcagacttcaactatggtagctggagtgaccaaacgtatgatgacgccgtgaacgctgccaagacaactgatgtgaacgatcctaacaagcgttacgaagattacaagacggctgagcaacagattgaaaagcaagttggtgtcgcaccactttactaccaatcatctgctacgttgatgcgtccatcagttaagaatgtggtgttgaacccagttggatcaccatatgactggaagtgggcctacaagaagtaactctcattaaatggtatactggtaccgagaagatggctcagctaccgtagaaagtaggtaacgataatgcaagcaaagcatggtacacaaattgtggatgtctggcagatttctgatgatatgtcaccagctgtttgggtgcaagatgcgttcaaacaagggctacttcactgggatgcacgtgaagaaaacaccttgatgcttaatgcaccttggtcagttgccatgggggcgtgcggtgactttctgacgcgtgatggacaggaattgcgcatcgtgaatgaaaaagaattcgaaaaagattatcaggtaatcgataatcaatagcatcgaccggaaagcgctgaaatatcagcgcttttttgctatactggtagttatgaataaacaagaagaggaaagacaacatggcagaaaagacacgttttaaaggcgaaattctaggtaaagaaatcacgattacagctgctgaatcacaagcacacatgaaggctgtttttgaattggctaaccaacaattggaccaaatgaagcaattggcacccaagttgtcagatgaccaactcctaaccttgttggctatcaacgctttgtcagaccaattgaagatgcaagccgagaaggatcacgctgaataatgaacttgctgtcaattattattgcagtattgcttctggcggcggtactacgtggtcgatacttaggtttcgtccgcagtttattgtcactgggcggtcgttttgtggtttacgcagtggctgtcttgatgtcacaccgcttgggaagttggattcacgaaacgtttttgatgacggtacaagcacgttgggcggccaatggggtaccggaatttgtttctgacaaagccaatgaatttttagcatccggtttagcatttggattaatcatgattattggcacgttcattgtgcgttcaatcgagcgtagtttgcgtttcattaaccatgtgcctttgctcggcacggtgaatcgtctagccggaatgctagtttacggccttttagtctacgttgaaatcttctttgttttacaattaacacagacatgggaaatcccttggtaccacgatgcgatgattcagtcacccatcgcccaatggattttgaatcagacaccttacttctcagatgccatctatcaatggtggattctccagtagggattaataagagatattagaggttaagacacatgaataagaaagtcttagcaacccttgagtatgaagcggtaaaggcccaattgcgaccatacctctcaacggctgctggtgaaaatgagttgcgcaacttgttgccaactgcagatgccaacgaaatgcaaacgtggttggcagaaacgtcagacgcagctaaggtgctacgctggcaaggtggtattaacattccaaagttggcggatgttaagcctcacatgcaacgtttgaagattgatgcgtcattgagtgggactgaattggcgcaagtcggacgcgtgttgtttacgacgggacaaatgcgtttgttcttcgaaaacttggtggaagatcgcggtgaaccattggctgccttgcgtccttactacacgcgtttggttgtcatgcaagatttgacgcgtcgtgtgaatacggcgattgatggggatggtcgtgtgaccgatgaagcctcaccagagttgcaccgcgtgcgccaagccattacgtcaacggaaaatgccatccgtcaaaagatgcaagattacacgcgtggcaagtcagcacaatatttgtctgacccaatcgtgacaatccgtaatgaccgttatgttattccagttaagacggaataccgtagtcacttcggtggtgttgtgcacgaccaatcacaaaccggtcaaacgttgtacatcgagcccggtgatgtggttgatatgaacaaccgcttgcgtgagcactacatcaaggagcgtcacgaagaagagcgtgttttggctgaattgtcagctatgttgcgtcctgaagctgataacattcaaaagaatgctgaagttttgggtcacttggactttgtgaacgccaaggcccgttatgctgcggcaacaaagtcacaagagcctgagtacagcccggaaaatcacgtgcgtttgttacaagcgcgtcacccattgttggacccacaaaaggctgtggccaacgatattatcattggtgaagattacaaggccatcatcgtcacgggtcctaacaccggtggtaagacaattaccttgaagacgttgggcttgttgcaattgatggcgcaatcaggtttgttcattccagttgctgagtactcaacagttggtttgttcaaggaagtcttcgctgatatcggtgatgagcaatcaatcgagcaatcattgtcaacgttctcatcacacatggtcaacatcgttgaaatcttgaagcaaattgacgctgattcattggtcctattcgatgaattgggtgccggaactgatccacaagaaggagcagctttggccatgtcaattttggatgccgttggtgccaagggttcatacactgttgccacaactcactatcctgagttgaaagtttacggctacaaccgcgttgataccatcaatgcctcaatggaatttgatgttgaaacgttgcgtccaacgtacaagttcttgttgggaattcctggtcgttcaaacgccttggagatttcaaagcgtttgggcttggatcaaagcattattgatgccgctgcctcattgacgacagaagattcacaagaattgaacgacatgattgccgatttggttgaacgtcgtaacgccgttttggctcaacaagtgcaactggctcaacaagtcatcgaaaatcgtcaaatgaagaacgattacgagcaaaagcttgaaaagatggaaactgagaaggcccgtacgcttgaagaagccaagaaggaagcgaaccacatcgttgccgattcacgtaagaaagctgataagattatcgctgatttgcgtaagatgcaacttgatggggtggccgttaaggaaaacaagttgatggatgccaagggtgctttgaacgccatgcgtcaagaaccatcagctgaaaacaaccgcgttttgcgcaaggctaagaaggcgaagagccaaaacatcgaagccggcgatacggttttggtacgtgagtacggtcaacaaggtacggttaagcgtaagctcaaggacggcaagtttgaagtccagatgggtatcttgaagatggtgcttgctgaagacgaaatcgagaagcaaaacgttgccgaagtgaagtcagagcaaaaggctgcgccaaagccacgcgttaacactagcaaggcagttaaccgtgcgaacgcgtctgcaacgcttgatttgcgtggacaacgctatgaagctgcgatgagtgagttggatcaatttattgatcgtgcattgctaaacaacttgccttccgttgaaattattcacggtaagggaactggtgcaatccgccaaggtgtgcaagaatacttgcgttcacaccgtgccgtgaagaacttcaacttcacgggtcctgatcaaggagccacgtacgctgaactaggttaataaaatatgacgaaggctagtaacgacttgttactagcctttttgctataatcaatttaatgatgtaggcgtggtattgagggcatttgtatggaatggatatggacaacgcaggaacagcatcgactttctgtgttccgttatatggttagaaataaagtgacacgattgtctgacctgatggcagaatttaaattttcacgttatatggtgatttcggtagttgatcaattgaatgaagacattgcccgattaacgggtcaaacaggtgtgttggtcatcgaaaaggggaatgtaattgtatttgatgcgccgttaaatctgctaccgatagatgagttgaaacaatattatttgtcaaactcaaccagagcacagattattgaacacttaattgccgaagattttgagtcgtgggaagacttggcatttgatttaggaatttcaacgcccactatctataaagaaagaacaattgtgcaagaaaatcttgcagttcagggtatcgaaataaccaaagattatcgattagtagggcaggaggaaaatattcgatttctaacctttgccttattaacggtctataatggccaacgtacggccgatgttgccgatgagattaaaaacgccgctaattactatattagtcatgtcatagcgccaatatttggtgagttaaaagactcccagattagtattatttggcatatggccgcgatttggacgaatcgtttttcacaacggcacttcgtttctagcggttttaccaaccagtatctaaacgccacgactgaaatgtctgaacaagcgcaacgacttctaaaacacttgaaagttttgatggctcggaatggccatatgtctgatgaagaattagataatgaggcgcgttttattatcttaatcttgcatagtttaggactattttcgaccattcaaaccgcgcgagatgtcacgcctactgtaaagcaatgttggcagcggtttgatgagagcattcaaacgagctataaatgtctgttccggttgtcgatgacacctgttgactccagaaaattaacgtatagtgtcgggcatacactatttcaatttttaatctatccatttgggattagttcagggatttatgatttacaacattttgaagaattttcagaacgatacccactggcgtttcagctgggcactgaaatattgaatgattttgcgcaaaaacaagaactcgattctagtaaactgaaaacggcactcttaaccgaccttgtctcagctttggcaacaggcgattatatttaccaaagcattccaaaggtcaatattgtgttggactttggtaatcatgtgaatatcgaaaatttgctactggaccagttcggaccggtaaccaaagcaaagattgcgacgtcacataggttggacaatcaaacagatatactgttaacagatgtccctcggaaaccggtgactaatgaactagtgtacgtttggcaaggaattgaatctgatcgttatcttaatcagctgattgcagatattaatcggattagttccaaaaaatttaatgcctggcgacgacaaaattaaatatgagaacaagcttcattattggacgttaatcgtttgatatgaagcttttttcattattaaaagtctgataaataggagtttttctattttttcggtctttttttaaaacgaattttattaaagaccgtgctgaaatatgcgaatatggttatcgtttacttttagtcaacgaaaggagatggcgaatgtcgacaagaaaaaacttaattagtcggagtagattttatatttttggattcgcaacagccttaatcatactcatttggtgggccagtctttattccagcgtggtgcaaatcgcaacggcattattagtcctgttaggcatattttcaagtttgattttgccagggttacttatcacctggttaggattgatttatttggttgttggtgtgttaatgctgatgattggatcatttgtcatgggaataccagaaaaaatactcttgttaatcgcgtttccggcatcgctatttttgacgaacgggcgtcggacaattgtcggtgacttaagttggttaatggctaatgaacaacacgtcgcgtcatttactaagaattatcaccctggtttgaatctccagcgctcatataatgccaacaagatttttgaaaagtcagtcagtcgtttcggtacataccctggtttaaccaaggtttgcgtggacgtgactggtattcaatgggcgcacagcgaacagtaccgtcagtttaatgccaatcaatatgatgccgtgatacacgcagtagcgggtgaattgaagcaaaagcgattgccatctgaatttctttatatattagatgatgatatgtttttgattttgtcatttaggctgccgcgagaaacttttactggtttaactgatgagacgaagatggcattgtcagaaatcatggttggcgattacaaaccccaatttcaatggggacatacgttgattacagaggataatgctgaaaaataccaaacgttaccagatgcattgaagcatattcgtcgtgagatggaaacagatcttgtaacggaatatatgaaaaaggagagcgaccatgattaatatctttttttggattgcactagtagttagtgttgtatttttggtgcttgcggcagttttatttgttgcccagtggaccatttattcccgcgtagaagcaacgatgtgcaagttatggggacaagaaagtgaggcataatgatacaccaatttctattgattacaacgttgttttcgatatggttgtcattatcgatggcaatgattacgctgttcggggccgtccacttttggcttaaaaacagtacaaaagagacggaaattataccgttagagcgttaccccacgatatctattgttgtcccagctcacaacgaagatgttgttattgcgcaaacgatgacggcactcctgaacctgaattatccaccagaaaaggtggaactactgttgtattcagacaattctacggatcaaacggcggctgagatgcgtcgtattaaaaagttgcctgagaatcaaaatcgcaacattgtcatcatcgagcgaactggacaaggcggtaaggctggggtgttgaacgattccctacaggtggcaacgggtgaattcatcgcagtttatgacgctgatgccatgccagaacggaatgcattgtacttcctggttcgtaaagcattagaagatccggagcgtcatgtggctgtctttggtcgtaacaagacgcgtaatgcggaccaaaatttactgacgcaatttattaatcaagagattgttgtgacgcagcgcatccagcatattgcaatttggcatttatttaagattggccgtattccaggtacgaactttattattcaaaaagattatgtgactgaaattggtggatggcgtgatggtgcgttaacggaagataccgatatttcattcaagattatgcagagtggcaagctaattgctttggcttataattctgaggcatttcagcaagaacctgagcatatccgagattactatcatcagcggttacgttgggctaaaggaaactatcaagtggtgattaataatattaagcatctcttcgatcggagtaactggcgcgtaaaaattgaaacgttttactacgccgcgactttcttttggtttaatgccgcaattctgttgtcggatatcttatttgcggtaaatgtggtgttttacattgttggtttgttcaatccaacgattacgataccgttcacgtttggcacgacgaatgtcttactggcacaaattttattgtttaattgggtcttgatgattttgttgtatgttttgcagattaacattgcaatgtccacccagttcggtcaggcgacgaccaaacaaatctggttatcattcttgtcgtactttacctatacacaactctttatggcggtttcagtgcacgcagttgcgcaagttatcggcgatagtctctggcatcgaaatggtaatgtctgggttaagacaaagcggtttaatgattagttagtgaggtttaaatggtattacatagaagattatggtgggcagtatttgcggttattttggcgttttcatctattttggtttatgttcgtgtcaataatgaacgggcggttgtacgtgatacatatgaaacgtggcgtgaaacatttgtcgtgaaaaatcatccgggggcaacctatgtgaatgcgggtacgtctaagcaccgggtagcaatgtctgaagcgcaaggaatggggatgcttattactgcgcgtgctggccgtaatggttgggcaaagcaagcggactttgacagtttgcttgcgtattatcaactacatcgcgatggtaatacgtatttaatgagttggcgtcagcaactcaagcaaggtgaatggcgtaatgatcaaaatagcgccactgatggtgacttgtatattgctcagtcgttaataacggcagctaaaacttggcccaaggcagctgatcaatatcgtcggcttgcccgaaaaattgcagctgatattttgcgttatgaatataacgacaccgcaaaaatggtgactgtcggaaattgggcaacttcagatagctgggcttacgatgtgatgcgctcatctgatgtgatgccaactgtttttgatgcgttagctataacgactggtgatgaccgttggcgagagatttcaaatagtatgttagataaattgcagacgttgagtgaccaacatcagacggggttggtaccggatttttctattattgaaaaaaatcgaattcgaccagcccaacgtgacgaagtgtcaactaaggctgacggtacgtacgactataacgcagcgcgagttccgatgatgctggccaacgcaaccgatgcccgtgcccgcaaaattaatgatcgaatgatacacttctttgcgcagcaaaaaacgctggtagctggttatcagttgaatggtcaagcgacaaaaacgtatgaatcatcggctttccaagcaccaattttcaatttggccaccaacgccaacaacgcagatgctgaagtgctgtatcgcaatacgaagaatattttgaacaaatctttggcgcaacaaccttattatgatgcaacaatcacaacactagttgctgtaggaggatttaaaaatgattaaagtaatgactgtttttggcacccggcctgaaggcataaaaatggcgccagttattaaggcacttgaaaatgatgatacagtgacaccagtaacggttgttaccgggcaacatcaagaaatgttgcagcccattttggatattttcgatgttaagccggattatgatttggcaattatggagcctaagcaaagtttggccaaaattacgagcaaagttttgttagggatggatgacattttaacagccgaaaaaccagacgtcgttttagttcatggtgacactagtacgacactagcaaccagtatgagtgcatttttccatcacatcccggtgggacacgtagaggctgggttgcgaacgtgggataagtactcaccgtttccggaagaaattaatcgccaaatgacagatcgcattgcagatatgtattttgcaccaacgcgattaagtgccaataatttgattcaagaaggtgtcgagacagataatgtttttgtgaccggaaatactgtgattgatgccttgcattacacgttacataaagattataaaaatcccgttttggaccaaattcatcccgaacaaaaaatggtgctattaacaatgcaccgacgagaaaatcaaggggcgccaatggctcgtgtctttagagcaattcgggatatcgtgtttgaaaaccctgaagttgaagttgtgtatccagtccacttgagtccagctgtgcaatcagtcgcgactgaaattttgggtgatattgaccgtgtgcatctagttgaaccactagatgttgtcgattttcataatttagctgcccgcagttatctcattttaacggattcaggtggtattcaagaagaggcgccttcattaaatgtaccggtacttgtgttgcgagatacgactgaacggccagagggagttgatgccggtacgttacgattagttggtacggactaccagacagttaaagctgctgttgaaggactcctgcatgatgagacgcagtatcgtgacatggcagataatacgaatccttatggtgatggccatacagctgaacgaattgtgcatcttattaagcagtttatgatgtaagtgtgtttaattattaaacacgtaataaaacataccgaatccaggtgtttatatcagtttttcatttaagagttagttataataaccacaaggaactaactaaagggagtatgaaattatgacagaagcaaatttggatacgaaagcattgttggagaagtacttgcgtgattcacacgttttgaacttggcaacatctgttaacaaccgtccatcaaaccgtgacgtcttttacttgacgcccgatgagttgacggactacatttacatcacaacgacgcgcaactcaaacaagatggccgaaattgaggctaatccatttgttgcgttcacgacggtgccaactgatgaggacaatggggtagtcacatcaaacaaggctgaaattcatttgacggacaagtcaattgatgacgtcgccgaattgattgaaaaccaaattccaaattggatggatgttgctggagaagcaaaggacagtttcgttgtcttgaagttgtcattcagctcagttaagattttcggtgatcaaggcattagctctttgttgttgaacgaagagggtaccgcacaagaaacgctgtaagtattgatatgaaaggttgtccaatcgggcaaccttttttctttctccgggatgtttcgcaaattaggcatatgtattcggtacagtaaaagtattaagacatagggagagagtgttatgccttttacgaaacgaattattgctgggtcaacgttaatcacgctgttgccaatcatattcggtgccatgctgtatcatcggttgcctgatcgcatgccaacgcattttgcggcggacggatcagtcacagagaccatgcccaagttggtagtggtgttcggcttgccattggtttttgccatcattaatgtgattgttttggtatttgcgaatgccgacccaaagaataaacacttaactagttttccggttgcaattatcgcgagcctgattccgtttattacggtcggaacgatgttgatggttgatgtcttagcgctcggctaccgggtccaaatcacaacggtggtgatgttcatcttagggattgtgtttatcgcgattggcttggtattaccgaaagtggataccagttacacgattggtattcgcacgccttggacgctgtcaaaccgcaataattggcgcatggtgcatcgtttaggtggtcgcttgttcattggtgccggaatcttgctattcggctgtgcgggctttaatcacacgccaattttcttaacgattctggctatcattattttgatcgttgtcatcgtcccaattgtctattcatatctgctttggcgccaatctaatcgttaattaaggatgctttggtgctatcattaatctcatgaaagtagggtatgggatatgtacgtattgttaattatcatagggttgttatttttcgttggtgggttatatcgagccataacgtgtctctttgcttggcagctgcatgatgcgttgatgggtctagccggcaccggtataggtattgtaatcttagtcgtactgttcatcgctggcatactctttgattggctacctagcaacagtgatggcggtggtgatgatgatggattgccgattattatggaagaaatcatcgctcacgaacacaagtttgatgaccatgatagtggggatgattcatcggaaaacactgattaaatgcctattcgacaaatcggacacttggcgttatactaaccttacattagaaaataatgagggaggaacgctaattatggcagttcaagatattacggatgcaacattcgaacaagagacaaatacaggggtaacgttgacggatttctgggcaacgtggtgtggtccttgccgcatgcaatcacctgttgttgaaacggtggctgaatcaatgcctgaagtaaagttcaacaagatggatgttgatcaaaaccctgccacggcgcaagaatttggtatcatggcgattccaacgctccttgtaaagaaggacggcgaagtggttgaacgtttgactggtttcacaccagcccaccaactagaagcaattttggcaaagtacgcctaacgattaaaagagatgttcattcatctcgttttttatttagaccagttcacggtgtggactggtcttttttattagcaagccatctagttgtactgacaaataatcagttagaagcaaagcaacaatgtgaaagtctgaaattgtacgcacaataaaaagtgcgctctcaacaaaaacgttcgtgaattacgtaacaatcacgatataaaatgcctaaaacacaagttattcccgacgtttggacgaaaatttgacctttggaactaatttgagacgattttttgacgccagcgaaatgaatcaattgtccgtatgacatatttggggttgttttatgttgtccggacgaatagaataaaacttgtaaagaaagcgctttcttgtattgcctgataaacaccattcgcgcgtcagggaattttaattatttagacgagaactaatttaattagttgtattaggtggagtaaaaatgacagaaaaaaagatttcaagtaaattcatttacttcttcggcgcgttcgggggaattctatttggatatgacattggtgttatgacgggggccttgccattcttgcagaatgattggaacttgcaaaacaatgcctcaatcatcggttggatcacatcatcattgatgttgggggcaatcattggaggcgctttggcgggtcaactttctgacaagcttggtcgtcgtaagatggttttgattgcagcggttttgttcgcagtattctcacttgcatcagctttgtcaccacacgatggtcaatattacctgattgcagttcgtatcttcctgggacttgcagtcggagcggcatcagcattggtgccagcgtacatgtctgaaatggcgccagccgcagttcgtgggcgtttgtcaggtattaaccaattgatgattgtttcaggtatgttgttgtcatacatcgcggactacgcattgcaaggtttgcctgaaggtatggcatggcgcatgatgcttggtttggccgctgtgccagccgttatcttgttccttggtgtgctacgtttgcctgaatcaccacgattcttggttaagcaaggtaagttgcaagaggcacgccaagtgttgagctggattcgacaaccagaagaagtcgaagcagaaatgcgcgacatcgaagatacagccgctggtgaagctgctgtaagtaagtcaacgtcatggggaacgttgtttacaggtcgttaccgttacttggtgattgctggaattggtgttgccgccttccaacaattccaaggtgcaaatgctattttctactacatcccattgatcgttgaaaaggcgactgggtcatcagcaagttcagctttgctttggccaattattcaaggtgtgattttggttatcggtgccttggtttacatggttatcgccgataagttcaaccgtcgtacgttgttgactgttggtggaactgtgatgggattgtcattcttgatgccagctatcttgaacgccatgatgcctaacatgggcccaatgatgattgttgtgttcttgagtatctatgtggccttctactcagcaacttgggccccattgacttgggtgttggttggtgaaatcttcccattggctatccgtggtcgtgcaagtggtttggcttcatcattcaactggattggatcattcttggttggattgttgttcccaattatgacggctgccatggcgcaagaagctgtgttcgctatcttcggaattatctgtgtgcttggtgttgtcttcgttcgcgtggcagtgccagaaacgcgtggtcgttcattggaagaaatcgaacaagttggtgctgcccgtgccgctcttaagggtgaaaccggtgtggcagaaggacgcgaagcctaggctacagtgaggattcacatagttagcagagaaataggagagagttatgactaataacgatattaaaacagttatcaatactggccaagccgcccttggtattgaatttggttcaactcgcattaaggctgtcctggtagcgccggacttttcgacgattgccgtgggtagccacgaatgggaaaacaagcttgaaaatggtgtttggacatactcactcgaggatatctggtcaggtgtgcaagatgcttaccgcgatatggcggatcaagttaaccagaattatgcgacagtgattcgtaatctatcatcagttggcttcgccgccatgatgcacggttacatggcatttgataagggtgataacttattggtgccattccgtacttggcgtaatgccatgacggctgatgcagccacgcaattaacgacgttgtttgatttcaacattccgcaacgttggagtatcgcgcatttgttccaagcaattttgaatcaagaggcccatgtgaaggacgttgccttcatgacaacgttagctggttatgtgcactggcagttgaccggtgaaaaggtattgggtgttggggatgcttctggtgtcttcccaatcgattcacaaactggcgactatgatgaagcaatgattgataagttcaatcaattgaaggcggtgcaacagtaccactggacattgcgcgacattttgccaacggtcaagatggctggtgaagttgccggacgtttgactgatgaaggtgccaagctattggatccgagtggtttgctgatgggtggggcaattgctgccgctcctgaaggcgatgccggtacggggatggtctcaaccaactcggttaagcaacgtacagccaatgtttcagctggaacatctgccttcgctatgattgtgttggaaaaagcgttgtctgaagttcacgaagatattgatatggttaccacgccagatggatcagccgtggccatggttcacgccaataattgcacgtctgaaattaatgcttgggcccgcgtgtttaagcaattctcacaagcaattggggtagatatcagtaacaacgacttgtacggggcattgttccagtctgcattagatggccgtccagatgctggtggtttgttgagttacggctatcactcaggcgaaaacatcactggtgttagcgaaggtcgcccattgtttgttcggacgccgaatgctgaattcaatttaccgaacttgatgcgtatgcatattttctcagcctttggtgccgtgaaaattggtttggatatcttgaagcaagaagatgttgcaatggactcagtcgttgcacaaggaggcatcttcaacacgccggtagttggtcaaaagctgttgtctgctgtaatggatgcgccggtaacgttgatgacgaacgctggtgagggtggtccatggggaatggctgtcctaggtcaatatgtaacaatgtgtcgtgaagatgagtcgctggcggacttcttggaaaagcgtgtgttcgctaaccaagacagtacgacgatggcacctgatccggtggatgtaactggttttgaagaattcatggttcgttataaggcaggaattggtatcgaacaagttgccattagtgcgttgacggacgaaccggtagttgtaaaagaagaggagcgtgatattcatgttggagaacttgaagcagcgggtgtatgacgcaaacatggctttgccaaagcacaatttgattaagttcacttggggaaacgtatcagaaattgatcgtaacagtgggctctttgttatcaaaccatctggtgtggcttatgaagatttaaagcctgatgacatggttgttgtggatttggatggcaatgtggttgaaggtgatttaaatccatcaagtgatacggaaacgcaccgtgtgttgtatcgtgagttcccggagattggtggcattgtgcacacacactcaccatgggcagtttcattcgcccaagctggggttgacattccggctgctggcacgacccatgcagacacgttctacggggatgtccccgcaacaacattgctgacggacgatgaaattatgggtgaatacgaacttgaaacgggaaacgttattgtgaaaacgtttgaagatcgttgcatcgatccagtcgaagtaccagcggtattggtacaagatcacggtccatttgtttggggaccaaacgctgccaaggcagtctacaactcagttgtgttggaagaagtcgcacagatggcttaccacacgatgatgttgaatccgcacaatgtgcacatgtcacaaacgttgttggataagcactacttgcgtaagcacggtgcaaacgcctactacgggcaaaacacggcgaagccggttgcaaattaaaattagcgaaaatacttaggggattaatgattatgtttaacgaaaataactacaagttctggtttatcacgggttcacaattcttgtacggacctgaaacgttgcaagaagttgaagcgaacgctaagaagattgtagatggcttgaatgcctcaggtgtattgccatacccaatcgagttcaagttggttgcaacgacgtcagaaaacatcgcagcaacgatgaaggaggcaaacttcgacgactcagttgccggtgtgattacgtggatgcacacgttctcaccagctaagaactggattcgtggtacgcaattgttgcaaaagccattgttacacttggcaacgcaattcttggaagaattgccatacgagacgattgactttgattacatgaacacgaaccaatctgcccacggagatcgtgagtacgccttcattaatgctcgtttgggtatcaacaacaagattattgctggttactggcaacatgatgacgtgcgtcaagaaatttcaaactggatggacgtagcggttgcttacaacgaatcatttaagattaaggttgtgacgttcggtgacaagatgcgtaacgtggctgttaccgacggtgacaaggttgaagcacaaattaagtttggttggacggttgattactgggctgtcggtgatttggtggaagcggttaacgccgttaaccctgacgacatcgacgctaagtacgctgaattggtacatcgatactgcttcaatttgaatttctttcgagaacataagaaaaccccatgagttagatttactccaactcatggggttcagttcaccaatggctttttgtcgttagttgttaatataaataaaatcagcagcgtgttgcgtaatttgcacctcgttttgtccgtccgtcaaaacaagagggccatcgaatggcaaacgttccttgattgtccatgtgctaccaagggttacaccaactgtctcaacatattggagtaactccaagtcttcggtaaaactgtttagcgttacggtttcgccgtcattagctgcacgcaacgtgcgcaacttgtctggttcatagttgtaatttgcgtccggaattagcaacccgtggggtgaatattttggataatccaaaaacttttcaagggcgttaacaaattcatcgtccgcatcgtggtccaagttgtcagcgttgaagtgggcttcagaaattgaaagccccagcttggttgcgccgaacgtttcaatcaaacggtgtgaacgaatcaaacgaagggcagtttgacgacctggttcggtcaacgtaacaccgtaataaggcacgacatcaacttcgccggcttcttgcaacttcgccaacatgtttgaaacggaagaaggcgtgacgttcaagtgatcggcaatttgattgtttgaaatcttgctgtcgtcatcaccgccacttaattctaaaatcgtttgcagatactgcgtctttgatacggattcgctcataatgaaattcccttttacgcttaaatttgtttagtggattaattataacatgatgttacggatataaaagttaagtcctttaaaaaacataaaggtgatttgtcaaaaaataaaatacgggatatgcttgatttgttgatagcgcactggtggtatcaccaccaggttcgaagttttggaggcagacatgcacgaagaggaatttcaccaaaaaaacaagctacacggggaacaaaagctgtgggcactattagacagtgctcgcgaaatcccgcagcaaacggcattattcgtttactcagctgttaagcaatctggctatggtaagcgacaagtattcgttggacgcgtttatgacagttgtgtctatcatattggttgtgacacaatcgagaacgcattcaagttaaagttcagcacaccggatgaacgcaataagttcgccaattcatttgagacggcttgcattgaacaaggtttgtctgttcatcaaagtttctaaagcacacaaaaagaggattcgacgattgtcgaatcctctttattaattacttcatcatcagacgtgacttcatttgctcaagaacggggtggttcaagaagaaataaaggataattgcttgaattggaaggaatataatttgcttcacaccacgtacccaaaggagtgacgtgattgcgtgcggatcagtcataccacccataatcacaatccatagcgtattcataacggcattgacaataaacaagaccagaataaccgtaataatcacacgggcccagctgatgtgctcgcgattatagaatgagaatccgtagatagcagccccgactagcgctgaaagggcgaatccccagaaataactataaccactaatcatcgttgaaataaaatcgttgaagaatgcaacaatcattccccaataagggccgtaccacttggcaatcaacccaacaacgataaacgtaaagccaaccttaacggaagctggtccaaacgtaaaacggccaatgacgatttccaacgccatcaaaattcctagtagtgccaactgcgtcgtgcgcaaacgtggcaatgcgtaacttaatgtcttcatatcgaaaacacctcctaattttatttggagggtttcacctattacagtgaatgtgataatgatatcgcgaacgtatcagtccttcgtctgtggcccacattccgtttccacagcacttaacgcatcaaaatctaccctgcatttctgttacgagttctattgtagaacaacttggctgaaagggatacaaaaagttattaaattgaccaaagtaaaatgtttaacaacgaaagaaaaatgttaaaacgttttatcgttcggaatatacgaacaatattagttgatagaggcaactaatttgcgaattgttggtcaatttgtgaacataagtcgcaataaggggctgtaaaacctttcaaaagttggtaaaatgtttacaacagtatttaacccggaaagagattaatcatgataacaattaaggtacctgcaacgttaggcaattttggacctggggtcgcgtcactaggcatggcgctagacctatcattaacggtcgaaatcattgaagcaagcaatgtttgggtggttgaacacaatctaggggatacgattccttatgatgagacgaattacattgtggcggttgccaagaagctgtatccagatattacgccacatgtgttgcgcgtgacgtcagatattccattgcgccaaggtttgggatcatcaacggcggcacttttggcggcaattgaattggctaaccaacttggtgaactcggtctagatgactacacgaagttgacgttggctgcccgtacggaaggccaaccagctaatgtcacagctgcattgcttggtggtgtcacagccagctacttaaacgacggtaacgtttttgctagcggggtggttgcaccggaataccaagcagttatctacttgcctgagtatcaacgtgacgacaaggcggacaagcccaacgagattgccttagcggatgcaaccgcaacggcagctgccggaaatatgttgttggctgcttggcagtcacaacaattggtattggctggacaattgttggaaaccgataatatccaacgggcagtgattaatgacgtgccagagttgggcaagattcgccaggcatcacatgcccttgatgtctacggatcagtggttgcaggtgatggaccagcggtggtgacgttggttgcaccaaaccaaacccaagatttgttagatgtgctggcttatttggaattgccaggtgaatttaaagtggttgatattgcaggaactgggttaacagtgttttaagaaggagaaggaataatggggaaggcttcaatccgtgacgttgctaatttggcgggggtttcaattgcaacagtgtcacaagtactgaatggcaagggagaacgattctcagacgccacgaaacaaaaggtgttggctgcacgtgacgaggttggttacgtaccaaacgccagtgcccgtagtttgaagcgtggcacgacgacaatgattggggtaattgtgccaagtttgcgcaatccttatttcggtgacatcgtgcaacgtatgcaagaggtgttgccagaaaatgtgtcattgcaaatcatgacagcggaaaccagcacagctgatcaaacagttgaaacattggtggctgcgggagcacaaggcttggttgtggcgagtcaattgtctaatccacctgccgttgcgcgtagcttgcgtcgccgtggcattgccatggtcgtgcttgaaaaccacgatgaattggaagatgcggatgccgtttatgcatcagatacgcaaggtggtcgcaaggcagcagaacacttgattgcattgggccacaagcacgtggtgttgttgggaaaccaagtttacacagataatttgcaataccgtacggctagtttcaaagaaacgatggccgaagcgggtgtgaaggtcagtgaagtggcgacgcgcaatttgaccaagcacgcgggtcgtgcggcggcgatggctgtctcagtcacgcacgccacggcagcttttgccttgaatgatgagttggcgattggggtcatctctggtttgaatgcaatcggcatcaaggtgccagagcaaatgtcagtcatcgggtatgatgatactgattatgcagagttcttccgcccagcgttgacgacaattgaacaaccagtgtgggatattgccaaggcagcattggactcagtgcttaagcgtattgcggaaccagacgcgccacgacaagtttcagcctttgatgcaaacttggttgtgcgcgagtcgactgcaccattagcttaattatggtaagctagtactctgaggaggtgcgccatgacaattttgtttaagcgaacacgcgatttaatagcgaatccgaccggagtaaccgaacataaggcagcaatgtcagcagctttgatagggcaagttgagacattgatggctgatggctggttacctaagtctttggcagcatatgttgaggccgttgcgaaggcacctgagctaaacgatgcgacgatgatggacgtattggaagccaagtggtttgaagcacacagagtgggatcagagctctttacagaaatgttagtagccggtttccaccgtggtagcgcgccagcaactgaccgtttggggatgttgtacaacgttttggggctatatctagatgaaaccaactttgtgcaaatgacacatttgggtctttgggacgatcgtgaagcgacgcctaatttatactacctacaaattaatgatgaagatgaactacaagcttattggcaatttgttaaccgtgttgcttacttgatgcgtttgaagtaccgtgcttggaacggtattcgctctcgttatgcaacgagtcgtttgttaacggcaacgttcgacaaccaattgcgctactatcttggcaagccggtgtctgattttgtacgtgcccaaggctggacacgtgccatgtatgaggcaaaggtgcttgaagagatgggtcacgaggtgctacacccagatgttagcctacataatcgtggcgtagcggatcagtcaaacgtgaaggtggtcacacctgattatcacgttgagttgattttcgattcagctgatcagattgtgtcattgtggcagccgcttgaaacgcatcaagtggttgttgcagatgggtcagtacgtttcgtgcaagatcataatgcttactcacttgatgagttgcaaatgattgccaacacggagtcagctaattatgctggtcaaggtggcgaaattcatgaagcgttggatgttcgcccagctgcccgcaacgcaggtctagaagcaacgttgcgtaattacgcgaagaatcaattttaatcacaaataaaaaccgagaatctgttttaaacaggttctcggttttttgttgttatttagaagacggcgtcgtagataacgcggacggcgtcgttgacttggctggctttcacaccaagcatcaatgaaatttgtgaggcaccttggttgatcatgggcaacgtaatgccggcttcagaaaggggcgttgcgatttccgaaaatgcgccaacccgattttgcatcccttcgccaaccaccatgataatcgcgaaatcatcaatccattcgagatggtccggcgcgatttcagcctgaatttccgcgcaaatggcatcttgaattggttgggtgagctgtgtcttatcaaagataatcgtcatgtcatcgatacctgatggcatgtgttcataactaacgccgtggcgggccaagatttgcaggatacgtagcgtgaaaccaacttccttgttgagcaagtagcggtgaaggtacaacgcagcgaaacgatcatcgctggcaatcccagttactttcgcagggttagaaacttgatccaccggcacaatcatcgtccctggtgcatcgggttcattcgtgttcttcacattaattggtatatctgcctcaataaccggaatgatggcttcatcgtggaagacggcgaaaccagcgtaggctaattcacgcatctcacggtaggtcattgtttcaatcgcagctggtgacttgatgatatgtgggtcaacggcgtagatagctgacacatcagtaaagttttcgtacatatctgcgtggaagccacgcgccaggatggccccggtgatatcagaaccaccacgactgaatgtcgccatcaaaccgtcagtggtataggcaagaaagccgggtaccacaatcaaaccttcgctaggtagattaaatgtggcgatgcggtcgtaactatcttcgttaacgcgggccgccattggtgaaccagagactgtcaaaccaagatcatgaggcgacacaaattgagcgggatgaccgagctcgcggaggacgtaggcaactaattgcgcattcaaatattcaccatgacccatgaaagctgcatataagtagtcgaatgaggggtagtgaacgcgacttaactgtgccaattgatcagataatgaagatagaatctcatttccttctaattcaaaataagtaacgatgtcacggtagcgttgtaaaatctgcgtttgaatatcggtcgtgtcttcgccaacaattgtcagctgcgcgtatgtctttaataaatcagtgactttaatatcttctttgaaacgcttgcctggcgctgatacaacaaggactttgcggtccgtatcggccaacataatattcaaaaccttttctagttgcggtccgttcgcaagggaggatccgccaaattttacaactttcatgattgactccttcaaataatggctaattgacgataatttaaaaagaaaagttctcaaaagtcaacccttgacactcataattctaaggagtattctaatcgtatcttaattattgatagaggttgcgaccaacaagagtagcttaaccgagccggcaccggcaaggacgttaagtgaaaggggcggtcgccgaaatgaattagcgcaactaatttgttgggacaacagttaagagctgttggactgtcgctggaaatcagcggagagctatcgtaacagtctatttgaatgctttttcgagcgatcaactgacagtgcgatagtgccgtcggttgatcgtttttatttgcccgacggacactaaagaaaaagaggaaagcatcatggtagtagcagtcacacgtccgacacgtcttaatatttcgcaagcggcggtcacacataacgtccaacaagttcgtgaaagtgcccaagcgagtttcgtctttttggcagtgaaggccaatgcctatggttttgggttggtgcccatgagtcaagcggccttagcgggtggcgtagatggtttggccgtcgcagttttggatgaaggcttggcattacgtcaagcggggattaccgcaccgattttggtgttgggcattacgttgccacaatacgcaaagttattggctgataaccaagtgatggcgacggttggttcactcgcttggttggaaacggcagctgagtacttgagtcccgatggtccacgcttgcaagtaaatttggcggtagatactggcatgggacgcattggcttccgtgaacgcgccacgttggaaacggcgattacctacttgaaggcccatgatgacatttttgattatcaaagtatcatgacgcatttctctgaagcggattcgacggaggaagattacttccatcaacaattgcattgctggcatgcactaacggatgggctaccaatgccaccgttggtgcatctcgccaactcaggggccgccatgtatcacgctgatgaaatgccaacagatgtgattcgcgctggtacggtggtctacggggttgagccatcgcttggtgagctgcgtgatgatgattacttagaaccggtgatgacacttgaaacagagttggtattcgttaagcgttgccacaagggcgaaggggttagttacggtcacacgtactacaccgaagaaggtgagtggattggcacggtgccggttggttacggtgacggtctaccacgtaaaatgcaaggattcgaagtgattgtaaacggcgagcgtcgaccaattgttggaaagctagctatggatcagatgatgatttcattgcctggtgaattaccaattggcacgacggtaaccattattggtcgccaaggtgatgttgaaaaccgccttgaggatgtcgctgattatgtgggattggcaccttgggaaatttcaactggcttacaagagcgcatttatcgtcaaattacagattagtaggggaaataagatgacaacaccatatgaaacaaacgctgccggccatttgacggttggcggtgtagaagcaaacgaattagcagaacgatttggcacacctttgtatgcctacgatgtgtcagcaatgcgccaacagatgcgtgattttaagcgcgtctttacagaacgccaagttgattatgctgtctcatacgcttcaaaggcctttgccacggttgcaatgtatgaggtggctgctcaagaagggatgcacattgatgtggtttcaggtggtgagatttacacggcccttgaagcgaacttcccgatgagcgatgtctctttcaatggtaataacaagtctgaagcagaacttgtgatggcgattgagaacaatctgggcacgattattgtcgacaacttcttcgaattgcatttgcttcatgatttattggctgaacgtgaccgtgtgcaaaacatcctattacggattacgccaggtgttgaggcgcacacgcacgattacatttcaacggggcaaacggatagtaaatttggttttgatgtgaacagtggccaggcacaagcagcattgcaagaagcgttggctgatccacacttcaatgtgttgggagttcacgcacacatcggatcacaaatctttgatgtgactggtttccaaatggcagccacaaagctggttgatttggtccatgaatggggcttcaatcctaaggttatcaacactggtggtggctttggcattcgctacacggaagatgacgaaccaattccggcatctgatttcgtggcagcaattatcgatacgattgctgagaagacgtccgaatatgggatgccaatgccggctgtttggattgaaccaggtcgttcaattgttggcccagcaggggtgagcttgtacacaattggctcacgtaaagatgtgccaggcattcgttcatacctggctgttgatggtggaatgggtgataacattcgtccggcattgtaccaagcaaagtatgaggcggtcttggttaaccaaccagaagcaccagctgaagaagtcgtgcgcgttgctggtaagtactgtgaatcaggggatgtgctggtttgggagcaggcgttgccaaagacgaaggctggggatgtcctcgctgttttggcaaccggtgcatatggttactcaatggcatcaaactacaaccgcaatccacgcccagctgtggtcttcgttgaaaatggcgaagcgaaggtggttgttgaacgagaaagctaccaagatatcgtgcgactagatcgccactacttataggaagaaagaggaattagcatggcagaattagacgcacaatcaatcattaattttattgcaaacgcacctaagcaaacaccagcgcgcgtgacgttggcaggcgatttgacggatattgtttggccagaaacagtccaggcattcattgaaacacgcacaggaacggtgatcggcgactttaacgaaatcgcaccgtttttggcagcacatgccgatcaaatcacgaaccaacacgtggaattgttggcccgtaactcgggtgtgccattgctaaattacgatggtgtcccagcccgtattgaacccggggccattattcgtgatcaagtcgaaattggcgcgaacgccgtcattatgatgggtgccattattaacatcggcgctgaaattggaccaggaaccatgattgatatgggagctgtgctaggtggccgtgccattgttggcgctcacagtcacgtgggggccggtgccgtactggccggagtggttgaaccagcttcagcacaaccggtgcgtatcggtgacaatgtgttgattggcgcgaatgcggtggtaattgaaggggttcaagtaggtgataatgcagtggttgcggccggtgcgattgtcacgaaggatgtccctgcgaacacagtggtagctggtgtgccggcccgtgttatcaaggaaattgatgcacaaaccagcgccaaaacagcactagttgacgcgttgcgtaacttagattaatgaaacaggggcagcatatgacgacactagatttaatcaaaattcgacgtgatttgcataaaatccccgaactagccttacacgaaacacaaacgcatgcgtatttgaaaaacgtggttgaaactttcgaaacggacttcatgacgattcgagaaattcctgaggtgccaacggcactgttggtgcgcttggctggcacaaatccgacgcgcaccattgggtatcgtgccgatatcgatgccttgccaatcaccgaagcgacgggattgccgtttgcctcaacaaatgaaggtgtgatgcacgcatgtggccatgacatgcatatgacagtgggtctaggtgttttggcatactttgccacgcatcaaccaaaagataatttaattttcttctttcaaccggctgaagagtcagattatggtggacgacgggtttatgaaacgggagcctttacgggagactggcgacctgatgaattctacggcttgcatgatcatcccggcttacctgctggtcaaattgccagtcacatgggcacgctgtttgccggaacgacggaaatccacgtcacgtttactggacgcggtgggcacgccgcgtttccacatcaagcgaccgatgcgattgtagccggggctgcatttgtctcagcaattcagacgattgtgtcacgtaatgttgatccggttcgtggtggggtcgtcacgctgggcactttccacgctggaacgattggcaatgtaattgccgaaacggcgcacctggatggcacgattcgtgcgttccgccaaacggacattgaaatgatgcagcaacgcgtgcgcgacatcgttgctggcatcgaaacgatgtatggtgtgactacggacttgtcattaatccaaggtggctatttaccggttgaaagcgatccaaccacaacgcaattatttattgattatatgaccaacgcacctgacgttgattacacggatatcgcgccagctatgacgggggaagattttggttatttattacaccaaattccggggacgatgttctggcttggtgttgatgatgccacccacagtttgcatgaagctggcttgtcgccaaacgaggcggctattcaaccgggcgtgaatgcaataacgggttacttaacatggcgcatggcgcattaggggaagagtgatgtacgaaaatattgaattaattaccgcaattattacgccatttacggcgaatgaccaaattgattatgtggccttagaccgactagcagatcggttgttgcatgatgggacgcaaggttttgtcattggggggacaactggtgagtcaccaaccctaacgcacgatgaaaaaatcgcgttatacacgcatttcgccgcccacattgggaatcgcggtgtggttgtggctaacgttggtgacaataacacggcgcattcagtggcgttggcgaaggaagtcagcgccattcctggtgtcgatggtttgttggcagtgacgccttattacaataagccaagtcaggcggggatgattgcacactttacagcgattgctgacgccgcaagtgtgccagtgatgttgtacaacattccgggtcgttcagcggttggactaacgaacgaatctgtcgtgacgttggcccaacacccaatgatcaacgcagttaagcaagtcaccacgattgatgatttggcatttttggttggtcacacaccagttgattttgcggtctacaccggagaggacgcacagacgttggctgcgaaagtggttggtgcaacgggaaccatttcagttgctgctcacgtatatagtcgcgaaatggcggacttgtttgcggcagttgcggacggtaatatcgaaacagcaggacgcttgcaacgttggttaacgccacgtatgaacgcgttcttccgttacccatccccagcgccagtcaaagcggtcttggcgcaacgcggtgaaattgaaaacacaacgcgtttgccaattttgccattaacggacgttgaattggcggatgtgcaagcgacatttaatgaaaaggacgattaaacatgacaacagttttattagctggtggctttggcaagatggggctggaaatccagtcgctcatcgctgaacaacccgatttagaattagtgggaattctctcagcaacgcttcatgaaagtcccatttccgtgtatactgaactggacgagatcgatacaccagccgatgtttgggtggatgtgacgcaaccagaatcagcctttgataacgcgacttatgcattgtcccatggttatgatttggttgttggtaccagcgggttgtccgctgaagacgtgacgcaattgggacacttggcacagaagtataatcgtcatgcgattattgtgccaaacttctcattgtcagctgttttgctcatgcaatttgctgagcaggcagccaagcatatgccggatgctgaaattatcgagattcacaatccgcataagttggatgcaccatctggtacggccaaagcgacggctacaaaaattgcagctgcccgtgaagctgaaccggtggcacaacgccaacatgatgcagcacgtggtgaagtcattgataacgtgcccgtgcacgccgttcgtttgccaggctatgttgccgaagaagaagtgattttcggtgcgccaggtgaaacactacgtttgaagcaaacgtcatttacacgcacatcatttatggggggcgttgcgttagctattcgtcaggttcatcaaatcgatgggctggtagtcggtctagaacacctattgtaattgttgcccaagtccagcgaggcttaagaaaaaagaatggcctgagagccaaaggagactgaaatgccagaagtaaatccagcccttgcaaaccgttataacaaggagcttgccaagattttgccatcaccaatccgtgtgattgatcaaaagttttcagccattgatggcatcatcaagttgacactaggtgagcctgattttgcggtacctgatcacattaaggctgctacgaaggctgctattgatgctgatgattcacactacgccgcaccacacggtcacttgagcttgcgtgaggcaatttctgattacttagtggagcgttttgatgcgccacgttacaacccaaacggtgaagttgtcgtgacggttggtgcttcagaagcattgtttgcaacgatgaatggcttgttgaacgcgggggagaagattattatcccaacgccaacattcccaatgtatgaagcgattgctgacattatcggtcttgatgttgtgggcattaacacagcacctgattttgtgttgacgccagaaaagttggaagcaacgctggctgaaaacccagatgccacggctatcttgtttaactacccatcaaacccaactggcgtgacgtactcagctgagcaaatcgaggcaatcgccgcaattctaaaggctcacaacatgttggtcttctcagatgagatttacgctgagttggtttacgatggtgagcacgtttcaatggcatcattgctaccagatcaaacgattttgattagcggtttgtcaaagtctcacgctatgacaggataccgtattgggtatgtagcaggtccagctacgttgatggcgcacgttggtaagatgcaccaattcttggtcacaacggcacctggtccaatgatggccgctgctgaagaggcgttgcgcaatggtcgtcaagacgccattgatatgcgtgatacgtataagcaacgtcgtgacttggtcatggctgggttggcagaagctggctttacggccgcacaaccaggtggggccttctatatctttgccaagattccagcaacgttgaacacgaacgatatggaatttgtcattgatttggcagaaacagtgaagttgggtattgcaccaggttcaatctttggtgccggtggtgaaggctatgtgcgtttgtcatacgctgcttcaaccgaagacctaacggaagctgttaaccgtttgaagcaatacgttgctttgaagggctaacataaaatgagaacaatttaatttttggaagcacaaccggtcattttcggcttgtgcttttaatgtacccaattttcgggtttttattaaaatttgaggagaaaacacatgagtgaagaacgatcatatacagttgctatcttgggggctaccggcgcagtggggtctcgtttaattgaacaattggcgcaatcatcaattccggtggcgtcattgaagttgttggcatcagcgcgttcagctggccaaacgcgtgagttccgtggtgaaacaattacgattgaagaggcccaaccagagtcatttgaaggggtcgacttggtattggcatcagctggtggttccgtatcagctcgtctgttgccagaagcagtaaagcgcggggcggttgccgtcgacaatacctcattctggcgcatgaacgacaatgtaccgttggttgtgcctgaagttaacgaacaagcgttgtatgaacacaatgggattattgcgaaccctaattgctcaacgattcaaatggtggtggcccttgagccaattcgccaacaatttggtttgaagcaagtgattgtgtcaacgtatcaagcggcttctggggctggtcaatcagcttggcaagagttgctcgaccaagcgcaacagcacttgaatggtgaaccagaaacggccgaaattttgccagtaaagggtgataagaagcactacccattggccttcaacttgttgccacaaatcgatgtgtttgaagatgaaggctacacgcacgaagagtacaagatgattcacgaaacgaagaagattatgttgggcgacaagaatgccaaggatatcaaggtgacggcaaccgcagttcgtgtgccagtcccagttggtcacggtgagacggtttactttgaagtcgctgacgcagacggcgcttcaacaccaaagattcaacaagccttgtcagaagcaccaggtgttgtgttggaagatgatccagccaaccaaatttacccacaaccaatcaatgctgaaggcaagcgtgacacctttgtcggtcgcgtgcgtccagaccttgaaaatgacggtagctaccacatgtgggttgtgtcagataacttgttgaagggggcggcttggaacgcggtgcaaatcgccgaacgcttggttgccttggacttggtgcgcgttcctgaaggttctgctgaaaagttcgcataagggatgttaatgacgaaatgttagtagttagtctataataaatagtaattattaaatttaggtggaactgaacatgtcattatcactagcagatattcaacgcgagcaaccacgccaagtgccattggccaactggcaagatgtgttgcaagccgaactaaacgcctttgataccgctagctcaacagttagtgggattggggatgttgccaagacaatcaattttgctattgatcgttttcacattgcgcgcaacacggacaacgttttgacgttccgcacattgaacgacacgtacatccttgatgtaattggtgggttggtgttgtcacaattgttggcgcaacactatctaggttcagtactgccagcccgtatcgcagaaggcgaaggcaatgactacccagttatgactgagtggatcaacgaaatcagcacaacagttgaataatcaacacatgaagcactcagatttattctgggtgtttttttggtgcgcgtttttccggaatttagagactatctgtttcgtgagacatcgatgataaagaagctaccaaatgctcgcaaacaggatgctactaaatagtaaaagcaagatgataaattagcccggcgtggcaacaggaaattcacaaaaaattcatgcagcgagggtaatcttaacaatgtttccaccggttgaaaccggtatacattttaagggtaggggttttatagttatggaaaagcagcctgaaaaaaaggtcgtaggaattattgcaattgtattcggggcaattgccttggttacatcatggatgccatttgtaaataatgcatcatttgtacttgcgataattggattaattatcgcacttattgcattggtgatgaatcgaaaaaacaaaaaagttttgtcactagttggtattggattggctgtgattagtatggtgattgtgttggtaacgcaaggcatgtattctcgcacagtggatgaagcgtttgataatgcttcaaaggcaactaaggcatcagggcacagtacaacttcaaccgaaaagggatcaaaaaaagatagtaaaaagacggttgaaatgggttacaaaaagtacgatgtttcttcgagcaaggattatcatgtgacatatgctaacacagactggtcagcagcatctgtgaaggtaagtaaagtggtggttaacaagttggatgatacttatgagtatgatacttatactgatggtaaaaagaatatcaacggtattgtaacgatgcattttgaaattaaggctaatcaagatattacaatttatccatcacatggtactgcgattctaaataacagtgaacaacaagatgccacgggtggataatgggatggagagattgcgaacggggttactaaaactggtgtagttcatatcccggttgagtcattagattcagatgatgcattgcagagcattcgctttaagtttgatgggtactacgacacagacgattattctgacgctaatagtcatcacgaatatgattttactttggatttgaaataatctgagattatataaagatggtttacttcggtagaccatctttttttgcggtggatgtccatcaaacaaccagagtatttcttggctgctgtgcttggccccgccacgcgtatagacacgtgcagaccttgacccgcaggtgtgggttcttagcgggcttcccgcttagagccacgggaggtaaagggaaacgcagcttgctgtggttcgcgctccttgcaggtcatggtcagtacgtgttagcgtgcctcagaaggggccaagcactccgaccggaggtcggacacacaccacaaatccccagacaaatcaacaaaattagtttgattaaaattaaattagagaaaagtgttgacttttataatcaacctcgtatacttaagaacatcaagaaaagaggaggacaacgtcatgaagaacgtgtcagtagaaaagttgaatgttatgacgttggttgccccaattatcattgcgattattattattatttcgcagtgatggttggctttttgagatgctaacgctagccatgactgcttcccaaggaagattatcatggctagccaaatttaattactttgtaaacgagtaacggctagtattttgcgcagaatactagccgtttttttatataaattttttgagctcaaacttttactcgtaggtcatacaggaatattaggagatatggttatgaataagtttgttaagaattcagttttgatgtcagcaacattggttatggtcgcaggaactgggctgccagttgtttcagcaagtgaagccaaggccatcaattggacacttacgggtgatctaaagacgacggacccttcaaatgttgcggatatcccatcacaagatgccgttatggcaaccggtgaagggttgtaccgtgttggtaagagtggtcaaccagaattggcggctgcccaatcagccgacgtgtcacaagatggtttgacgtggactttcaagttgcgtgataacttgaagtggtcagatgggtcaaagttaaccgcccaagattttgtctacagttggcaacgtacgaatgatcctaagacggcggctatcggggcgatgttcttcagtggggtgaagaacgctgatgccatccaagctggtaaggtcacggatttgaatgaattgggtgctaaggcgctcgatgatacaacgttgcaagtgacgttggaacgtccattgccacaatttaaggctgagttggcgatgatgtacttcttccctgaaaagcaaagcttcgtcgagcaaaccggccaaaagtttggcacgaccgctgttgattcactttcaagtgggccatacgttttgaagaagtgggatggttcaagttcatcatacacgtatgaaaagaacccaaattactgggacgcagccaatgtaaagacaccagctgttaatgtgacgacaacggctgatgcaacgacgagtttcaacctatacaactcaggtaagaccgactttgcgttgctgaatgcgacgcaagcccgtaactcaaagaacaagcctggttacacggtagttgataccgctgcgacgacatacatgacgatgaaccaaaagaataaggcgttgcaaaacgtgaaggttcgtcaggcgctatcatttgcggttaaccgtgagaagctggcgaagaatgtgttgacgggtgcggctgaaccagccaagacctttaccgccaaggggttggcaaaggatccaaacacgggcaaggacttcaccgttggtgcgcacacgaagtacgtcagttatgacaaggcccaagcagccaagttgtggcaacaaggattgaagcaagttggtcaaaagcaagtgaagttgacgttgttaacaaacgataccgatgcagctaagcaaaccggtcaatacttgcaatcgcaattggaaacgaacttgaagggcttgacggtttcagtgaagtcagtgccagctaagcaaaccagttcactccaaaaggcgggtaagttcgacttgtcattggcaacgtggaacgcggattacactgatccagttgatatgttgcaaacgttggtaacgggggcatcttggaacctaactggttggtcagacaagaagtacgatgcgctctatgagaaggcaacgacgacggatgctaacgatgagaaggcacgctttaaggacttggcagccgctgaagagtatgcacaaaagcaaggtgctgtagcgccgttgacatactcaaagatgaccgctttgatgaatccaaaggttaagggtgtcttcgtcaatccagttggtggcacatttgattggaagaacgcagtaaagaattaggagaaaacggtatgacaaaagacgggacacatattttgagtttggataatggctaccatttgtggtcacgcactgacggaacgggcaagccgatcaagttattgacgttgcatggtggcccgggtgctgggcatgagccgtatgaacgttttccagagttcttgaatccaattggggttgaagtgacgcaatatgatcaacttggggcatggtattcagatcaacctgattttgatgatccggccaacgttgaaaagtatttgaattacgactactacttaaacgaagtggaagaagttcgccaaaagttgggttatgaagatggtgagttctatcttgctgggcactcgtggggtggtttgcttgcccaagaatatgcgctccgtcatccgggcgttttgaagggactcattatcatctcaatgattgataacatcgatgattatgtcacgaatatcaatgcgattcgcgaaaaggagttcgacgccgatgtcgtcgtctttatgcgtgaagttgaagaacgtggtgaatgggataacccaacctatcagaagtatgcgacacacttagaccgtgaatacaacactcgccacccgaatgcaccgcatcaccaaatcagtacgatggggacagcagtgtacaaccattttcaaggtgataatgaatttgtgattacagggaagttggcgcactggtcagttgcgaatcgactacacgaaattgaaacgccaaccttgttaacctttggtgggcacgaatcaatgccgttggaagtagcgcgtcaaatgcgtgacaagatgccaaatgcccgtttgcgtgtgacgccaaacgcccgtttgcgtgtgacgccaaacgccggtcatgtccacatggtggatgaccctgaaatcttcttttataacttgaagcatttcattcaagacgttgaagcggacgaatttgtgccagaataatgaaaaaccgacatcgccaatgaaggtgatgtcggttttactatagccaagggaattcaggttttgtcgcgccataaaaggcggtgtcgtggccgctcatgaaggcccaattttgattgccgtagtcgtaatgccaccattcttcgagatagttggtgaaaccagcattcgtcatcacatgataaagcagacgacggttttcgcgaatcttgatgacgtcttcagattccggttcaaactcgtaataagttgtcttagcgcgggcactaatgtcatcaaatggactgcccatttccaacaggcgaccacgttcatcaacaattgaaacgtccactgaaccacctgtgttgtgtggtgaagggcggtttgcgtttgatgaaggcaaggccacaatgcgcaatgtcgcagccaatgtttggtcggcattgaattcgggatggtcacgttgcacgaagctttgcatgcgatcgaacagggcttgttgcgtatcgatatcacgccaagcgtcaaagataaccaacttatagccgtagggcagcatgtctgcggcatcattcaatttttgttgaatcgtttcgcgcacgaagatatcagccttcgcacccggtagttgctggataaagtattgtgggcttaccaccattttttcaggtagatagctcactgaaaccagcttttcatctgacaaatcaagcggtatggcacgaatttcgccccagtcccaagtatcgcgttgtggttcaattggatttccagtaaattcaagcatcagcacagccccctctgtgagtcattttgtttgacattcatattttcttcacaaaacacagctagaaaagtaagtgattattgttataataattactacttgggaagaatgtgagaataattaatatgattaaaaaagatttcatccaaccccttaacccaattgtaactaatttggcgccagatgggttgttggattttcaaaaggccgtacgtgatattccggatttggttcgtttgacgtttggagagcctggttttaacgttgatgacgcaattaaggaacgcatcattgaatcagttcgtgaagacaattcacactatgccgagtcacaaggtgagcgtgagttgcgtaatgcagcggttgaatacttcaacaagaagtacgacttgaactatgatggcgaagacaacatgattgtgaccatcggtgtgtctgaagcaatcaatgttgtgttcttgacgttgttgaacgacaatgaaggcgtaatcgtgcccgaaccggcatacccaccatactttgcatcattggacttggcccacgggacgaagatttcaatcaacacacgtccaacgaagttcaagttgacgcctgaacaagttgatgaagcgatggcgaatgccaaggtgccagtgaaggccatcttgtttaactacccatcaaatccaacgggtgtgacgtattcagaagatgaattgattgccttggctgaagtgttcaagaagcaccgcctatgggtcatttcagacgaaatctactcacaattgacgtatgatcaacaacacgtttctttggcaaagttgattcctgatcaaacgattttgattacgggattgtcaaagtcacacgccatgacgggataccgtatcggctttatccttggtgaaaagagcttcatcgactacgcccaaaaggtacacggtgcgttgacgttctcattgccaaaggttttgcaagatggtgcgttagttgccgtgacaacggctgcggaagttgctgatgaaatgcgtgacatttacaagcgtcgccgtgactggttgcgtccacaacttgaggaacttggtttcgagatggttaacccagaaggggctttctacatcttcgcgaagattcctgaagacatgggcaagagcggctttgacttcgccgttgatttggcagaaaaggccaaggtagccatcattcctggggatgctttctcagaatacacacctgaattcgtgcgtatttcatacgccgcatcagatgaagacttggctgaagcaatgaagcgcatgaaggcttactttgctgagcgtcgcgggcaataattaaatcaaaaaacgaacacagctaggaccgtgaatggtcttggctgtgtttttgttagcgcatgttgttgtgttacaggtgttgcactgttatactacactgtaacaggagggctgataatggagtttaatgataacgaacccttatacattcaggtcgcggattatttggaaagtgaaattctcgatggcaaatacgagatggggagcaaggttccaagtgtacgtgaactggcggcagaattagtgatcaatggccgaacagttcaaaatgcgattacacgacttgtcgaatctggcttagttgaaactcgtcgcgggttgggtaactttgtgacgacggatcaagaaaaaattcagcgcattcgtcgcaataaaattactgcaatgacggaaacgtttgttaaaaacagtttggcttttgtctcaattgctgaattgcaggatattttgacgcaagtggtggcgcagtacaagaaggggtaaacggggatgttagaagtaaagaatctgagttatcgaaccggcttacgtcaaatcttaaaggagatgacgctgacggttgaggccggggagattgttggtgttttgggcgaaaatggggcaggtaagacaacgtttatgcgtgccttagcgggattgattcatccagaacgtggggcagtcattaagattgataatcaatctggtgatgtgttgaagtcactggtgtcgtttattccaaatctaaattgggcaatgaggcgtgatacagtggcgtcggttgcagctttttatcaagatgcttatgcggattttgatagtgatcgttgggaagccttgcgtaaggatctgaagattgataatcaggctaaaatcagcaagttatcaaagggacaactggaacgtttgatttttgccttaacggtgtcacgcgaagcaaaggttattcttttggatgaaccgttcagtggtgtggatgtgatgacgcgtcgtcgcgtgttgcaaagcttgctacgttggctgccagaatcatcaattgtgttgatgtcgacgcatgaaattaacgagattgaatcagtcattgatcgtacccttgtcattcaggacgggcaaattatcgttgatcgtggtattgacgaaattcggtcaaccgagcaaatgagcttggaacaatattttgtccaggtggttacggagaatcgaaaggggattgaatcatgatgaagacaagcaagctcgttaagttcattgcgaaagatagttatgaagggtttcgaacatttttgattgcagttggtgcagttatgattgttgcgctggcaattgccttcaaagacagttggcaagcgggaggctctcagctatttacctcgttgtcattagcgattggcctaccagtcatctttggacaggtattttatgtgataatggcttatgtaaaatcagtccagtcatggcaaaatgcgaagttggttttgctaccagcaacaaaatggcaatttgtaatcagtaatttggttgtccggttgttggtgattttaatcaacgtcgcggttgtgactggggtttatcgtttggtgatgatggccatcgaaaagggattgaacgctagtgaagctgataatgcgttgcactttagttgggaatttagcggtgtagtaagctcaaccggcgcgattgtactcgtctttttgtttgttaattttattggcttggcggttaatttgggcgttgctcattttatgccacgtttcaagtatgccaagggtccggttttctttgttgtcttcttgattgtgtttattgtcgtttcgctaggtgagacctatttggtagattggatgggtctgggcgaatgggcagcacgagtgtttgatggcctattagcacttggatttttttacgggatttttaaaatgtatacgcgatacaacgatgcgtactaaataccagacaggtgacaagaaaaagtttaagaaacgacgggttatttatcaaagtagtagtcgtcatgtaggatatagaagtagtacgaatgggtttattgtttaggagagaaaaatgaagaagcgaacgaagattattattggcggtactttgggggtactagttgttggtggcgtggttgtgacacaatttggtaagtcagatgagaagcgcacgattgccacaactcaggtgcaagaacaaccggatttgaaggaatctggtgtggttcaaccaatgcagattcaagaagttgcattgggtagcatgaagcctggtcaaattttggtcaaggacggtcaaacagtcaaggctggggacgctttgatgacgatggaagctgccgatggtaaggcggatgttagtgaagcacaagctgaggtaacgaagcttcaagcagctgtgggtattcaacaagaagccctaaataatgcccaaaaggcaatgaattcagaagatggtggcagtcaagatgccgtgacgcaagctaagatggccttgtcagatgcccaaaatgatttgacagctgcacaagcgaaggttgcaaacatccaagccaaggtcgctacaacggccgttgcaaagtttgatggtgttgttgtgctagaccaaacggatccagatgcaccaaagctacaagtttactcacaaaagaaggaagttgtgacgacagttagcgatggtgactacgacaaggttaagccagatgctgaagtcactgtaaacggtgtttcagatcacaacaaggaaacgacgcaacatgtcttgactgtcagcgctgtgccaacaaaggacagtaaccgtaaactagccaagtacgaattcacggtgacgctggatgacacattccgttatggtcaaccggtgacggtttcacttgcgcaacacggtatcgttgtgcccaagagcgccgtaaagacggttgacggccaaaagatggtctaccgtgtcgtaaatggtcgcgcggtgaagacggttgttgatgctcacacaggtgataacaatgtcatcgttacggctaacctatctgaacgtgatcgcgttgtaaccgattatgattcagctaagaacggggaggcaattgatgacgctaattaagttatcgaatatcaataagacctaccaaaacggtgaatcaaagttacacgtattgcgtgacatttcacttgaaatatcggacggtgaatttgtggcggtaatggggccatcaggttctggtaaatctacgtttattaacatcgtgggtatgcttgaccgtgaatttgaaggtgattacttctttgcggatgatgacacaacaacattaagccgtcgcgactatgcagctttccgcaaccgtaatattggttgggttttccaaaactttaagttgattcaacaaatgtctgtgttcgacaatgttgcgttgccattggtatacgcgggacgtcgccgctcagatatcaaggaagcagtccaagagacgcttgatcgtcttggtatcggtgacaaagggaacaagaaaccttccgaattatctggtggacaacaacagcgtgtcgcgattgcgcgtgcattagttgcgaagcctaagttcttgttggccgatgaaccaactggtgcgttggatagtcatactgcccaagaaattttggacttgtttattgcgttgaatcatgaaggaaccactattttgatggtaacgcacgatgcccatgttgccgaacaagcgcaacgaacaattcgtttggctgacggtcaaattgtaggtggcaacaaataattaccaaaaacgtagcaatttgtagcaaaaaatagaaaatcagcacagtaactaagtggagaatgttgattgattaaacgaactgaagattacttttcacgctaactaaaatcaggtataattaagttattcctaatgaaagtggtgggaaaaatgattaaaacgcataaggttaaaatttatcctaacgccacgatgagtaaggagttagaaaagctttttgattatcgacgctttatttggaataagggcttgaaagtttggcaagagatgtatgaggaatcacaattgatggccgataaacatatcttgccaaatgagcgtaaggtgcgtgatgagctagttcgcgataaagcagactggcaatatcggttgtccgcacgtgtcttgcagctggcggttaaagacttggcgcaagcatggcacaatttctttaatccgaatatgccaaatcatcagcgaccgcggtttaaatccaagaaaagatcagctaaatctttcacgacggatcgggctaagattatcgctggtaagttgcgtttggataagcctcgggaaggtatttcaacgtggtttgacattcgtctagccgagatgccacgatggcatggtgagttgaagctggtgaccgtcaagttagaacaagacggctattacgcatcgctggccattgaaatgccagaggttgtagtagattacaatcgatcgaaagcaacaggagtcgatgccaatatcgggcggttcgtttatcaagacgatgacggatatcaaacgcaggcaacattgccgaatagtttactaaaactctatgagcgtgtgacgttgtatcaacgccaactcgctcgtaaacgggttgagaatcctaagaactataattcaaagcagtaccagacaacgagagccaagttgaagcggtgctaccaacgaattatgcgcattcaaggggacattctgaacaagtttacgagcaagttggtggcgaaatatggggtgattggcatcgaaaacttggattgtcagcacatgaagatgaacaagcgcttggcgaaaaatctgcaccgatcaatgtttggtaaattccaactgatgatgcagtacaaagcggcgtggcagggtgtgacgttggtatgtgcggatcaattttttccaagcacgcaacgttgttcaaactgcgggcatatcaagataggtgtcgataaaattacgctgagtggcaatcgcaaacacgggacaaaacatcatgagtacgtttgttatgaatgcggttttgaagcggatcgtgatgagaatgccgttgaaaatttgaagcaatatgcaattaattcagtttgggggcaggctattgtcccaactattgggtaactgatagtttaggtgcgtccagagatggtcaatgtggctgagagagttatcgaagtcagaatactgttgtttgatgggcgtgaatagaacaaggaatggtatgacagaaaggaaatacatgaatccttactggtgtttctacatttctccacgttttatgtagcaggtatgtgagatggatctttggggaattattaagtcgtcatggcagtcacttatcactaacaagcgccgttctattttgacgatgttgggtattatcattggtatcgcatctgttatcacgattttgtcgattggtaatggtgtgaacaagcaaatggccaagtttgtctcagctgataagtcggggatgatcaaggaaaccatttactacacacaagatgattattacgcaaatgggttggatcaatctgacgttaacacaatcaagaacagcccttacgcggataagattgcgaacatcaagttgaagcgccttgaaaacggatcaacgacacttgatggttatgctggtgaacaaaaggtatcgaacttgaatgccaaagtcgtaaagggtagtggtgatgttgaattggttactggtcgtaagctaaccaaggatgataacgcattggcccaacgcaatgttacgattgcagatgattttgcgaaaaagtattttggttcagcacacgcagctgttgatcaagctatcgaattgggtggtttgagttacacggttgttggtgttgtgaagatgggtgcagattcacaaatggaaatgccagcgcaagtttggttgccatacaacacgttcctgggcacacaaacagctgcttatccgatggtacaattgacgattgcaacaaaggataagccagggaaggtagcacaaaaggtaacggactacttgcaaaagaatggtagccaagcatcttctggtaagtaccaatttgaagatgaaggcgcaaccatggcttcattgcaaaagtatgtatctgtgattgccctgtttgtgtcagcggtggctggtatttcattgttcatcgccggtatcggtgtgatgaacatgatgtacatttcagtttcagagcgtacgcaagaaatcggtattcgcttggccgtcggggccacggaacgccacgttttgttgcaattcttgattgaagcggtcatgttgaccttgtcaggtggtgtcatcggtttggcaatgggagctggtttgggtaagttgattacggttgtgatggacaatccaaacattacagctgtcgtcacaatgaacaatgtcttgatggtcttcggtgtcacaactgccattggaattatctttggttggttgccagcgcgccaagcatcacgcaagaatttgattgaaattttgagataaatattgaaaaagcttccgatgaactgaaccccgaaaattggagtgacgtttaagcggctaactggtcggaaagaatttagaaaaactttcgtgggaacggaaagttaaaactagtgtctcactaaaaaagactaaccttgataagttagatgaattggttaataaattacatgtaaagtcacgatcagaattgttagacactttaattgaacaaggatatgaaaaatttacgaattaggaaatcattatgtataaaaaaattaaaagttggttaattgagctgtttccgaaaattaaggcatttttttctaagccaattacagaacaaacagccagtttgagcggtaatgataatcagtcaagccaatacagccaaaataataatagcggtaccataaataatggtgacgagatccatggtgacaagaacacttatgtacattatgttgaaaataaggaaataaggttagctaaagacaaagtgaaacttattgaactcgaaacagaaatttaccaaatcgttaaatcaagtcatcttaatacagaagatagtataacggctgtggaaaataaggcatctgatctcatgaaagatgctcaatcacttgttaatgaaatatcatcagtaaatgcacaatatttatctggatctctaaaaaaggcaattagtcatgctaatgcaggagctactaagtatctatcagaaagaagaaactatatagtattcgtaaaaaatggagttgttacaaattctcaaatacaaaacaagattatgaatcgaatagataacgctataaaagagttggacgatgcctatgatgaattaaataaatttagctagaccaaagggagttaacataacacaggttatacaaagtttcctatacaccggcgcttacaagcactgactttgtgaagtctcaaaatcactttgatgagtgtttatttgctataccttcagacttgtgaaattcaacaaaatccaaaatagaccaccgtaactccatagcctccggcaggcacagtgtcaaacccctggaccccattaaaaaaatgtcccaaaatctgtacgaaatcaggtcatttttaaaattttcggggggtacgagaaagccctagcgggctcgaaaaagaggtccagagtcttgacatcagagcctttatataaaaataagcttcaagcatgattcatctacatacctgtgatatagacataaaatatatcaaaaaggagaacgccgttttatcttcagtttaaaaaaataacacaatatatttcattatatataatgaaatatattgtgtttcgtttattattgtatgttacttaaacggtccagcatgatcaattacttgtttttctatattagacccatttaacggattgtaatgataaggcaaattaaaatcagatggatttgcgttactctgagcgttagtaccagttacttgcttgtacacattattacgctccaggaacttatatgaatcgccatttttatccaacccaatcaagtgactgttattagtcttatagaagtagttattttccgataaaatataactaccgctacctatttgtagggcattgtattgttgttgagaaaaaccagcaggattgttaccagttggttggctactgttatcgaaatagttattataggcatgcacgtatcctctcaatagtggtctacccttaatgttaggtccaaaccaattatcatggagcgtgacatgcattttatgccctccttgtagataggaatcgcttccgtttgctccgacaaccatagttaagcgttcagtggctaaatcatgccactcaccaatccagttccagttaggatttggattcatatttaaccattcgttcgagaaccaaaagtgattatttgatatagtgacgttatcagactgcaagcttacagaaaacaagtcatcactcatgtcatggaagtcattattataaatccatgcattgttaatccttcttaaagacactccttcataattaactcctgatccccctggtttgatatcatttcctgttaacttttgaagatcagatatattaccgttaaaagcaatgttttttacgacaatattagaaattacctgatttccaggcaacatttcaccatcaaactttaattggatatttactagagtcggatttgtaccagcctgaccttcaatcgttgtgttgtcccactttttatcagcaaacgtaaaagttaccggcttatttccaccatatatatttccagaaattataatatgatgttggttactattaaaggcattttttaactgctccaaatttttgacgattactgcattttgatttgatccagtagcatttgaaaatccacctgtttgagtgtctgcagatactacaccattccccataaaaaaaacactagataaaaatagtagtgttttcgtaattttaaatatccccatgttgtcccccacttagtatacgtttggtatttgaaaaacttattataacacagcttatttaaagctaacacgtttacaaatctaatgttatattcggcgctgatgtccataatcttgacatcagcgcctatattcagaactatcaactgataattaaaaaaatttacagaaattgttaattcagaaaaattagactacttgcaacaatatcagctactgcaagacaaatatattcaaaatcgcactcctcaactaaaggggaaaattttagtattaaaagaagatgttaaatacgctgcaaaaattttagttgcaaaggttggataaaaatcggtagcagattttgttgactacctaactgggttctaagataacattcaacaaggattagaaaatggaatggtaaaatactttggtgttgatagaaatacagcaaagtgggcagcaaaaacggtagtatttatattcttttaaggagttttaatttatgaaatcatggttcgaaaagaataaacaatcaatcttcttaatatatgtattttcttgggcagtgttttataccttattcggtactaatttaatacatcacaacattaagcaatttttatttgaaaatttaccaatttggctaaacacggtgatcctagtgattcttgttctgattttaattctattgtggcccggtaaaattaaaaataaacagcattagtcaaggtataccaaagggagttaacataacatcgattatcccaagttataggtttatcaaggcctgaacgcggcttgtgatttttggaaattcacaaacttttaaaaagcccgatttactcatttcacaagtggggaatcgggcttttttcacaatctataccacttatggtagtgtgggctaaatttagtgtattgaatgtttgaatacactaataatgattgatataatgataccagataagtagtccgcttcctgaattggcggagttataaataaatcaggtatcgagtagtccgcttcctgaattggcggagttataaataaaccaggtatcgagtagtccgcttcctggttagcggatttataaataaccaggttaaagtgaagtgaaaaaagcctaccaggaaactggtaggcttttttggggggataatggatatgagtgatagttctgattttgagttcggaagcttagtatttgttgctgatgatttttttgaattggttaatgatccatttttaaaaacaaacaaaggaactggacattctaggccacattattttgcgattcaagataaatttgaatccgatatattttgggtagtgccgctaagtagtaagatacaaaaattcgataggattgttgatagaaaaatacaagcaaacaggccacatgacggattaaaaaaagttaagatacgtaatagagaaggttatctattgttccaggatatgttcccgacaaaaaaagaatatttaacggaatacaagcaatcaggtaaaactgttcagctaaaagaaaataacgatttaaatgaattaactaaacaggcgtatgccgttgtaggtttgctaatgaaaggtgttaaatttaataaaacacagccaaatgtcaaacgcatattggaaaagttatcggaagacaataagatacaaaaagagttgtctcaatttatgaatgataatccagaattaaaacccgaaagggcgtatagaagtaaaactaacaaccgtggtttatagcaaaaaaggatagccctattcagggctatcctttttgtatttgtcgggtttatttgaatttacgtaatttgcaaatatctttaatagcgattcagtttcatctgcgctcaaactttcagtttcaaaatacttatcaagcaacgcacccttttgaattagtttccttgttcgagctttgcgagcttttttgttttcaatatattgatattgtcgaatttttagttcttcaatttcaattcttttttgggctttttcacgctttgcgagaagtttttctaattgatccgacatatcaattaccccttttgttcagatgatgatattaaaagttgttttgattttgattttatgtatttgatgaatctttattttggctaatggctactgctgcctttttagcaatttccttaatagatgtcctatcaagagaagcgtgatcaataccggctagcttgataatctcatgacccaatgttttctcaatacgtgccttttcatttttgatttgttcattcaacttatcaagttttgcttgcttcttttccattgctgataatgccatgaatttccccccctttaattaaatgactattcgtttaaagtcagtctagcacaaacgtttttttcgagcaaatttaaattgatagataaaactagcaagagtagacttaaacatgaagataagaaaccagcggtcatgatgaaatcatgacaatgcgcacttacaccccacaaaagaaatttgtgggtactgtgctaaaaccttgtataagaagtcgcccgtggcgacaacaaaaaaatgagcaaaaatagacaaaggagaataaaataaatggcgattatgcatttgagttttcaaaatattagttccggtagtgggcgtagcgcaattgctagtgcaagttatagaagtggagaaaagttgttttcagaaaaagaagatagaaattatttttatagccgtgatattaagcctgaaacttttatattagttccaaataatgcaccggaatgggctagggatagggaacgtttatggaacgaagttgagtctgttgaaaataaagctaattcacgatatgcaaaagagtttaacgtggcattaccaattgaactttctgatgatgaacaacgtgaattattaactaagtatgttcaggaaaattttgttgaatccggaatggtcgcggacgttgctattcaccgagaccacaagggaaatccacatgcgcacgttatgctgacaaacagaccgtttaacccagacggaacatggggggttaaaagtaaaaaagaatatatcttagatgaaaatgggaacaaaatgtataccggaactagtaggtaccctaagtcgagaaaagtattaactactgattgggacaaaaaagaaaagataaatgaatggcgtgcaaattgggctaagtcagtaaatcgtgttttagaagaaaaaaacctacctgacagaatcagtgaaaaaacactggaagaacagggcataaaagaagaaccaacaaaacacgaagggcgcagtagatatgctgacgaacgccgcaaaaataatgaacaaattcgtcgcaggagagaagcacgaaaggacggtcaattattagacgataaaattaaaaatcaacgtcacttgtcaattctacaaaaccgtttgtcatttgatgaaaaacatttggttgctaatttgagtaaggagcttcaaacgtttgttagtttggaatcacttgatgataaacaacgtatgttgtttaactggaaaaatagtgtactgatcaaaaatgttatgggtgatgatgttgctaagcaactggcaattattgaatcgcaagaacagtcaatggaaaaagctaatgagatactcaataaatccgttgaaagagccattgaaaagtactatccagaattagatatttcagcgactgcatttgaagaacgtcgtgagcttattaaagagacagatgccagtggtgaagtgtttaagggagatgcattaattgatagattgaatgacattcgtagtgaccttattgccaataagattttggcgttcactaagcgcccattcaacagttggttgatgcttgataagcaagaagaattagcaaacgacaagttggaaaaaattgcatctaaatacggacaaacgttatctgaattaagagccggaaatcgtggagcttttgaacggtattctgatgaagatttgaagttggcagttgaatccattagagacttgcgtacggtgaaagagattcgggggattgttcagcaacaatacaatgaagtgttgggaaaggtttttccagctgccgatttggattctatgccagtcgttaaaaaagaacaggtttatacggcggttatatattacaacgttaatttgacgagttggacggcaaaggatgttgaacaattgcggactgatccacagcaacaattcaatacagttgagcaccgtaagggaatggcctatttgctaggaaatatgtcgctagatgatattgataataaacaattgaagcgagtgctaactaacaatggaacaactaatctgtttattgcggagttgaagaataatccggaaatagatcaaaaagaaattattggaattcaaaagaaattgcagaacgaccagaataagtttgataggttccgaagtggagagatgcctacttatacaccaaggaattataaagaatttaccaccacgcaatatgtgcaaaatgtattctctgatgcagtcatggcaattctttataactctgacttgaagcaagagattgaacgtcgcaagcaagccaagggattgcgtgatactgaatccgaaatggagaaaaagaagcgtcaacaccagactagtaatcgcaaggctaacgcaccgagaatatagttttaaaaatgcgtcacgtgacgcatttttgtggtataatatatatgtactactaaagaaaggagcgcgcgttttatggaagaatggtattcattatcagaagcatcaaggaaaatgggcaaggagcgtgggtacgtaagtgcatggattcgtaatcacccagaagtgatgccgaaggaaatgcttagaaaagtgggagacgctaatttaactttgatttctgattcaggaattgatttgattaaaagtaccccacgaaaaaaagagagcgtccaagtgagaaataacggttctcacaaggactacctggaaggactggttccaggcgtaactctcatgaatagtattttaaatggtggagtaccaaagttctattgttttgatgctatctaattattctcattagaaagggggtgggagagtgaaattagaaaaatggcaaggtgttgtggggcagcttgttattgataatgacaaagcaatcattgcatcagatgatgaaatgaaagacgttgcgtcattaaagggccaggttgccgagaatggtaagcccgttgaagaaatgcgacataagctattgcgagatacaatgcgaaagcaaactaatgtagatgttttgaaagtaaaacaacattttgaaaaatcacatgattcagaaaatgccgaaaaggttaataatctgaatccaggtaagccggcacaacagttcaagcaaattaaaaatgaagcattatttttcggacaaagttttcttgaaggctttctatgtgtttatggaattgaagttgataatgcagtcgagcgatatgagaatcgtttgcacgtgttggaaacgcaagaccttgaccaagaatatccagagaagaaatactatatcggacggattaagaatggaaggtctgaaattgcgacaagtgagatccagagccgagaagtcgccgaagcagaattgaataaattctatgctaagacgccggaacaggaacaaacacagttgcaacaatcagtaggattacaacaacacgataaaaaggagcaggtagatgagtagtttagttatcgccgcaggcgatttgggtaatgtgcaatcaaaggtgacaagtgccttgcaagcaatccagggtttactaacagcgatcgttgttattgtgggtatcgttgttgcacttgcaattatcattaagcgtttgccatcagctgacgacccacgtgagaagtcagaagtttatcacagtgttggacgtgtatttggactagttgcgttggccgccgcagttatttgggtagtgccagctgtatacaacttgttcacataagagagtgggtagccaaatgaagaaaggtaaggaatttgtttttccagaaaacgtagacaaggaatacggaatttggaaaggatatactttgcgagactttggctacgtgtttgcaacgttgggtgttggccttttgttggtggtgataccgccatacgggccaatcatcatgacaattaaattattcgttgttattttagccgtgacaattgtcatggctcttttaacattaaggccagtatcaggacgccggaatattaagattcggcagtggttcaatacgcaacaacgatatgcacgtagtcagaagttgtactttttagcaccaaaaaaacaagggggacgccatgaaattaacaagcgctaaggataaggcttccaactcattggactggacgtataccgcaccaaagattaacagcggtaaggaaacaatcgaccaaatgagtttggcagaaggaatctacaaagattacgtggttacaaaaaccggaaatctagtatcaatgcttgaagtttcaggcgtcaatttggatttgctaagtacgcacgaacaagaagatttgtttagtgattatggagcgtttctgatgagtacgctgggagaaggggttgatgattcactacaatttattgaagcaacaattccagtcgatatgacagaatatctagccaatttgaagtcacgatacttagagctgctaagccatcacccagaagaaacatttaaaattcaattgatcgctagctatatcaatcactataccgacgttcaaaattcaaaaaacatgacccgaaagcaacacctagtagtagttaagacggccatgaagaacaagtcgttcgagagtttggattcagcggttgatgcattgaacgataaagtgcaacaagtgaagcgagaccttgaaaacgccctaacggactatgaactagctgccaaacaattaaacagccaggagacgttaagcatttggaaaaacttgattaactacaacggatagtggggggaaacatgagtaagtttacagactggttattaccagcaaaaaagcaaacagaagatgaacaattgcatattgtggttaataaccaggcagaagaaaattttttgccagaaattgaccaagacagctttcattcattgttcccatttagttgggagcaataccccacttatgtgcaatcaggtgagaattatatgcgagttatcgcagttgctgactatccaaagcgagtatatggaaactggttatcagaattgaagcgcaaaaaaggcgctatcaatatcgttcagacaatcgacagcgcctcaaacaccagcatggtgtcttattacaaaaagaccatacagaataaacaagcagagcttgaaaatacgtatgaccctgtaaagaaaaaggaacttgccaactacattgattccgcaaacatgcagttggacaaataccttgataattctaccacgtttgtataccagcacatgctagtctacttgcgtgccaatagcttgactgaattagataatttgactgataacgtcaaaaacacactgattaaactacaaatgaagccattaattcccgttaaggcaacattccaagcattttggtcagcaatgccattgaatgaaaacttacttgaagattacacgtacaaagagagtaatacagaagttgctagttcaatgttcccatttgatgatgctgaaatcctagacttgaagccacgtagtgatattgaaggtgtcaacaaagacactaattcactaattgcaatcgacatgttagaccgcaacaagacgttgaatcaaaacatggtggtaattggttcgtcaggtgttggtaagacaacctacatgacccagaaaattctgcgttatgcagttcaagattatcaaatctacattattgatccagagaatgaatacactaagacagttgatctattgggcggttccgtattgcaccttacgtcaaacgcaccgcaaaagattaacccactacaaatcttctcggaagaaatcctaagttctgatgaagcagtccataatttagatattttggttaaggacaaaattcaacgattaaaggctttctttgaagttttgaagtcagatattagccaagttgaaaaggcaattctagatgatgtcgtcaagcaagcatacattaacagtggcatcttgaagtacgaacgtctatcagaaatttcaaatgaccaatttccaaccttatcagacgtatatgaacaaattgagaaattggctaaaactgcccctgacaagtacgaacgcatcaaagattttcagttcattctaggtagttatacgcacggttccaatactttgttcaatggtcacacgaacgttgatttgaaggccagtgtggtttcatttgatttgaagccattgcaggctgaaaaggaagttcaagcaggagcctacttaacgattttccaatatttgtgggacgaaatcacaaaagaccgcaagaagcgtaagaagttgtttgttgacgagttccactttctgacgttgaatccgtcggcagctacatttttccaccaagcatacaagcgttttcgtaagtacaatgcgggagctatcgccggtacgcaacaaatccaagacgttatcgaagcatcaacggattcaggacaaaacattggagaagccattatcggtaattcatacacaaaggtattctttggattggacggtaaaggtgttgatgatgttattacgaagttgcgtatgacgttttctgacaaagaaaagaagctgttggagcgtcgccgacaaggtgaagcacttatgatttacggaagccaaagagcattcatgagcgttgaattaaccgaagaagaattacgcttgattgatccagacgcatacatggaaaagtataatcgcacaacggcggaacaaccaaattatcaggcacgagtaattttgccaaagagtgaaattgacatgcttacatcatttgataagggggaagcatcagatgagaactaaaaagaacctattcaattttgagttaggaacttttgagcaaatgggtgacgaattaacacttactttaaagcgtgacaagttccgttatgacaatattgctgaattgaagcgattgaagcaagataaagcacattttttgaagttggcgacaatcctggaacaaggtgattcagtagcacttaattacacaattccaaatggagcaatgcctttaaaagacatttcaaaagagaataaagcaatccgaacaagcattgctaaggcaatccttgatacagatattgaaaacaatgaatttaacgtatcactgaatccagctaatgtttggtattacccaatgagtaatgtttggtatgcgtacaaagcgacacaggacatgccttacagcgattcagcagaccgctttatagaatataaggcgcttatcctatacgtgcttacaggtattccatacgagcgtttaatcaacaatatgaatgaagcaacgcaaataattactgacgatttgattaagcaagtggttgatacaacggatcaaaaagacttgaaagaaactgttgctgttattaacgactatgtgcaagcggaagagtggaagtcagtagacgccaatcacaagaaaactaagcgccgattcttagttggaattggaagtgtagcagtagtggcactacttgccgtaggtttggttcataagtcgggcgagaatcagttgaaagcaacagaaattcagaacactaagcaattacgttccgtaaagtatgagagtgctttacgagatgccttgaatgacaaggactggaaacaggctgataaagctatgaacaagttgggttactcaaaaaagaagcaggcacaaacatatcttgatttaaatgagtatcaacgagccttgaatgctgatgccggtgttctaaataaggcggtaaatagtttgtacaagaatggtaatgctaagaagctgctggattggaaattgcctaccaatgcaactgacaagcaaaaagacgccttgaagttggaaaaacaaattgtcaattatgaccaagcccaaattacagcgcaaatgtcatttactgaaaatacagacgttcttctgcgtatgggaaaagcgtttttgagccatgatgatgaacaggacgccaccacagcccaaaataagttgttgtctttgaataaggacaagggacactacatggaagccttaatcaagcaaaaaaaggcgcaaaagtcagtaactgattcacagcataaacttgatgatgcaaacaaaattgatgataaagacggaagcaagggggacaaggtaaaggaagcacaaggaaaccttgatagtgctaagaaagatctagatagtgccaaccagcaagtcaaggaagcacaagagaagttggggtaattgaatatgaacccactaacttataagtaccagaaagcaaaatggaaagtaattctataccttgttattggtattgtggttgcttttggagctatcgtttcagcgatatttggtggattatcagaagaagattgttcaccaagcacggtgtcagttgaagcaaccagtaagagccaacgtgaaaacgcaaaaaagctgtatgacttctttattaaagaatatggggctacaccacagggggccagtggcgcgttaggtaatatgacccaagaaagtcaattaagtccagatgctgttgaagataaaagcagagcattatcgggtcacggtttggcacagtggacggcgggacgaacaactaatcttatgaattttgccaaggataaagataaatcctgggacaattttggcttgcaaatagagttcatggatagcgaattgaaagggtcagaaaagggggcagttaaagccttgcagtccaattcagttatagatgcaacgacacaatggcaagtcttgtacgaacgagcaggtgacccgaaaatgggaaatcgtttgagttacgctcaaaagtggtttgctgaatttggaacttctgatccagtcgccagtgacacatttggaaatgccagtgacggtgcgttagaagcctctaatttggcctgtgacgacggttcgggtacaactagcaataatagcattgtaaaggccggagagagcatgaaaggctatttctactatgttcagcaacacccaagcgctgacttaggggacgacttgttaaatccaaataaaaatggtggtacagattgttcaggtttcgtctggttagcccttaaaaaggcgggatataaagttcctgaaaatatgggttggtttactggaagcatggctagtgatgccaggggtgctaacaagtaccttacagagattagcgaaaagaatgctaaggccggagatattgttattgtgaatcaaggagctggtgccggaaataacggacacacagccattttgttagaagattggaaaggaaaggacaccaatattttagagcaaggtggtggtgatagtaaggtaaatgaaggaaagtttggtgtaaactttgctactttgctgaatggtggtgccgttgtactagcacgagcacacaagtagggggagacatgaagaaagttaatatcatcgcaggactgttgggagtggggttagttatctcactgtatgccaacgttgcacaacacagcacagtgacgaaccaacagcaaaccattcaatccgcacaaaaaaaagaaaagaaatctgcatcagaattggcaagtattaagcgggataatcgcacgcttaaaacacaagttgatagtgccaagacgacgattaacaattctggtaagagttcaacagaaatcgagtttaacaacgtatcgaacgattttctgaaatctatgtttacctatgattctaagagttatgaacagcgtaaggacaatgtaaaagatttgctttcagataaattgtttgaacaatactttccgaagaatcaattttttggtgattcaaacaacgtaacgtcaaaactggataaagcgcaggtgtacaccaagtcgttacaagacagcactatgcagggtatggccgtaatcgactatgagagcaagagcggcgataacgattttaaaaaggacacagtagtttatcaactaacgttcgataccacgacaaacaaattaactgatgttcaaaatctagggcacgtgatgaagggaaataatgttcaataaattactaaaagtattggttccagtggtggtgctggtgtcattgatcggattcattggacacaactatatcaattatgttgagaagaaaagagagccggtagtggttcccaagaaaacagataaggtgctgtttttctatcgtgacgattgttccgattgtcagtctatttttcatcaaatttattggaagaattttattagtcgagatgttgaatttatcaacatgaacgaatcaagtaatcgcaagtacattgaagaatataatctggtgtcagtaccaacatttgtgcatgataacaatcaatatgctggtactaatataagtgatattgacgacgtaatgggggactgattaagaatggaaactgttagtaaaattgctaagcgggtcataccctaccttctagctatcgttattgaattgtatctgacgacgttggccgttgggtcactcatggcgttgcaagtgtataagttacagattggagagcattattcaccaattatcaaagacttatcgcttcacccgattaagtacgctacacaatatgttgaacaacggaatccgttgttcttggtaatagctgccggagcagtgttatataccttgtttttggctattaagtggcaaaataatcgaaaaaaagattgggaaacggctgatacagatacacacggtagtgccacatggggttcagtaaaggaacttatgaatgaatatcgacgagtatcacccacaaatttggctgaaaattttaacaaatcaattgacccgtcagttattcagaagttgcaagaaaagggggagcaatcatgaatggaacggttttaggaatcgtagacaatcaagttatttaccaggacaaccaaacaaagcccaaccgtaatttgtttgtggtaggtggaccaggttcatacaagacacaatctgttgttattactaatttgtttaatgaaacagagaacagcattgttgttactgatccaaaaggtgagttgtatgaaaaaacagcaggcatcaagttagcacaaggatacaatgttcacgttgtaaattttgcaaacatggtacattccgacagatacaatccatttgattatatttcacgtgataacgaagccgaaaatgtcgcaacaaagattgttcaatccgaaaacaaagaaggaaagaaagacgtttggtttagtacacaacgccaactattgaaagcattgattctgttcgtaatgaaagaaagagaaccaagtaagcgtaatttacgtggtgtatcagagattctacaaacttatgatgtcgaagcagaatcagaagaagaaaatagcccgcttgacggtatctttttagccttagatattaaccacccagcccgccgagcctatgagctaggtttccaccgcgcaaagggtgagatgaaagccagcattattgaatcattattggcaactatcagtaagttcgttgatgatgaagtcgcagaatttactagtgtttctgactttgatttaaaggatattggccgaagtaaaacagtgctttacgtcattattccggtaatggacgacacttacgaaagcatcattaacttgtttttttcgcaaatgtttgatgagctttacaagttagcagctaatcatcatgcgcatttaccagttgacgttgattttattcttgatgagtttgttaatttaggaaaatttccaaagtacgaagaatttctagcaacctgtcgtgggtatggaattggtgtgaccacgatatgccagactttaacacaattgcaggcattgtatggccgtgaaaaggccgaaagtattctaggtaatcacgccgtcaagatttgcttgaacgccgctaatgacgttactgctaagtatttcagtgacctattgggtaaggcaaccgttaaagttgagactggaagccaaagtacaagcaagagcaaggaaacaagcacgagtaagagtgatagttacagctatacaagtcgtcagttaatgacgcccgacgaaataacgcgtatgcccagcgatcaaagcattgttattttttcaaaccagcgcccaattaaggctaagaaagccttgcaatttaaacttttccctggtgtagccgacatggtgagcctagctcaaaacgattataacggcgaaatgtcactatcacaggctagttactatcacgaacaggaaatggcatgggaagttgaattagagaaacgcaatcagaaattagcatctagccaactagatgaatcagaagaagaatctgaattggattcaatggacgccttatttgacgaatacaattcacgaaatcgagaagaatcaactgttgacgacatgttgtaattgcgtcacgtgaagcattattatgataaaattaaagtagggatatataggaaaaggggtatgaaaatgaataataaaaaagtggtagtcccagtgattgtattggttgcgttggctttattagccggtgtgtatgtaggtacgcacaaagatatagctaaggacttacaatctaacgaatggacgattcatgatgatagttcaattggtggaacggctaaatttactaaaagtggacgcatgaatttatcaattggcaatcttgatgtagatagtttcaagtacaacgtttacaaaaagaatggtcacgaatacttgaaattgcaaggtaaaacggctgttggtggtcaagcaactaagtatgtatatgaagtgaaaaaagattctgattcatacactatggatttgaagaaggagaacgagttagcgaagctagaaactggttctttgcaaggagatttgcagttggataagaagtgattcatctaactagaaaggagaacgtatgtatactgtaatgggattcagcatcgttaaaccaattaacgattggctttcatcagtagccggtagtgtcatggattttgcagtatcaggtgcaaaagcaatacttgaccaagtcacacagaacctaccagttatcacaacctggtataacgtattcctagcaatcgcagtttcaatggttgtctcaattacattattcagagtgatccatacattgttatccaatgttgatgatagttcggacgttacgtggattaacattctaatggattcaacaaaaggagcattcctaatcccaattatggttttcattcagggattcttacagaagaaaattgttataccaatggcacaaggtatgttttcaatggatagtaattacacttctaaggcagtgcaaggtgtaaaggatattccgttagcaaacggttcacaaaaattggccttgaatggttctatgcaggttctatttttagtgtttttcgcaatcgtgacaattgcatttttgattaagatgtgtatctactttgcagatatggcctggtataacctagcaattcctttcgctgctatatcaattgccacagaatcatttgattattcaacaatgtggtggaagaagctagtgtattacaacatttcaatgttatcgcaggttctatccttaacattaacaatatggtgttttaccaatcttgcgaattatggatttattgctttcatggggtgcatcggatttggctggttggtgctacacacaccacacgtaattcaagacttctgggcatcaactggaatcacaaaaagtggtggacgttcagctattcgtggtttacaaaacggtatgcgtcgtttatcgtcagcacgatagtttcaagcaaaacgggcgcctgttaggtgtccgtttttgtttatactgatagacttaaaataaggaacagggggaaattatgaaaaatacagagacagatattttagcaagtgaattacctatcgtagaagaaaaggggcaattcaaaacgttggaagaaactattcagcaaagcggtaattgggtgcctgtggcgtggtggcgtggcgctgaggtaatgctttacagcaacccaaaagatgtcttgccagtaattgatgatgaaattgaatttgtgcccgaagaaagggagtaagtagatgccaacaaaggaagaagccgaagcatggaagaagcaactacttgatgatgccgaaaaaatattatggcgctgacagacagtgacaagttcaaggattatttggcagtcatgggtaagtttcactcatacagcgcccgcaatatctcactgatcttttcacaaaatcctaatgccagccgagtggccggatttaagcagtggcaaaacgactttaatcgtcaggtaaataaaggcgctaagtcgattagaatagccgcacctatcattaaaaagctgacagaagaacagaaaaaacggttaaacacgacccaagataaagggattgtagggtatcggtttatccccgtgttcgacgtaagtcagactaatggtcaagaacttgccagtgccagagattttgtagcggataatcttaaagagaccgtgaatgtcgagcgcttgtataaagaattgaagcaacatatcaatgacaatactgatattagtgttgttgaaaaagagctggaagatagtaatgttaaaggctattacaggccgtcagctaatgaaattgctatcaattcctcagaacagaacactacgcttaaacttaaaacgttgtatcacgagtacgctcacagtcagatacacgctattggggctgaatatcagcaattgccccgcccacacaaagaagcgcaagctgaatcggtggcatatattgctatgaagaacctaggcattgatactgatacgtattcattgggatatgttgcaacgtgggcgcaaaacaaagagacgattcataaagccctgtcagaaattcaaaatattagtggacgtgtaatcgaaatgactgacgttctcacaaataaattgggattacaagaagaattaaagtcacctgaaaagatgacgacgcaacagttgaacagtcagttcagcaatatcaaaaaagagattgtacggattgatactgaaattgcaggtaaaagtgaaaaagagacgtctctcaaacgcactgagagagcaaagttgattgataacctgggtaatctatcgaaagagatgcataaacgcacccagactgaacttaaaagttacgcatcagacaatccagaagttaaatccgagaagaagcagggacaaaaacaaataatgacgcataactgaccgcccgttggttggttatggcatcaaagagtaggtggtcataaatcgaccacctactttttgatcccagcgataaagggggaaatcatgggacaatataatgtggacgagattgaattttacagtaatgggtgattggataatattgacctggcatcagttactaatgatgaactaaaagacctgacttattatcaagtgaagcaggcagcaggcacatacaatgaaatggtatcaatggaagaaacagacccagactatgctttttgggacaatgattataacaacgaaaagaataattatatgcagttggctaccgaattaaacaacaggggaattgaagtaccgcacgcacttgatatgcacgataatgcatcacaaatgaataatgtgattgaaagattcacaccaggtttatttgaatacaaagataatgtaattgtgcgagcagacagcgagttagaagccattaaacagatattcaatggtgatttagaaacagctataataaagacttacaactttaacggcttacctgatgatgaatttaagacgcaattaaatcagggtgattggaatggtgttttggagtttgaaaagggaaacggcttcttcaagaatatcgggaatggactgtttactgatgaaatggtgatgttgggagttaatagcaaacatgctgttaatgccagtttatttgctgataaggcgactgatcgaacccaagcagagctaagaagttttgttgctaacaccccagacttacagaccaagcataatttggggcaacagcacaatgcccctagcatctaaatagatactaaaaaggacaggagtgccccctgcccttttttattcactagtaatcggatttatttatgatagactaaatgtaaaagcttacaaatcagtggtttgtttaaataccacacgtgtggtatgattagtataacaaatcgaataaaagaaaaggcacccgccggaattggtagttccaacgagtgcctgtgctaaggatagaacaagtatctttaacacatttgtttttcaatacccttattataagcgatattgaaaagacggtcaacttatgaagttctaacagaatcagtgtattaaaggaactttctaaacgggcgggaatgtgtagagaactgcatagtcccgcccgttttttataggaaaattagcaccgctagaacgtacacgttatagacgtatccacaatttgtggcggggaaaatgcaccccgatgattaaacggcattccctgtgcagtgacggactatcacggcatgggggtgtggggagcgcatataaggacacgacctctggcttccaagcgcatttgacgcaaaaactaagtgattcaagaacggatcatatgtaaaactgggtttgtgggtggcaaaacaccgcctagaatcaacgtataacgtaattctggacggtctacggagctttattggctcacaccagcgggaaaccgctaaaaggcaggtatacggctcctgacgccttaaaagtgtgagtgttgaactagtcttgttgacgacggtacgagaactctgaggagcgattgacgttgaatgcagttcatttattgctaagctatgggtgaactgtattctcaaatactcaaatctttcggagcgatgattggttagtgcgtgtcaacctgtttttgttttaaaaaaggttttgattaagcgtaagcataagagttccaagggcttgcccttgtgtctgccgaaggctactaattagccggtgtacattacaagcgtgattcaaacttgggataatcgatgttatgttaactacttttggtataggcggcatcacgaagtgatatacgggtgttgttgtaccagttgatgtaccagccaaccgcccatcgttttaaaatttcattttccttttttaggattgcgagttctttgcgcaattttttgagctcattggctgaaactgactcgccattaacgtctaagggggcgtacttcttaaccaaatttcgaatcaaatcagctgacggaccgtattccgtctctagttcatcggaccgacggcacgctttaaccatttcaacgatgtactttttaaagtcctcttcataacgtgtaaccataaataaaaatgctcctatgatgatattttaccaaactagaaaacatagtccggaatctcatcataagagcacgtcgcactatccgtaaacacttcgacgaaataataaacagctttacctacgaattatcaaatggaccaattgaaggttcaaacaataaaatcaaagccattaagcgtacggcatacggtttccgtattttcaaaaactttcgtctacgtattcttgtctcattcaagaatagtttctactcaatgaactataagcacaaggcagctgatctcaacaatgtgaaatcagctgcctaagtaagtttcaaaatattaatttttattgtaataaatctcacctaactaatgaaccaataggttagattctcgatagatcgcacattgattattagttattagctggaacatcttgcaatgaccaattaatttcaccagaatagctacctgctacaggttgcttagtacctggaatttcaaggaacaaccccgtgtccttatcgttccagtcttgattaatcttaaccgtatcatcatctgatgtcgttgtgtgatccataatcacagtttcttcgtttgtcagtggttgtgtgtcgccatcattcctgaacatgacgttattattcaatgtatatgcaccatcagatgaagttaactgctttgccatacttgccgtcacacgccagctgctacctgttccacgtgtatctgaaacagtcatatcaccagtcgcgttttcagtggccgcaaatttcttgttaccgctcttcaggccgtgtgatccaaagtcaatcttagtaaatttaccagcccatgctaagtcaccagcaatcatgtaagttggcgcagccttcaaatcagcgtcatgtaccgttgtatcagtaacaggattcgtattaccgctgtcatctgttgaaaagacttgcaccatgtcatcctttgccaaaccttcaataacccctaatgagaagttaccatcagcatcagctgtggctgtgtttggagcatcgacccacgtttgacccccatcatgactaacctttgccgtaacagttgcaccggcgtctgtcttaccagaaacgtttgcactgggcgtggtactactagttaatgacactggtgttggtggcgtcttgtcattaacatccgctgtaacctgatcctcgtaatcaccaaacttaccgtagaagctcaacaactgaccaccattaggcgttgccttttggaagtaatcatttgataacgttacaaatccatcggcacctgactgctttgaaaacgtgtgacccaatgagtcgttaccggtcaacgtcacttggtccttgatggcccaaacgtcgtggtaagtcaacaaaccagtgtctggatcaggtttacctgaaaccggcaattgccccattgaaacacgtgcacgtacggtcttatcagtgtcccaaatcaaaccgttttgggtatctgaatcaagcatcgtcgtgttagttgtatcagcttccttagaccatggttgtacatagattttcaagggttggttcaatcctgaaatacgcgccgttgagttgttcttgtacgccgtttgcaaaccactatcagatgaaacgacaccattcgctggtgtataggtgaatgatgccaccttttcaaatgctgatgacgctgcgtcagttgtcgtattcaaaccattattccaaagtgtcgcgttactatcagtaatactgaattttccacgcgtgacattaatcgcggcattgttacccgttccttgattattgatatcaaagcccttcggattcgtcaacgttaggtattgattggcatttccacccgtcatggcaattagtggcacgccactagattgattacccatgacatataaacttccttgagacttgactgcaattccttgatcaccagtaccagtagtatttgagtaatcaataatatttgctgccccattgggtgtgtttgatgaaaccgacatcgttgcgtttgaatcgacaatatagtgaccgttgtaaccatattgtgcattcagataccagctaattccagctgttccgccgttcaaattaaacgttgcacctggttgcacatgaatttcaccaaatctcagatagattggcgaatatgggttataagtgtggtaattaaccaatgacacaactgcatcgttaccaatcgtaatgtgaccatctccagccgttgacgtcatgtaccaaacagacacgggtcctgcacctgttgcggacgccttaccattattatttgaactggcgtttgacacgccgtaataatgcgttccgtcagcaatttcaatgtcttgagcgccaataaaattctcatagttagtgcgaatatcaactgtgccactcaagcgaaccttggcaccaccaaccgtggcgaaacgctgtcccccattaaacgtttgcttgtaagtcaaattagacatcttcaccgtccagttactcgcttgcttattttctccgttatagatgaacccgttaaccccctcaccttgtgttgccaccatgtcgatgtcgtgaacgttcaaggacggtgattgatcgattgctgaactcgcgggatttctgaaactcagcgagtgcgaagcattagaacctgtcgaaaacgtaattttgtgaccgtttccattaatttctataccggctgtacgtgtttgcgtacttgtagccgttgtttcaaaatcttgggctaatgtaatttttgttgtgtccggattattccaagccgttacaaaatctggccagctactaacagtgacctcatcagcattcgcatgtccctgagacataaccaagacaccaaaaactaccccaagtaataccaaaaattttttcataatattacctttcaaaaaactgcttgcgcaagcgcattagatataactaacgcaaagcacaagcagttatcaacgttaactacgcatttcttttatctcgaaatgattgatatgataaatatcccacgctgatcaatccagccagaccaatcatgttcaagtaccaatcttcgctcctgtcaacgcctgtgtttggtagggtcgtatttataggatggttatgagtccctgtttgaaccgctatatcatcgcttggcttaacatagctgtgtgatgccgatccaccatcattctgaacttcaccagtagtggtatcagaatcattatctggtaccacttgttggcttggatcgtcagggttaacaacgaaggaaactgtaccgtccgtatcatatgaaccaccatccgcacttgcagacgttaggccagtaccagcaaacaataaggttgccgcactgacggtcaaaaaccatttagttcgtttcattgttacggtgcctctttttctgccacaaccagtaggccaaaatcaacagaaatataattagaccgataattcctgcaatcagccaccaattaattttgacaatatcaacatcagtcttatttagttttttagcttgctttgaaacaatcgtaaagttttgcttgaaatgccacttgtcgccgtgtgacgtcattgtcaaattaagtgtgtatttaccaggcttaagttcctcaccacctagaaaaaatggcacatcgtaaacactatttggtgcaatctgcttaccagaatttgtcttatcagcattcacattcaacttatacagtttcttgctgctattacgcttggtaatatagccatcaattgcgacgttattaatataagatggggtcgtgttgttcaccgaggcaacaatcgccgtgcgatagttaagctgctcggcagtcacgccacttaacttcaagttaggtgaaaccttgtcagtattattgcgcagcgtcaccccaaccgtgtacgcatattggttcacgatattagtttgaccactactcttcttctgcttcaggttcgtctgcttgaatgtaatcccccctgccatcacacccttaaaattctgattaggcattttaatagtaattggcacttgaattgctgagtgtgctggaatcgtttgactatcaggcacattcaccgctttaacaatatcattggtatacgacttatccagtttagacttcaagtctttatcacttgtgctagaatactgcacgacaccggccgtattagttgttgcgcgggtcatagtcatggccaccacaacatccttgtcagtatcgttcttcaatgtcacactgaccgtctgcaattgccccggatcaagttttaaatcaaaatagctatgattcttgtctacttggttatccggaatgttagggattacggcgaaattaatttcattagccgaaacaaccgccggggcggcaccagacatcacgagaccaatcatcgccaccaaaaacaggaaaaacttcttaatcaacccagttactctcactacctaagcctccctagttctactgaacttacgctgaatgagcttaatttgctgagttagctggagtgtcagtcaacgtccaagtcaagttcgttgagtactttgcagcagcaaccttgtttgacgtacctggtacaaacaatgaaacactcttgtcgaccttacgatttgaaccgtcgttagccgttccagtctcgcttatcaagttatccgtgtcacccatacgagttacccaagtaccttgaccagcaccgttagtagccgacataacagtttgtgcaccttcaccaggaatcaacgtgatgttttgtccggccaaagcggcacctgcttcagaatccttttgcgttgcagcgttcaagtcggccatgatgatttgagcacccttcaaatctgatgatccgttgttcaattgcttggcttgttgaacagtcaacgtccaacctgcacccgttccgcggttatccgtcacttgagcaaacaaggcagtgtcagctggtgaaccattcttgtatgattgtgccttagcgtagtacgtttggtcagctgaagaaatcttttgctgaccaaagtcgaaagctgaaacatagtcaattgacaaaggtccttgagttcccttgccaccatcttctttaccatcaggtccaactgggttcgttgggtttgatggatcaacattgccaggatcaactgggttcgttgggtcagttgaaggcgtaaatgtaacacctgcatcagtcgtgtatgaaccaccatcagcgtaagcgattgtaggtactgcagcacccagcccaacagctgccaatcccaagactgcagtagattttaaaatagaactaatcatcattaaatcccctctgaaaatattttagatacatttcctatatcctatggcaattatactcatttataaaatggcaatgcaactttatatatagggtaaaactataacaaacagtttgctttcgccaatggaaaatgtcctttgaactgaacatgaaaattggaggaaagttcaaacggctaactgatcagaatggtttcggcattctcccattgtgcctaacccccatcgaactttcgtgacgtcagtgggagacccttcgtaaatcgacggttaacataatttggtgatatgtaggtataagaattgtaatttcgtgttaaacgtttgaaagtagtacaacggagaagtccattcatcttcatgattttatctataaaactttatggttggtactaaagactcgattacgaagttcttgtgtgatatgacgataaccagagttttatcgtcacgaattcatagattaactcacgtgggttctacttcttcgtttgtcaggttttatacgaccggactctaaaagcgcgttcccacttccatattaaagcaggagtacgcaagtggaacgtctttacagttattagtagagaatcacggtattttgattgtcattttggaaccttgattttaaaggagtgggtttgtcttgattcgacttagattattcataccttcaatttcacgcatcttaattttggttagacagttaagattagtggactcacctgtgattccaaacttgacatcagagccaatcataaaagaaaagcatcctcttctaggagaggatgcttttaatagatacataattggatacagtaaatcacttttgattatttctgagtgaacatcacttttttatctttatatagttaaaaaaataaaaaaagtaataaaaaataaccataatcaatagtattgttgtagtcaccaggttccaatcaagcattagcgccctactataattactaggtattccttgactcgtaatattaagtaactctttgatagagtgattatgatccgtcactattaatgaacctgtaatcatgatgataaattggtaaataatactacccgtactttgtatcgtatttttaacccaaattcgtttatctgatggcaaattattttgctgtacgtagaaatggtttaattcggaatttaaacaccctttcgttgtacttaacaataagatacccaatgagaatagaggtctaacaaacatcatactgaggcctacaaaaagcatgataaaaatattatgatgattgtttttgactagaactttattgatgattggtgcgacgactatgcctacaacatatggtatataaaagcggataaataaatcatcatgaccatagtatccagcaacatataaagatgcgaataagaataaatagttgcctaaggcaccatttatgattgctatataactcaaaactttaggaacacgacgttgtggtgatctatgaaaaaaaatttttgacacaataagaataatagctagtagtaatgatccccatataaaatcatcaaattgcataatattattcatcaatcgactagatcgcaaactaaatattaaaacgaaaaatactacaaataatcccaaatatcgatatgaatagctttctaaatcatgagaatctactgcgtattgattaatagtagatattgtcataatagctatcaagtacaaaaatgtgtaaaatacaaaaaatataataaaagaatttttagatgggataaacagtatatatccgattaatatcaaaattaagacagtaaaatatttatttttagctaaaagtaaatgactttttatattaagaaaattaattgacgtattagcggttggtaaccaagcagcacttaatcccagaaaaaaggcagaaatcatataaaattccgaaaaaaaatttccaattatgccaaacatagatcctaatgtaccaacataaagagcaacttttagcagactagcactattaagacttgttttgatacctctaatcaaaaatattccggttgtccgtaaggtataaaaaataacaaaaggtaaaactgacaatactgtatgtgccccgctaattctcagaaaaaacataaacggtagaacaatcaccgtactactaataacatttaatccagaattaccaatagttaaaatgtattttttcataaatactctccaatgattgttttaatgtgtttcattcaatgtcgacgtttattctttttagttgacatatatgctttagctactgtagccacaaaaattgtcattaaaccaatccctaccgtagagtacaacatagtaaatacttttccaaaatccgtcactggatgaatgtcaccataaccaatcgtcgttaaagtaacaaagcttaagtaaaaagcgttaagtagacttaaatgttctaccttactgtaaaagaaagcaccacttagtaatgtcaaaaatatgactatcaacagtcctttggtttcttctgatttgaaaataatccaaaaagaggaaaataattttttgactgacaaaatcattgaaatcacattgattctccctgaacagttttttatctactttcgagtatgcatatttgtttaatcaaagtcaaatatgaaaaaagtttaacggttagccaaaaaacatacaaataaaaaagtatataaacgcataaaaaagcactcttctcatagccgataacccaccaagtcagtatcaccggtattatccatggtggcgtcaaaatgagcaaatacggtctaatttagggagattagttggcgttattacccaaaatcaatttgatctaacattgtttcacgacttgcttgatctaacccaagataagtcagtgtcatcgcctcactcgagtgattcaataagtgcatgactaagccaatattatagtttgattgcgtataaacgcgataagcgcctgttttacgcatagtgtgagttcctagatagttaatgcctaataggtcaccaacgcgtgccatcaccttgtaaaactgcttctcagtgatatgacgatctgtatgggcagttgagggaaataaccaatccgaattgatgttttcttggatcagccaatcatgatattgcagcaagtcttgctgaacaggttttaaatataacgtgttcgctttgcctgtttttttatcatgaataaaggccgtctgtttaacagagccatctggattatagacatcggatctctttaacgtcatcacatcactcacccgcagcaaggtggctttgccaacttgaaagatggtgtagttacggcgacccgcccgaaaactatctagtaaggtgtcttgcaccatttttaagacgttagagtctttgattgggagtacgatttgttgcaccatatatgttaaatatccttaactaattcatcgtttaagtacgagactatgatttttttaataaattcaatgtaatctataaaatcttgcttaaatatatattcattagccatatggcttgaatcatttcctggaccaatctggacaatatccatgcgatcattttcagagataaatgttgcggcatcagttgtaccagctacagttctcaaagtgattttctgtttaaagaactctggtccatatagcgaaaccaatttaatgattgatgaatctttactggtcactacgggatctaattgtcgtagaacattgagttctaaattcatatctgcaaccttattcattttgctaataatatcttctaaatcactaattattcgattggcattaaccatagttgttgttctgacttttgttgtcaatttggcataagaagggactgaattaatttgttcaccgcccgaaataatagagtttacaggaataattttacccagcacactatcatttatttgaaccatgtgctcaaaatactttttttgttgattcatgtattcctgtaggttatcaatagcattgataccaagatccggcattgaactatgggcagattttcctttagagataatttcaaaatctagcacaccattttgtccaaaaattgcgaattgagtactttttcctgattcaggattagataatcgagaaggttcagcaacaattagtgcgtcgagatctgatattagttgatgacctaataagctagcagatcctaattggcccttttcttcaccacctgtagctagaagtctaatttgtccacctaaatctatcccctcatccttaatttcgattaaggcaatgattaaagcaaccaatccgcctttcatatcagaggtaccacgtccaaataatttcccgtacatatcagttaggacaagcggatcgcttttccaatctgacaatggccctatatttactgtatccatatgtccagttagacctagtatacgatcaccatgtcccatcgaaactattaagttagatcttcctgtggcaaatggtatttctgttgattcaatgttatgatccttcagaatttttttaaaatattcagctagttcttgttcattatggccgtctgtttttatagatatagatttttctagtatagaaatacgttcaatattgttcatgtttaatcccccctaattttaagttctattatatcacctaacaaaaaaacaacccctattatctaaccagtggataataggggttgttttaatagggttttacaggggcgattatttaattatcgccccttaaacagttcaatattaatgcgaaataaattataacaatcttcacacgataacattacaaccacgagatatgttttaactaactacgtcacaaaatatatttctattagtgctacatatattgcataatgtacataacaatacaaatttaaaaaaaaaggatgtgtagcttatatggttgacttcgcaaaaaaaattaaaaatccagagaaaaaaatattaactaatcctattgaaatctatgatgaattagatcgacaaacagaaaaagtcggcacacttagaccttcccaagttaaagtactaactaaatggtatgaaagtcgacttaatgaccatgacgttatattaaaattaaacaccggtgctggaaagacaatagttggtcttttaatgttagagagtaaattacgtctgaagagccttaatagtcgagataattacggaattgaagtttttctatgcaatgatattaatttagtaaaccaaactatgacgcaagcaaaacagtttggcattaacgtggctactatgtcgtcagataataaaatacctagcgaagtaattagtggtgaacaaatactagtgacatcggtgtcaaagttttttaacgggaaatcgatttttgaaaattctaatgatcttgaaatagatacgattgttatcgatgacgcccatagaagtgctgaattaataaagcagtcatgtgaaattaaaattacaaagggaaataaccagcagctatatgaggagctatttaacttactaagtgagggtttagaaagtcaaggtgaaggaacctttgcggagttaaaagataagagtgggatttatgagtcatcgtatttaccagttccttattggacatggatagataagatacaagaaataacggacttaatttcagataaaagagatactacagaattaaggtttatatggccgattcttaaggaccgtttacaatattgtgattgtataatatctggttcccatatagaaataaagcctttgaagctacccctagaattttatagcaaatacgaaaaagcaaaacagagagttttcatgtctgcaactacggcttcggactccattttaattagcgatttgggaatttcagctaaagcagtcaaagaaccacttacagatcctgaagaaaaatggtcaggagaaaagatggttgtcataccatctttgatatctgataactattcccggcaaaacattgtttcaaaatttgggagtatgaaaatagacgaatttggtgtgactgtactagttccaggatattataaaactgctgattgggaaaaatatggatctgtgattggaaatcttaataacctaccaggtgcacttcaaaaatttgatagtggggaatttagtagcccgttagtcttggttaatcgatacgatggaatagatctttcagatgataaaacaagaattttaataatggattcactacctaccgtagaatcattatttgataaatatctttctgatgtaaatcctaatgggtctgaagtaattttacgaactgcacaaaagatcgaacaaggtatgggaagaagtgtccgcgctgacacagattattcaatcataatgttcgttggaacagatctggttcgtttcattagaaatcctaagtttaaaaaatattttagtggacaaaccttggctcaaataaatattggtatttcgacggctaaggatgcccaattggaatataaagctagtgatcagatagattacaagccattaatggatttgttatctcaatctgtatataggaatgacgattggaaagcatattataaagaacaaatggagatggccgattattctgagacattttcaggaaatattgattttctagtatcgagaaatgaaattatgaaaatggtagtaaatccagtagtgaacattgacctattagttaagaaattgcagagtttaattgatgactgccaatttgcggaagaaaaaggattttatcttcaattactggcacgtgcattatatagtcattccaaatctttatctcgtaatttccaaatttctgcatatacccaaaatcataaccttttgttgccaacaacaataaataaagtgaagaaacttagtcctttagttgcaggtaaaaggattgataatattattagcaaagttaaaacatatgaacattttgaaaacttgattaatgttgcaactgatattcaaagcaacttatcctttggaacaaaaggcaaaatgtttgagaaatccctagatgaattaggaaaaattttggggtttgaaacaaatcgtcccgacgagtcttataaaaaaggaccagatcatttatgggctgttaaagacaatctttattatatcattgaggataaaagtgaagttagtgagtcaagagacaaaatttataaatcggaaacgggtcaaatgaataattcgatagcttggtttaaaaaagaatatcctggagcacaatttgttcctataatgattattccaaccaaatatcctgaccctgcagggggattcaacgctgatgtcagaataatgcgcaaaaagtctctaaattcacttaaggcgaattttattaattttgtcaacgagtttaatacgcttgactttaatagtttatcaacaaaagaagtggcagatttgattaccctacatgacttggatgttgatcaatttattgagaaatattcagagaaatattctagatgaaatatattttaactaaaatcataagcatagtttagattcagttgttactgaaaaaaaccgaagaaccacatattccttcggtttttttgtatatcatagacaaaggcaccattgttattggtacttattttccaaacctccaccaccttctcggcttggtttgcgcttctgctggttctgttgcttgttccgtttcgttttgtgaaaacacgttttttttaacctcactacttggcatcgttaaggcttttaagtctttaatttctgctttgtattcttctagcaatcttttatcttgtaaggctaaccgttgttgttgatctaataacttgtgtaactcttgcttttcagattgaatttctgacactaaattgcgaaggaatttcacttcattttgatcatcaacagcatctttttcgttgtcgtcaatattatctttatgttgacgttcttttgttgacgagtcactcgaaaacatagatttaatagttttttgaccgtcaacattaacgtaaacagtattaccttttgttgatgtaaattgacgcaaatcgattgacgtatctctttttatcttttgccatacagcctgctttgaaacgcctaattcatcagcaagttctcggattgtttttaaattttcactcatgatctatatcctgccttttaacgattggtaggtactgttcaatcgattttttaagatacttagcaatattctttttcgaatagtcatcttgtttatctcgaatatatgctaagtgttctttcacgccctttaaaccacgtaactcttttaattcgtcatagagtggataaacatttttctgtagccctgacaaaatagttgtatccgtcaaatcaatgtatgacaataagaaatgttccatcagtaactttgtatatggactttttatagccttaacagtcaacatgtcttctgtttcttcttgacgaatcttgccctcaatataaacaggatcatcctgtttataactactatcagctgcaacttgttttttagtaatgtgaaagacaatactatcaatactccgcccttttttgatcttttcgtaagttacattgaaagttgtgtgtttagtaatttctgacaatgggtcattcagtactcttttttcaaaatgatcaaatcgtttatattcatcaattgtatctgtcatttgacgtaaatctcgcatacttatttcgggattacggtagctttcaacttgttcctctctccgtccacctttaacactgtaatgctcgtattgattgtaattcatcgataaccaacgatacaaaattattgcatatttgctgttcaattctgcaatatctgacaaagcatgttgcgtaaaattatttttgagattgattagataaggcataatttcacgatgaaattcaattttcacttcgtcattataatcggtccattctacatacgggattggtacaatactaataaatttaaagcctttatcttgttcttttttaatttgaaaaaaagcttgtttctgcattttttcaacggcttctttaaaacgactatgtttgttgctatcatcaacttgaaaaaaagcaaacaactctcgcttggataagtaaaccgtctgatcttcggggggattttccgtatcaattagagaaacggccaactcaaacattttgagtggtgtcttatccattttggcaattgaagtgattaaactgttatgttcaaccacttttcgtttggacagttcattcaagctctgcacctgacttgcgttcttttctggtaaaatagacatataaatacgctcctttgtgtgcgttattgaaaaagcataaagaaaaacttctagacaggattttctttatgctttttattataacctatacacccacttgtctaaatgataagtgggtgtatacatagtattttgtgggtgcgtacatagtattttgtgggtatatacatagttttttgtgggtacataattttgtaaacccttgataatactgactttttaaccgcgcaaaagaacaaaagattaaaatataaaagataaacttataataggctgcgcctttttattgaacccataaaaaacaaaacaaaaagaaccccatagtacgtcaattttgtacgtggggttcttttttgaatgaatttaaatgacatatcacttgttatctaatatgattgccacttattaagccgatagagccatttaaaattggttaatactatttatacgttgcgtgtttaaaaacgcttatacgggcaaataggccgttttaacgttatagacttggacctttaaaaagatcacgcgttaattcaatgattcgattaattaatgctttaacttgttcgataccgtgatccaatctagttggcgctattttcgtatctggatctgctctagctgtcatcagtgtttttaaccaggactgggccacttttttattttgagtgagttcttcatgatccagcttataaagaacataccgggcctccacatcagtatgggctatcttgtcgacaccataatcatttttaagcatgtcacgcatagcataatccagctcttgctgttgtcgttgccgcttctgtagcacttgatgcgtttctttcaggttttgatagtctgcttggacgtctgctaattgtgctttgacttgtcctaacgtttgcttgagttcttccgtctcatgatggctttgtaaggtggctttcttcatcgtggctaacacgtttttaaagcgatctaagtcatctggtttaagaactgtcttaccaaagaggtttttagataaggcttgtttaaaatcatcaatttgtttttcggctaaatctacttccgttaaggcttgatccgtgattttaagtacggcctgtttcgcacgaatgttgtcctcaatatcggctagttccgtttttaaggcattaaattgatcattgtattttttgatttcagcgacattctcaaacggtaaggttttgttatttaaaatcccttgttcataaaagggcagtactttttttaaatgctgatctaaatcctcatgaaaggtttgtagatcatgacgcgttagcacttctttagcggagactttataacgtgattttttagcatcaaaaaccaccggaacaaaggcatagtgcaagtgaggggtggtctcgtcataatgcacgacagcggccacgacattttcttgaccataacggtcattcagaaaattagtggttgcttcaaaaaaggcgctctgttgctcgtagggggcttctgtgagttcttcaggtaaagtgactatccacgttgctaacgccttcacatcgtctcttttcatgcaataaacgttatttaaacgctcgttgaaacgtgaaagcatatctgaaccatctgccatgagatcttgattcagataggatttcgacacatcaatttctttgttagtatgatggtcggttttacgttcaaaatggaccgctaaaccaggtactgcgccacgcgtatttttctttaaatgcgccatcaaaaatgcctcctcgaaaaaggttttccaagaccagtataacaccgttaaaaatctggtatagcctgttataccaaaatgatattttggacaggctctgcgaggcacgtcatcgacaagcgatgacagtagcgtttccccttcctactggggaaactgctattttacagcgcctattatccggcttgtaaaacctccggcgggtcacgccgtgacagggcaatttatcattgcaggatcaccttcagtgagagcatgtcatgcagaacgctacccgcgtggggcaagctggtgtcagcttaaccacaaaaaaagtaaagttaccaattagatattgggtaactttacttttaaacataatgcttattagatactccagacagcattacttttgctgagaccagcttgttttcatttgttcgaaaattgtaaatacatcatctgtcattgtcttgtagttttgaatgtttgatggatcagcaatgatactttcgaaatctaaaatttcgtagaacaaagcattttctgtgcttccctctgtgattgattctgtagtatcactatctacatgataaaaattcgctgattgtgcccgtgggtattctggaattgtaatataacctttcgttcccgaaatagttagtgctttaggttgcttagcttgcaaagaaacagataccatagcagattcgcccgcctgattatgaagaattgtgacgacctgttcatcaactcccgttggagcatagtcaacaaaagactgcacattatcaggttgatctgacataaaatagcgtgccccagatataccgtaaacgcccatatcaagtaagacaccaccacctagatcaggattaaagaagcgattcttaggatcatagggtttaacactgccatgtgccacactaatatgcttaaccttaccgagttggccgtcattaatcatagattttacttttttggctaaaggcatatgaactaaggtcattgcttctaaaaggataacgttatgctgttgcgccaaatcttcaagttgatccaaatctgccttattcaaggtaatggctttctccatgagtacatgtttgccatgttcaatcgcttgtttggcaatatcaaaatgggtattgtgtggcgtagctatatatacagcgttaacgttgtcatcagaaaatacatcatctaaagaattaaattgatgaacaacgccataatcggtagcaaattggtttactttgtctgcattacgactaaatacgccataaatttctcgattgttcttattaaatacggttgccatttcatgcgcaataacacctgttccaatgattgtccaattcattgtcatttttgtaatcctttcaattatgtgatatctaaattgtagcgcttttaatcatatgattgtataaagaacacttcggtactatttgatcctatcacagccagtaccagtcattactacattactagctattcagaagatgtctctaattaaaaaaaacttgataagctaaaataacgtaaatactaaattcaacttgctgcatggattgtgaacaagtatgcagttggagataagagcaacatttcttatgatcacagagaagattgatgtaaaaaggcatggtaaagataattctttaccatgcctttttacgttagttagttttcatttccgccatttttatttggtgaatctaaacgcttgtatcctgatgaatgaagatagaaatgaaaaaacaaaacagaacttttaggacaaaaataaaaggagtgcctgtgtgcactcctttttaatataattgggttttcaaatacatcatccactttatatgtactcaaattatccgttttatcgcagaaatgccaaccgacgtgtgagttggatgatttcgtaactcaaaataaatattaaatacaaggttcattatagtacttaatgaccaatgtaaaattataatttgtggttgaatgcaaaatacgcatttcgatacataattgtgcgggtaaaacgacgatatgttataatatatgtatcggaaatggtgttcattaggttcacctttagtggttttatcagcaggggtgttggtagagccacttttttgtaaagaaaaaccccaagcggatgggtagtccgtttggggccctgtggttatcgatggttaaccgatcaacaaccataggataattccagctactacttcagcagcaactgccaacacaaattcggaaatggtgtgtttgttcatcaggtacaccccctttcggttgcagtgttggtatgcaacaaatcaattatatcagatttcaaatgatgatatactatgtgttacgaagtgtgaggttacataaatggacgaaaaagaaacttttttaacagtgttactgaactatctaaacatttgggtatatctagaaagacgctttatgagcgcgataaacgtggtggaatagaacttaatggttcttatacacaaaatgaattagattctctaaggataaagggtaacaaaagtgttttggaaacaaaagtaaacgatcattcgcaaaaagaaacagaacagaaacataatgacacagcgcttcttgatgcgctcaggaatcaaattaggatgttagaagcggatcaagaacgtttgtattcagagcttgatacacgtaacaagcatattgatgagctaaataagcaggttgatcaatcgcaacaattgcaactcaagacgcagctacaattggaagctgaacaacaaaaattgctagctttggaaacggagctcaagcaggatgatattatcgaagaaactgatcagccagaagtcgaagagaaaaaaagcttctggggtcgaatctttggttagtggtatagattgtgaaaaaaggccgctcaaggcgtttgtgaaacgccctgagcggtcttttttgagtttgtgaatgggggttgctgcacaaagtgcgcaaaaccgcgtcagatcaaccacttgggataatcgatgttatgttaactacttttggtataggcggcatcacgaagatttagaaaaactttcgtgggaacggaaagttaaaactagtgtctcactaaaaaaaactaacattgataagttagatgatctagtaaataaattacaagcaaagtcgcggtcagaattattagatacgttaattgaaaaaggatatgatgatttgctgagctagaccaatcaaaggtgacataacattgtttatacaaagttacctatacaccggtatttacaggcgctgactttgttaagtccaaaaattactctgatcagtgcttatttgatgtaccccagacttgtgaaatttaataacatccaaactagaccaccgtaactacagatcctccggcatacacaggtagcaaattcttggcccattaaaaaatgccccgaaatatgtacgaaatcagaacattttgaaacagtttcagggtacgagccctaacgggtttgaaaaagaggtccggagtcttaacatcagagccaagttactacctgattaatctccaataggggaaacctaccccagaatgccaaaataagcccagtaacactcctgcccaactcctcaggaagtgctactgggctagtgtgtatcaccatatgtcagatgttatcaacaccacgtcaacatggtgacctctcaggcgtgtattgtatcagcctatcatcgccccagatggcgacaccagcaatggacaacttagtgggactgtggtgtgcctctatggcggccatttaggtgggatacataacggaacgttattttttcgtacatctttacacagttttgtaataatctgcggaaacacttagtattccggctacaagcgctgtcaagccccaaaatcacccttgaaatgacccttgtatctcttgggaacacctgccatactaaggcttgtcagtaattgtctgaggtacattctgagtcttagcaactcaggaggtgctcatatggagaaatacactgaaggaaataccacgatgaactgggacatgattgtctctaacgttctatcaacggtggccacttttattattggccgtctgatggataattggcttaaccgccgtaacaaataacctttggtgcttcatgaggacataaaaaaaagaccttgcttttaacttttccgggttaagcagggtctctgtgtgtacatgaagtactactatcaactttgtaagaatgtacctatcagaataatctgacagagaaccgcttgggaggcctaattcccaggcggttcttcctttgtatttttatgataacacatgtgagaaaaaaagttatatatataaactcatcttatttattgcacgatacaacttgtgaaatccgggttttgaaaaattttcgggggtccggcacctctcggtgccgaacaagctgtccataatcttggcatcagcgccaagtatttattttgcgtggtatagtttaaagatgaatatgctaaaaaacgaatctattaattagattcgcaaatataaaaggtggattatatggataatgtgattgatttgaggcgactctggcttattgttcgtcgaaatgtttggctgatgattttgttagggattttgtttagtggtattagctttggtgttgcaaagtttgttattcctcccatgtacagtgcgtcggctgatttacttgttaatcgacagcatgacgatactcagcagggtttgcagtataacgatcaacaggctgacgttcaaataattaatacatataaggatattatcacgcgaccaattattctgaatgctgtggtcaaagaattaaatcggccacgcaaggtacaagtctcaccagctgttccagcccagtatgatgtgaatgaatggggacaacaagtacaaaccagtccaggtcacgaggccgtttacaaaatgatgccatctatttatcgtaatcgagggttagatgacaagacgattgccggtatgatcagcatttcaaataaaactaattcgcaagttttttcagtgaatgtgaagtctcgggatgcgaagatgtcccaagatattgcgaacgcaattgcaaacgtctttaagacaaagatcgcttcaattatggcggtatctaacgtgtcaattgtgtctaaggctacaaaaaatacggtgccagtttcaccaaatgttaagttaattacgttagctggtttctttttgggtgttgtcacggccttcggttggggattcatcaaggaaataaccgatcgcacggttaaggatctagaattcctgactgaagaattgaatctaacaaatttgggaattatcaattacattggtaagattcctgatttgaaagaagtacttgcagaagaaggacaacaaaaacgaactagtgagtcccgttctaatcgacgtatttaatggagaaaaatgatgggtatttttaaaaagaaatatagaccagacacagaaacgcaggttaatggggcacgcttagtgactttcgttgagccgaaacatgttatttcagaacaattccgtacattgcggacgaacatcgaattcgctggtgcagccttggataagctgcaggttgtgatatttacgtcggctgaaatatcagatggaaagacaacggttgcatctaatgtcgctgtcacatgggcgcaagccggcaaaagtgtactttatgttgatgcggatttgcgtcgtccaacagcacattcgacttttgatttgttgaacacacgcggattaacgacgattctggctagcaatgctcaacccaaagatacagtacaaaaaacatttgtggacaatctagaagtactaacgtctggaccagtgccacctaatccagcagagttattaagttcagcccgtatggcatctttaattgactggatgcgaaataattatgatgttgtcgtacttgatgtgcctccggtgatggcagttacggatgcgcaagtattgatgccactagtggacggtgcaattttggttacaacatttggtaagacgttaaaggctaatttgcaacgaacagtcgaaacgttacgattgactaatacgaaaatactgggaactgttcaacgtgtacgtggtggtaaacatgacgtgggctatgggtatggctatgggtatggctatgggtatggctatgggtatggctatggcgaaacggagtcaaattaagtaagagtaggtgagtgagatatgaaagggattattctagcagggggaacaggtacgcgactgtaccctattacaaaagccactagtaagcaattggttccaatttacgataagccaatgatttactatccaatgtctgttcttatgttggcaggaattaaggatattttaattatttctactgatgagtttatgggtcaatttgaagaactatttgaagatggacatgagttgggcctaaacattgagtacaaagtgcaaccagctccaaatgggttagctgaagcttttattctaggtgaaggatttattggcaacgactctgttgcactagtcttgggcgataacatttattacggtgcgggattgtctaatcttttacaagaggccgcatcaaaagaaacaggagcaactgtgtttgggtatcaagtacgtgatcctgaacgatttggcgttgttgagtttgatgagaataataaagcaatttccattgttgagaaacctgatcaccctaatagtaattacgcagttactggtttgtatttttacgacaatgacgttgttcagatcgctaagtctatcgagccatcaccgcgtggagaacttgaaatttcagatgtgaatgcgaagtatttggaacgtggtgatttggatgtgaaagttatgggtcgtggatttgcttggcttgatactggtacacacgactcgcttcttgaagcatcaagttatgtagccacaattcagaagcaacaaaatttgaaggtagcttcacttgaagaaatcgcctaccgaatgaactacatttcaattgatcaactcgaacaattggcgcaaccacttaagaaaaatgattatgggcaatacttgctacgtattgtcgaggaggataagaaaaatggcaattaagattattcctacaaagttacaggacgctaaacttgttgaaacagaggtttttggtgatcaccgtggcttctttacggaaacttacacacgtgacaagtttgaagaggcaggcatcaactttgactttaatcaagacaatcaatcattgtctacacaaccaggcgtacttcgaggaatgcactaccaactagctccttatacacaaaccaagattgttcgcgttgtaacgggtgcagtatatgacgtcttggtcgatatgcgcaagggctcacctacctatggagaatgggaaggttatattttgagtgaatataaccaccgccaattgttggtgccacgtggctttgcacacgggttcatgacgttaacgccaaatgtaaactttgcctataaggtggatggatactacgaaccaaaggccgatcgcggtattgcgtttgacgacccagaaatcggtatcgagtggccaatgtcagttgatcatttggtgatgtctgacaaggataaggcgcatccttcattggcagaagcagaaaacaactttatttacggagaaatttaatgtcacaatacaagcatattttagttactggtggcgccggctttattggagccaattttgttcgttacgtcgtagatgagcacccagatgtttttgttactgttttggataagttaacttatgcaggtaacgaagctaatcttgctgtattgcctgaagatcgtgtcaagttagtagttggcgatattgctgatgctgagttggtcgattcacttgcgaaggatgctgatgcaatcgttcactatgcagcagagagccacaacgacaactcattgaagaatccatcaccatttattcaaactaatctaattggtacgtatacgttgattgaagccgcacgtaagtacgacattcgtttccaccacgtatcaaccgatgaagtatatggtgatttgcctcttcgtgaggacttgcccggacatggtgaaggtgaaggcgaaaagtttacaccaacgactcgctacaacccgtcatcaccttattcatcaacaaaggctggatcagatttgctggttcgtgcttgggttcgttcattcggattgaaggctacaatttcaaacacgtcaaacaactatggaccttaccaacacatcgaaaagtttattccacgtcaggtaacaaatattttgagtgacattaagccaaagctatatggaagcggtaagaacgttcgtgactggattcacacctatgatcacgctactggtgtttggtctattttggaaaagggtcgcattggcgaaacgtacctgcttgggtctgacggcgaaaaagataatttgactgttttgaagatgattcttaaggacatgggcaaggctgaagacgattttgattttgttcaagatcgtgccggacacgacttgcgttatgcaattgatgcaacaaagactcgtgaagaattaggttgggcaccaaagtatacggattttgaaacgggacttgcagacaccatcaaatggtatcgagataatgaatcttggtgggcaaacgaaaaggctgaagtagaagcgaagtatgcacaaaataaccaataattacggttgttaagagcgattgatgagtgagagaaataagatgactgttaaatatttagtagctggagctaatggacagctaggtcaagaaattgtaaggattttgcaggaacgaaatgaaaactttgtagcattcaattctaaggaattagatatcacgaaccgcaaacgcgtgtttagcgttatttctgacgagaatccagatgtcgttctagatgctgcagcatatacgaaggtcgactttgctgaagaagatgggaaatatttaaactggcttgttaatgctgaaggaacaaagaatttggcagatgccgcagagactgttggagcaactatcgtctatgtgtccactgactacgtattcgaaggtttgaagctgactggctatttggaaactgatgcagttaaaccacagactgagtatgggcgtgccaaggtagcaggagaacaagcaatcaagcaaaataattctaattactacattgtgcgcacttcatgggtgtttggtgaatttggaaataactttgttcatacaatgcttaagctgggcgacaaattggatgaaattaatgtggttaatgatcaaaaaggccgacccacttggacaaagacgctggctaattttttgcttcacctagttgatagtgattcggaatttggagtctataacttaagtaatgacaacgaggctacatggtacgaatttgcggttgaaattttgaaagaaaagaacgttaaggtgaatccggtaaagtcctcggaatttccaactgtcgctaaacggccaaaaaactcagttttgtcacttgaaaaagcaaaatctacaggtttcaccattcctacgtggcaagaagcactaaacgaatatttgtcacgttaagataaatgaaattaaggattggaggtttagaacgaattggaaacacgatttgttaatcgcttagtaaaaagaataatcgatattaccggtagtattattgggctgatagtatttgcgccagtaattttatttgtagtcgtccagataaaaatggaagacggagggtcgattatttacaagcagatgcgcgtcggcaaaaaaggtaagacatttatgatgttgaagtttaggtcgatggttgaaaatgctcatgaaatgaagaacacgttattgcagcaaaacgaagcgacaggcccaatgtttaagatgaaagatgaccctagagttacaaatattggtaagttaatgcgaactcattctttcgacgaaatcccacagttcattaatgttttgcgaggcgagatgaccttggtagggccccgaccagcgttaccagaagaagttagtgcatatagcgtgtcggattcaaagaggcttaatgtaacgcctggattgacaggactgtggcaagtctcaggacgtagtgatttaagttattcacaaatgattaatttagatttggaatacgttgagaagcaatcgattgggtttgatttgaaaattttatttaaaacatttattcaaatggttacgcctggaaattcaggtgcttactgaaaggaacaatgacaaatgagacatgtttatattgtcggatcaaaaggaattcctgctcgttacggtggatttgagacttttgttgataaattaactgaatatcaagtttcgaaggacattatgtatcatgttgcttcattgagaaacaacaccgaggatagcaaaaatcacgatacttttacctacaacggggctgaagtttactctgtagacgttccagaaattggagcggcaaaggcaattgtttatgatatcaaggcacttgagtatgctattgatgatgctaagcaaaaaagttacgacaagccagtgttctatgtgctcgctagtcgtatcggaccttttattgggcacttgaagaaacaaatcgctgacctaggtggatcattgttacttaaccctgatggtaacgaatggaaacgagcaaagtggagcatgccagtcagaaagtattggaagtactctgaatacggaatggtaaagcatgcagacttgataatcgcagacaatcctaaaatcgaagaatatattcagactgaatatccaaaaatttatagagaaactaagtttattgcatatggaaccgatcaaagcctatcagagcttaatgagaatgattccaaagttagaaattggtactacgagaagggtattcttgaaaataattactatctgattgttggacgatttgtacctgaaaataattacgagactatgataagagagtttatggcgtctaattcagacaaagatcttgtgattgtatctaatgttgaaaaaaatcaattctataatgatttgatttctaagacacattttgacagagatagtcgaatcaagtttgtgggaacaatgtatgatcaagatttgttgaagtatatccgtcagaatgcatttgcttatattcacggtcatgaagttgggggaactaacccgtcacttcttgaagcgttgtcaactactcctgtcaacctcctggtggacgttgggtttaacgaagctgttgctagtgcagctgctttgtattgggataagaatcgcggttctctagcaaaaatggtgaatgatttagaacaaaccaatcaggaatacagaaataagctaggtagcttagcaaggaatgtcatccgagaaaactttacatgggaaataattgtagacaagtatgagaaggtgttcttgaactatggataaatttgaagcaagtgatggtttgaaaaagttgcaagcagctgatgaaaatatgctagccatgctggtgaaagtgttagatgagcatgacatagaatattatgcaatcgctggaacgcttttgggttcagtacgacaccaagggtttattccatgggatgatgatttggatattggcatcccaagagagtcgtacgatcgacttcttaatcatttagatgagtggcttagtgatgattattattgggataatttccatacaaatccgaactataagtacttcattacgcgtgtttattcaaaaagagttaaggtgcgtgaattaaggaatgacaatcagtcagagttttcgaatgcatcaattgatttatttccattggatgggacaccaaatagtaagtttgtaaggactatatttttgaaaaaagttatggcatatagagcgatggcctcatttgccaacttaacaaatattgataattctcgacatagaagtttggttgaaaaagtggtgatttcttttgcaagaatagtgcgcaccgacaaatttttgcatgcaaattatttttacaataagattgaaaaaatgctagtaactcaatcttttgaaaagtcagaatttgtaggttcgctaatgggggcatatcgcgaaaaagagttgtttaaacgcgagtggctcggttcgaagcgccaatatagattcggaacgattaatattacagggcctgaacatttttcaaaatatttacaacacatgtatggtgactacatggcgattccgtctgttgaaagtatcaaggaaaagcgtcattttgagataatcgaggattaaaatgaagagagttattacatatggtacgtttgatttaattcattacggacacattaatttgttgcgacgtgcaaaggcggaaggtgactatttgatagtggcactttcaactgatgaatttaacttggaatcaaaaaataaaaaaacgtacttttcatacgaagagcgacgtcaacttcttgagtctatcagatatgttgatcttgtaattccagaagaaaattgggaacaaaagaaaacagatatgaagatttacgtagtagatgagttcgttatgggagatgactggaaaggcgaatttgattatttggctgactatggggtgcaagttaaatatttagagagaacacctgaaatttcaacaactcaaataaagaaagatttaaataacaaagatttagcaactgatcacacatctaaagttcagtaatgtaaattgatgtcctatcatacatagaccttgtcctcgttaaggatgaagcaaggaatctgtaaattagcgtagtcgcaaattttatgattaaggaggatataaaaatgacacgcgtggtgttgattgttgcttattttgggaatttcccaccttatgcaagatggttttttaaatcaatcgagttaaatgaaactattgatttcttaattattacagatcaagatgatttacctgctattggaaacgtgcattacttgaaaatgagctttgatgaattccgaaagaatgtgcaaagctactttgactttacgattacaatgagttcaccgtataaaattgttgattacaagcctgcttttggatatatatttgaagattttattcaaagttatgatttctggggaaacatagatgttgatgtaatatttggaaatcttaggcattttttaactgaagaagtatttcaaagctacgataaaattaacgaacttgggcatctaacactgtatcggaatacaaaaactaataacagatattttatgtcaaaggtaggtatgccttttaccgaagtttttacgacaaatataattagggtgtttgacgaaagaatagggatgcaggcaaagtttgatttactaggagtgccttcgtttctgattccagagtttatagatgttgatccgtttagttttaaactcaaggggattggaattaaaaattatccgcatcaagtgtttctattccgaggaggcaaagtttttcaggtgtatgtcgaaaacgggaatatacattctaatgaatttatgtatgtgcattttcagaaaagaaacgttgaaccaattccgtatactgggggtgtgacaagcagtcacattaacgtagtgctgacgcagaacggatttaaatatccggatactataacagcggatttcgtcataaagaatagttcatcaagcataataaaagaacaaacgcttagagcgaagaaagccatgtatatctggcatcggagatttaaaaagtatattttaaaaaaatagtatgataatatctaaaatcaaattaaaaagcttattacttacgttgctattgttggttttgtttttttatgaaccgataattaattggcttccactgattggtaatgttgatgaattgattggtatcgcttccgtactttcaatcccgtttgttttgggaagagtccgaagtaacaaacagacatattttcaagtgaaagttatgctttctacattggccgtactaatactactcggcactgtctctaattacatttcaggttacaacgtttcgatcgtttcaaaactgattgatgccttaaccttagttaaagtaccactcgcctttctaatgtttaactatttaatcgatgatgtaacaaaaaaagaagtcttatacttacttagaattccggtagggctgtttttagtgggcgcagctgtgttcgatatcgccaatatattgggcactatagatatgagctatgatgtaaggtttggaattccttcctttaggttttatttcaataatccgggttcattgaacgaaagactttttttaacactcatagtagcaagtggctttcgaagcgccttttggcgaaggggctttgttgctgtttcagcaattattgtgttaacgacatttcgttttaatgcagtagttactttggcattgtggcaattggttattctggtgacaaaaggaaagaagaaagtttcgattggagcgttcattccaattggtgtaatggctgcatatcttggtcgtaaccagcttgcaagctactttctaaatggtgggactcctcgacaagttctttttacaaatggtaaagacttgatgttgaaatatttcccgtttgggaccggattttcgacatacggatcagaccaagctgccaaaaactattcggctttatactatgaattaggattttctaaaatttggggaatgcaaccactaaatcaaatgttcttacacgattcgttttggccaatattaatggctcagtatggattttttggaataatggcgtatatcattctgatagtaaatatgatgcagttaatgttgagaatgaaatctattaatagagctttaggaactttgatttttctgtatttggttatttcatcagtaggagcttcgatactgcttagtgtagaaggcttaaccttggtggtatttatgacattgcttacttctaacgacaataagcaggaaagataattactcatgaaaatcttgaaaaactacttatataatgtttggtatcaaatattggcggtactgctaccatttattactattccttacgtttcgcgtgttttaggagttggaaatgttggtgtagtttcatttacaacggcaaacactcaatatttcatattactagcatctctaggagtcacggtgtatgccacaagagagattgcatatattaatcaaagcgtggagagtgtttctgcttttttctttgaaataatggttttaaaaaccatattaaccgtagtatcaacgcttttatttttcgtgtttatttttctagcaccagagtcatacagacatatttatctcattcagttgattaatgttgtggcggttgtgtttgatatttcttggctttacatgggaatgcaaaattttaaggttaccgtgttaagaaatacaattgtcaaacttttgtcagcaacgttgatttttttatttgttaagtctgcgtctgatttaggcctttatatcgctatactggcgatatcggttttgtttggtaactggtcaatgtggccttatgttatgaagtatacaaaacgtgtaagtcacatacatcctttcgtccatctaaaagcgattgtgctgttgtttattccgcaggttgctattcaagtatttaccgtgatgaacaaaacgattttaggtgtatcggcaacacacacacagattggattgtttgaaaattcggataaattaattcgccttcttacggcgttcataactgccagtggaacggtactattacctgctatatcagagttgtttagaacaaatgattttgaaaaaattagggattacatgaaaaaggggtttgatctcacaaatttcatggtgttcccaattgttatttctttgatagcttttggcggaaagtttggtgtatggtttttcgggagtgattttcaaggcattggcaaaataattatgattttagcaccaacattaatttttatgtcttggaacaatgtaatcagttcgcagtatttattgccgtctaggcgtgaatctatttatactatgtcttttgtgtttggggcgattcttaacggtgcgttgaattttattttggattccccttggggggcaataggagcggctgtgtcagctctcttatcagaattttttgtagcaacgtatcagttgtttatgatccgtaacttctttgatataaaaattattttagtaaatacacttaaaacagtcgtcgcggcgagcattatggggggaatgtttgctgtggttataagtaggtccaaggcgattggctatgtgggattattaattgcgttaatattaggcgggatagtttatgtcttgctcaatgttttgatgaagactacggcttacatagaggtacataatttttttacaaaacggagagataatgctaaataaaattaaagaatatatgtcatatataaaaaaaacgaatttcttacgcgtgctagccgttactccttggttgattcaagatagacaaagtcaagaattgttgagaaaaatccttagaaacgaattgttccaaacattctcaaaaaaaattaaaaagatgagtgtttcaagctatgatccatcttttatcggtgaagtatatgatgatgtgatttggtttatgtggctacaaccaattggggaagctccagagtttgttcaggaaaattataaatatttgagacgaatgctggggcggaaattgattctaatttccgaagataatgttttcgaattaacaaggttacctgattttataattgataaatatcgaagtggaataatatcgcgaactcatttttccgatatcgtaagagtgcaattgttgtctgtgtacggaggaatttggatagattcaaccgttgttgttactaagacgtggttggataatacacctgagataactttgttacaacaatttaagccaggtaatgaagggaattacgttaatgtatctagttggtttatgaagttccccaaaaatcacccatatataacgcaagttcgagatgtgctattttcttattggaactctgaaaacaaattgtttgattattttctaattcatatgattatgcaacgagtgtcaatggatcagaataattttttgggtacaatatatccgtttgataattcgataccccattatttaatgttaaaaatgagaaaagagattgtttcggcagactcaatgcaacttttcatcgccaacgaaggaatagcaaagtttactaataagactcgaaatgtcactgaaacagagaattacaaatcattgataacagttttaaagcagatgtagtcataatgtttaatagaagtcttagagggtggtaaaggtctttaaaagttctggttatcggatatttaaattgctagtctttgtgtgcttgtcttcggtagtactccatacattttgtataattattccaataatatgaatgtgtaaaacattggattccccatgaattggcctagagaaaaaatagagtcacgattatggttgccattttcatatggttgactgattctttgaaagagaggcttagatgccacttcatagtaaaccagtaaacaatgaatgactattttgaatcaaaacttcgattagaccggtaatgacaaatcggggttaatcggagttttttattattttgaatcttgcttagatgactgatgttatatttttgaaatcagctgccatttatttcaggggttgaaacctcttattcaaaaacgcataactgataccctttggggttggtgccagttctgcgttttaagttaaattatatttgtattactcagtagtatttaatgcattttcaatttcggtatgaactcgttggaatgcagcatccgatatgatttggtatgaaacgccattgtccatttcaccggtacctttgatttgatcacgattaatagtttgagtagaatcgcgctacttagtggataagttacgtaacgatgtaagtgaaatgtttgaacgaacattatcagatacgtcatttaggaaatcgtttgatagaacgctagaaggtcatcttttagcttgttaattactgattcaatcacgagttgttggcgaatttgacgaccttagtctccttgtggatagtcgtaacgcatgcgtgagaattgcaatgctggtgcaccgtccatgtggtacgtttgaccttctgtgaatgaataaccttcatagtcaaatgttaatggtgacttgacattgacaccaacaatgcgttaacgagtggcttcaaacaattgatgttaaccaataggtaaccatctagcttgatgttaatcaatttatcaactgcatcttcggcattaccatatgcgtacgccgcagtaatcttttcatcaatacagtcgatttgaatctttgtgtcccgttagattgagatcattattgtgtattttgaagttgggttaacgaccataatacatcactgtatcggtatgatccttgtagtatcggactagagcaccggtatccgtacctataagaagataaactacggtctttccagctttttttcgtgtttgaagattcaatcgatgtactgtccatcgattgaatcttcgaggtggtggtgtctagcgtaaatgcatcaacaacaccaatcacaatcatggtaaaatccaaagtaacacctttttagtcaggggaaaaactccttaaaatgtattcaaaagatgaataagtatataataatccgtgaataattgagatatattcaaagaaagaggaaatatttaaggagacgtatatgatcgatattcacagtcacttattacctggtattgacgatgggtcaaagagtcttgaaatttcgttgcagatggcgcatgatgcggtcgcagatggagtgacgcacgcgcttatgacaccacaccacatgaacggacgttatgtgaatcatgcatcagacgtgattaatctaacggctgattttcaaactgaattgaacaatgcaaatattccattgacggtttttccatcacaagaggttcgcatcaacggtgacttattgtcagcgttggatgaaggcgatattctcacaacagatgatcaaggaatgtatatattaatcgaattgccttctaatgatgtgccatcatttacatcagacatgttatttcgtgttcagcaacgtggattaacaccgattattgtgcatccagaaagaaacactcagttaatgaaaaacccagatctgctgtatgatatggtatcatcgggtgcctatacacaagttacagctagctcatacgttggtgtattcgggaaatcagtaacagcgtttagtgaagatattattgcaaatggactagcacatatgattgcatctgatgcacaccatattccgggtcgtaaatataatatgcgcacagcttttgacaaactcactaaacaatatgggcaaagcatggttaacgaatttgataataatgccagagcattggtgaatggtgaaccattagttcgttggcatgaaacccctattaaaaagaagatgtttttctctgcctattaatgtaataatagggttgatcttattatgagattctgccctggtttttctaagttggtaaaattgcatcatatgggcattttattcatgggtatacgtaatgaagatgaaagacaacatttgaaaacgagtggcggtattgctgcaaaacattatttgtgcgtgttagaagtgttgttttactaattagcaacaataattgggtacagtgacgccacagcacacgcgttctgattacttttaacatacttactatgactgaatggtacctcgcacaaggaatacaatacaacaacacccgtatattaacccgtgctgccacatctatcaattttagagagcataatcaaggtttatatatattttcccttacaccggtctccgtaagcactgactttgcgcagtaaaaaataacgttaacccgttcttaatttgtggaccttaaagtttgtgaaatccacttagatatgaacttgccaactatagtcgccatgcctcttgccggcgcagaggcatcctcgggggtcttcatttaaaaaacaaccgtaaaattagatgaatgaaggcaggtcgttttgaaaatttttcggtagaataaaacctgttggactttaaaaagtggccataggatagatagtagaggagaggacctcataaaattttaagcattgcgtaattaataaataaccagtattcttaaaacataacaaacgaataaatcaaaagcacctaccgggattggtgtccccgtaggtgccagtgcaaagaatggacccacccttcgaagcacgttgtcatttaatgtgtaagtatattatagggtacttaccgatgatgcatcaagaaaagaacattttctgacgagaggcaatgtgacccgattcggtcacattgcctctcgtcttttttgcactcggtaaccggccacattacggcaacagattagaacgcactcagtacaaagaagcctatatggaattgtaggacggcacgtgaagatcattgctgtgcgctccacagacatcataaacagagacgtggagaagagataacaaatagcccaaatgcgggtagctagttgttatcctatcatgaagacatatagacgcggataagctgaatgagtaatcattctaagtcagtgtttcctagtattacataaaggtttaaacagtccccagaacgcttatatagcgctcaaatgacgtcaaaatgcagtcgggttgtaagggatagcttgaacataaaacattgtggcagtagccagtcgttgcgagacgcacgtaatgaaaataaccaatttccccattaaggggttagttggttcagtgtcgagagagagccttgcaggctattcgcaacgataatgtatgacgggttttgggttttaatttttaaaaaggcgtcagcatataagttccaagtgtttgcacttgtgtctgccgaaggctactaattagccggtgtacattacaagcgtgattcaatctttccgaccagttagccgcttaaacgtcactccaattttcggggttcagttcatattcgtatctcgaatattccgctttataattcaaaacatgaaaggggttacattatgaaaaattcatgtcgacgcttcgctaagcgtacacttatcactcttgcagctttaactgctgtttctactgtcggatttgcagcctatcaaattggcggattcgatggtgacaaacaagcaggcaatcaaatcggtacgattgctaatcagttgaaaacaactgctgacaatcttgctggtactgctcaaaacttaacttcagaaaaggcatcgcacgcttctgacgtaaagaaagccaacgacgaaattactgcagcaaacaactatgcaacttcagttcaaaacgccattagcaatgctagttccgcacaatccgcggctgaatccgctacatcgcaagctgcgcaagcaaattcactagatccgtcaacaaacacttctaacgtcaaacaataagcgttatgaaaaagcggatatcaacgattgtcgtgactgcagtcatcacactgattgcgacaacgactgtatttgctagtgcttacacaattctgaccttcaacggcgatatgaatgacgccaaccgtattcgaaatataacggcaacgatgacagctcaaaccgaccaactgaacaagacggtcaccgccctgcagtcttcggagggtcgctctgatttttataccgtgtattttaacagcatgccaaaatacacctacacaccattcacgacaccaccatatatgaacgttggccaactctattggtcaaatagttacaacaccctggtgtccagtaatggcgcacaaacttctatttggttcggtaacatctggctacctgtcacaagtgccacaaacggtaaagtcaccggcactaatatggcagtggcagatgccatgaaattattgcatcaaatctattattcacaggatttgactaatatcggcccaaatggtgccactacacaaggtgcaaccatttccgttaaataccaaggcaatgattaccggggaacactctcaaatctccactgggatacaaatgctaataccttggttgctaacgctagtgggtactattactttttttacatccacaatatcagtgtgaaatataacatgacccccaacggcggcgaatgggtggtaaaccaataaaaaataagcggaacaagtcttatccaaacttgttccgcttatttgtttagaatgtcaaaatcgtacgacccttatgcgtatgtgctgcaaacgcatcaagtacatctggcaacttttcaaaagacacttgttcaactggcagctcattcatcacatgccagtcagtcgcgaaacgttgccataataattggcgtgttggcatatcagctaccactgaatcaacacccaaaatgctaacaccacgcaaaattagtgggaacactgacgtaggcaaatcaacgccacccgcatttcctgtcatggcgatggcaccgttgtagtgaagcatcgcaatcaacttagctgccagctcaccaccaaccgtgtcgataacatagtcgtaagtttgcgacaaaagtggcttattcggcaatgccagaatatcatcggccgtcgtttcaccttctccaccgcggtgcacaatcggcgtcacattttgatagccactagcttgcaacaatgccaacgcaacgctacctacaccaccagctgcaccagtcacggcaatcttgggttgatcagcaacgcgcatccccaacccttccaacttcataatggccaacccagccgtaaacccagctgtgccaattgccatcgcatcttgcaaagaaagaccatctggtaacttaaccgcccattccgctggcacttgcacttgcgtcgcaaaaccaccgtcatgacgaacgccgaggtcatagccagtcaccagcacttcgtcgccaactgtaaacgcccctgacttcgacgccactaccgttccactcacatcaattcccggcaccattggatattggcgaatcacgccacccttgggcaaacttgccaagtaatctttgtagttcacacttgaaaaagccgtttgaatttgaatttcaccagctgataactcaggcaagtcacgctcgacaaaatcgccttgcacaacaccttcaatatcagtcatcatatatgccgttgttgtcatgtcgttatcccccaaaaactatttcttccaatatatcatgaatatgaaaaagccactgtcgcaaaaacgtcagtggcttgattcactaattttgtttacggaagcgggccgcaatagctgcttcgtccgggtgatagtaatgataacgagaaactggcagatatgcttcatctccaccaatttcaatctgttcaccttcatacaccggcttaccatcatgaatgcgtaaattcatcgtcgcctttttcgtgccaaatgaatcaagcgtcttcatttcttccaacttgtccgcaaaaatcaacaacgcctcagatcctggaaacaggtgatttgagaaatcatttttcaaaccaaacgccatcactgggatatccaaatcatccacgatatgcgctagttgcatgacttgttcacgcgtcataaattgcgcttcatcaatcaacacaatcgccggttgttcagcttgccccgcaaccatttcgaaaaggttgtccgtggcatgaataatgcccgcgtcctgcttaaggccaatgcgcgacgaaatttcaccgacattcgtgcggtcatctaatgctgaagtcaggagcatcggcttacgtccctgcacctcataattatgggccaccttcagaatttcaatcgattttcccgaagccatcgtgccgtatacaaacgttaattgcgtcatagcgtccaacctttcactctcaatgatgctgtgtcttcattaagtgtactagattagtcaactagtctattgcgcttgcgttgctgtaccagcagatgctgccattgttggcacaccgattgcggcaacatcttcatcagaaatcttaccagcatacaagttaccggtttcggctgcatccaagttcaatgaccggcgcaacacattcgtcgcacgttgctcttcttgacgtgacacaacttcagtagaccccgacgccaagtcgtgcccctgtccttgaatataatctgacttgatattctttgtggcatttaaatacttcgtgccaatcgttgtcatatcgccaaacgtcaaatcggtcttcacggacttagatagcgatgtcatgaatccgtccgttaacaattttgtgggattagccttggccttatcgacaactgtttccagcactaaacgttggcgttgttgacgaccataatcaccgcgcggatcatcgtaccgcatgcgtgagaaagctaatgcggccttaccatccatcttggtatacgtctttgttttgccgtcctcaccagtatgcgtaaatgtcgaactgtcctttacaaagctatacaaattcccaggtgttgcgtgtgcagtatctggattatagtcaaacgtgagcggtgacttcactttcacaccaccaatttcatcaacaacttgctccaagccacccatattaacgagtgcataatagtcaattggaatattcaaccaatcttgcaccgttttaatcgctgtcttggctgatcccaattcataagcggcgttaatcttttgcgggaaagtatcttcataaccaggcacagcaactaaagtatcacgcggaatcgacataatcgtcgtttcctctttttgcggattgatcgtcataatcatcagtgaatccgtgcgacccttgtcgttacgcccaagttcacccgtatcagttcccatcaacaaaacagaaaacggcttcccgtctcgaatcgttgcggatacatcacgcgactttttcatacccgcatcttgataagtcttgtcgaccaccgtcttggcacgcatcgacgcaaagcccacaacaccgaccaacgctaacagcacaacgactatccctgtaccaataacgcgtccccaacggatgttgcgacgcttactaacacgcaatcgctcacttctattctgctctgtcatgttcactaaactcctctacacaaagtaatatatgcttaagcatacggagaagttgtatctaacttgtatcgtaaaaaagcccgcaaaattgcggacctccttctagacaagtgtaattactaaactggcatttgatttcgcaaatcgataattaatgccccctacgaattgttgactaatttcaccatcagccaaactttcctgatgacgtaacgtcacgttgatgttgttgcgccaattttgcgcaattgtttgcaacggcaggttaacactgtcgccgaaccattgcagattcaaaatcaaattgttactagggacaaactcaaaatcgatttcatttgttttgctcatcgcactaacataataggttgtcacaacctcaccgttggttgagtgatatacccgtttttcaacatcaagtatctgcaaatcattaggaatgtcgccaattactggttccaggattcgctttaaatccacaccacccgcttcgtcaacatcacttttaaacttaatcggattggcgtattcggtcacaacagttaaggcctcagcattgcttaacggcatctgttgcttattaggtaagctgtacgacgtttgatgaggcgcttgctggctataatgattatcttgccagcgtacaaaaagttggagcatgccaattactaagaagaaaaagagaatcgccaagccgagcacaagccaattttgcttttgtttcatcgttcaatatcttgcgccggcacctgaatgctgacggtcactccttccccagaattattatttagggccacacgccaccccaaaaccgtactgattcttttgacaatcgacagtcctaagccaagatgatcatcttcaccgagctcgctatctgtcacgaatggttcaaaaacatcatcaacggcttgttcatctaatccatgaccattgtcagttattgtgattatcagtcccgtttcatccaagttctctgccaccacaattcgaccgccttgctgtggcaatgctttgacagcattatccagcagattgaccaacatttctgaaaacaagcccatatctgtatgcaaacgatagtcggcctgacttgcataatcaaattggaatccatgagctgtttgttgtcgaatgccaagcgcaatatctgtcaccttttcgtgcaacatcttgctgctaatgggttcgcgttgcaaagtcacgtggtcatattgaatcagctggctgatacggctaccaagttgctttagtcgcgtactttcatccacaatatagcgcaccgcctcttgcttcacctcttcagtgacgttcgattcagcgataagctcggcataacccaaaataatcgtcagcggcgtattaatttcgtgagtcaaatgactcgcaaactctttttgaaaagccgcattttcacgttcagatgccaccatcgcctgaatttgatgtgccatctgattaaaatcattgaccaattctgttaattcatcatgacgcattggcttcaaaggttgataacccattggatccgtctgaaacgaccgactagcctgacgtagttgatgaactgtcaccaagatttgcttcgttaagatataaataattgccgtcgacactaagaacagtaccaacaagttaacctgcacatcccgaagcaaccgattttgcgtggcataaacagaattcaaattcgtaaacgtactaatgtaatacgtcttacgtagtagctgaaccttaattgtcgctacgacatacttccgattaccatctagcaaatattgaatctgttgtttatcaccctctagcaatttcaaacgattagcttgcttaactgccatgtcctcatggtaaatcaacttttgcttcgcatcccaaatcaacacattatcttgcgtcgtgccgacgaacttaatgacttgggcttctttaatacctttatcttgttgataatccaactgttgcacttgtcgcgccgtctgcttattaaggaccgctgcacttgattccttttcttgcaggccactttcaaaactacgatgcaataccaacacactattgatcgatagtgacgccaccaaaataacaatgaaagcaatgaacaatttaatcgaaattttcatagcgtctccattcgataaccaacgcggaacactgtcgtaatccggtcagctaggtccaattttttacgaagtcgttgcacatgcaaatcgacagtgcgtgtatctaccatgtcatccgcaaagtcccagatattttcatacagtgtttcacgggccaaagtgaccccttgattccgcacgaaataaaccaacagttcaaattccttattggttaaatccaccaactcgccatttcgacgtactgtttgttgggtgacatcaattaccaaatcaccgtacttaataatctcatcggcatggccgtatacccgacgcatgaccgcttcggcacgactcttcagcacttccaagtggaatggctttgtgatgtagtcatccgcgcccagttgcaagccctgcacaacatccgctacctcagttttagccgtcaaaaagatgaccggtatttctttatccgtgatataaggcaaaacgtcatagccactcatcttaggcaacgtgatatccaataacactaagtcaatctttgtcgattgcaaggtcgcaacggcatcttcaccagtgaacgcttgtacgatagcatacgtattcatcaaactcattttgacaagctggttaattcgcacactgtcgtcgactattagaattgttcgcttcatgacaactgccttccttcactcattcgtaatgacagtctatcatacctcacgtttgtatctcagttgtatctcacgcacagaaaaagcgctcgatttctcgagcgcctgttatctttctagaagaataatccaatggtgtagtgaatggcaatcgttagcaaaccgatgaccacattacgcttaactgcccggctagcaaagccctttccaattaacgcactcaagtaacccgttagtgctaccgctaccgtcgttgctagaatggttgcccagaattgccagcgaactggtgaaaagtacaatgccaacaatgggaacgccccaccaatcgccgcacagaacaatgatgaaaaggctgcagcccaaggactgacataatggcccaattgcacattatatttcgtcgatagaatcgtttccaaaggtgacttggccatcaattcggtcgcgatttctgcagccgtcgcttcggaaaccccacggtccagatagaattgacgaatgtctgtcgccacaccatctggatcaacgcgcaaacgttgggtttcaaggtcaacgacgaccttttccgcgtccgcttgcgaactaactgacgcatactcaccagatgccatcgacaaagcacaagctaacaagtcagccaaaccagcaatcagaattgtgaactgattggttgtggcagcgccaaccgaaaatagtacaccaacaaccgttagaatgccgtcatttgagcccagtacaccggcacgaatcgcattcaaacgttcttccattgtttgatgtgtcttaacatttttcatggttgcacgctcctcctatcgaccaatcaacgttccaatgtagaacgtcacaatcattgtgaacacaccagcgacgacattacgtagcgtcgctttcttctcatttgccccagacaaatgcgctgctgaataacccgtaatcgccaacgcaatcaaaacggctactccagttgcggcaacgcgaatgtgtggtgggaataaagtaattgccaacattggcaacaatgatccaagcgggaacgagaccattgatgcaattgctgccccgacggctgacatttcatggtgcaacgtgaacccatatcgctcacgaaccgtcgtccccagcgcatccttttccatcatctcttgcgtcgccttgtttgctaggtgttcggaaataccttgtgcttcatacttcttttgtacgaacgcaaattcttcgtcatatcgattattcaatgcatcattttgcacggcttccgccttaatttgcgcatcgttttgcgagtgcacggaaacgtattctcccatcgccattgaaactgttccggctagcgcaccagcgaaaccggcgataaaaatagcgaatgagttcgtcgttgctccagcgacaccaataacaattccggaaactgataaaatgccatcattcgcccccatcacggatgcacgaatcaaattatttcgttgtgctaatgtttgtttatcctttgccatcttattcactttctaattcgttttaaaactaaaaagcgcctttgattatgtatcacacacaaccaaaagcgcttaaccttgcctaacgacgggcaatcaatgatgaaatcttagcgtgtcgcgcaatgtacaccgcttgtgatcccaatgatggccacataccttgctttgagtgcgcgccgacaatgagtaggtcagccttaatctcaggtgccaattccattgctagtacttcaccagctttagcaccatccgccaaaactgtctcgacatcagtcacaccttgctcgatagcgtatgccttatacgtttgcaagttcttttctaaatcttcacgacgcttattcacagctgacaagcttaagacgtctgttgttgaaagatccccaagttccaacacagtcgcaatcgtcaacttcgcttgatcttctagcgcctgatggacagcacttgctagtgcaacttgtccttgttctgattcatcaaccccaactaaaacatgttggtaggctgtttgaatatctgatagttccaaagccatttcattatcccccgaaaattaaagtaacttgcccacaatttgaattaccaattgaatgttcaaaccagtcaacaacaagaagaccaaccaggcgacaatcgtcatccactttgaaatgatgaactcttcacccataatcttctttgaactggtcatccaaatgagcggtgccatcgcaaatggcaaagcaactgacaagaagacttgtgagtacacaagcaattgatccagcttatcttcagcgccaccgtaaatcagtgtaaaggcaacaaccggaatcaaggccaagccacgtgtgatgacacgacgtagccacattggtacgcgcaagtgcaagaatccagccatgataatttcaccggtcaacgtacccgtgattgttgagttttgacctgaagccaacaacgcaacggcaaacaacgttgaaagaactggtgatgcaatcgcccccgcaatcgtcttatcacccaaagcgttgtacatttgaccaaacgtaccaactgaatctgcgtgtccgaagaacatcgcagcccccaaaatcaacaacattgagttaataacaaatgccattgaaagttggatgtttgaatcccaagccataaagcgaacagattcctttaactcttccttgttctcgcggttaaccttacgcgtttgggcgatagatgagtgcaaatacaagttgtgcggcataactgtcgcaccaataatacccagcgtcataaccaatggtgaatctgcgcccgcaataccatgtgtgttaacagcttgaatctttggcaagtaaccaccaaacattgctgcaatatcaggtcgagataggacaacaagatacaagaatacaaacaagattgtcataatcaacgtaataacaatcgcttcaatctttcggaacccaaaacgcatcaacaacaatagcaataaaacatcaaatgccgttgttaaaacagatacaatcattgaccaaccgaacaacaagtggagcgcgatggcaccaccgataacttcagcgatatcagtggccatcagtgccaactcagtaataatccatagcgcaataccgccacctttactggtacggtttcgtgttgcttgcgccaagtcttcaccagtaaccattcccatctttccagccatatactggagcatcatggcaatcaatgatgaaatcaacacaattgacaatagcaagtagtgatatgttgcaccacctgttactgacgttacccaattccccggatccatgtaaccaaccgccaccaaggcacctggtccagaaaacgcccagagcttacgccaaaaagaaccgttttttggcggcacaattgacccgttaacttctgccaagctggcatcgtctgcggcgttttgaatcaacccgttcttaccgtttgtcacattttccatgacaaaacctccaaattatcaatttggattgcggtctcagtactattcagttttacgcttatcgctaaatatttagtggtattcgtacgctaaatgctaaataaaagtcataaagaatttcgtccaacttggctgttgaaagcttatgacaataatttaaccgagagccactacaacccatctcctacaatttagcactgttttcaagtaataggaaaaacctcccctaaaaaagacacctccttacaataagcaaacaaaagtatacagctgtcaggaacatcctcctgttcagcggaataattgctgcaaaaagaaaagacgttcgatttctcgaacgtctttagcttattcaccgacttttagtacattagcaatcttgttcatctcagcttcctgaccagtattattggcaatgagttcattataggcatcccgcaaattaaaggttgtcataacactaccaggttcgcccttccattgatacgtcgcatcattagggttcgtaatagttggtgcattgtaaatcgtcacctcgtcaccattcattgaaaaagcttggtagttccaagcgccaccaccagcaacaaattcgctaacaaacacttgtcgtacaccactcgcagttctgtctggcattacatgaatcgttttcgaatgtccactatcaatatcatacggcaatggcaccccacccatggctgtgattggattttgcttcatgataatcacggcgtacttttgcttatcatttaattgatcatatgacgtggaaacggcagttgtactacttgtgtattgataatttttggctatctgtgttgtatcatagccaactaacctgtttaattccgcaactgcattcgcatcagaagttaccttgccaataacaccagaagcttgcgctagttctggtctttcacggaaagctgggcgaaacacagccgcattagaacctgctggcgcctcaaattcatagatgttaccgtcattagcaatcacgtacatcgcttccttgtaatccgtagtcatcgccacgtgaccacgatatccctcatagcctaacgtcaattcctgcgggcttacatatccagtcttattcgtaatgtttggtgtagataattctccatgaatttcagtatcatcccatttgtaaaagccaaatgtcgctaacgcctgcaagcctttgccatcattactctgattaataaacaaagggccgttaaccgtgtcaaagtaaatgccatcactgtttgtaattgttgccggaacccctaatctaacatgcagttccgaaccaactaaattcatctttgcagcttgatcacccacccaatggccgaaatttgacacttggtcatcggttaactgtaaatactgcggaacctcttcactcgtagccgattctttcacagaagattgacggcttaccgatttcactgatttacttttcttatttttgcttgagttatctgctttcgttttattttcagactgattctgacctcgtgattgcgcagtctggtaaccagcatatgcaccaccaacacccagtgccagcgcagcaatgatagttccagcaatcacactctttttgtgtttcatatcgcttatccttacactcactattctcagcaatttggacgactttcctatttttcattgtataacatgcaactaatacgttgcttactataggcttttactggataagttcagaaaacaaaaagaaaagacgttcgatttctcgaacgtcttacttgtaacccgaaggtctttagattatgccgtcggtgggggtcgaacccacactcccttgcgggaactggattttgagtcctgttggttggatgtcagttggtggtggtcaccacacggttttgtcattcaagatcacggccgagcaattgcaagatttggctaacatgttcaagttgacttacgtagacattaagggctaattgtattttcaaaacgtcttaaaaacttaaatcatctcaaaagttacaaagcaggagcgacgttcacaaaaacgtcgcttttgtgttttaaaaacatcgggtaaaatagctggtggagggactcacaatgtcagatttaacaacaaaagtaacccttgccgatggccgccaaatgccattgcaaggtcttggattatataaggttacagaccaagccgaattgacgaatgtcatgcaagcggcatgggagagtgggtatcgtctatttgatacggctcaaatgtatcaaaatgaaggaatgcttggtgcggcaatcaaggacctcgcgttgccacgcgaggaaatgtttatcacaactaaggtagcggaaagtaaccaaggttatgatgcgacgttggcatctgttgaaacgtcattgcgcgagttggacatggattatgttgatttgttgttggtacactggccattgcatcaacatttctttgaaacgtggcgcgcatttgagcgtttgaaggatgagggattggtgaagtcaatcggaacttcaaactatggtatggtgcacttgcaataccttgccacgcaagcaaatgagcaacctgttgtcaatcaagtggaaaaccacccacatttgacgcaagatgcgttgttgcaatatcacaaggataacaacattcaaacgcaagcgtgggcaccgcttggccgtgggtcagtcttggctgagtcggtgattgttgaaattgcggcaaagcacggcaagacgccagcacaaattgtattgcgctggcacgtgcaacgtggcacaagtatcattccaaagtcatcaaagccagaacgtgtcattgaaaatggtaacgtgtatgatttcgctttgactgatgaagaaatgacattaattacgaatttgaataagtttgagcgcattagccaagaaccagaacaggtttatgagcgtggcgcacaatacccacactaaaacgtacaaaaacagcggcactgctgagcttgatgatcaagtctcggcagtgccactgttttttgtttacgcttggcgattaaagcgcttatttaccagcttttcaaatttatcctcaaactcaggactccaacggctccaaactaggatgaaccaggcgatgatgaagccgactgtcagtacgaaagcgatgatatatgcaacaagagcgggtgtaccgaagcttttaaggactaacatgatcagtaaatagaagaatgggccggcgacaattaagccgagggtcatcgcgagggaatcttctcggtcgtgaatgatcgccgtggcttctttttgaccggtgatgacgagttcgatgaattctggcttggtgacaatgttaatgtcgccttgttcatctgcaggcaaggtttgcctaaatgccaaagcttgttcaatatgatcgccgaccgaataaggggcgacagtttcaccgaaggcagttggacttaagttaaatagttcgttgtaaggaacggttgccgtctgtgcctcggtataaatggttagcgtcgttgcgccttttttaacgagatagtacataacaaaatcctccgttacatagtacgctcatcctatttaacttcattatccagggcagggcgcgttgtttcaaattatttgctcaaaagaaaaagaagttcccgccattggtgagaacttcttttaatatttaatcaatgtggcgacttgaagagtcacgaacgattaggtcgcttgggtagtgaatgttttctaccttgttgccgttaataatgtttagcaacatgtttgcagcgtcacggcccattttgctttgtgggtgacgtacagttgttaggcttggtgtcatgtattgcgacatggcgtaatcgtcaaatccgacaatcgcaacatcttctggcacacgcaggccaagtgacttgaccagatcgatggtttgaatcgccaaagcgtcgttgtacagcgccaatgcggttggacgatcagccgcttcgaggtgcgcctcaatcttattcaaaatttgggcgttacttgcttcatcatttgattgatacatcacgatgttactgtgtagcgcgatggctgggtattgttgatatgccttgtagaagccttgcatacggtgcgcaccttgcacatcgtcgaccttgaacaccccaaggatgcgttcgtgaccttgattaatcaggtgagtaatcaaatcagcttcggcgtttgagtcgtcaacttccaagtaagggaaatcgaaatgctcatacgttgagttgataaacacggttgggatattcaactcgtgaatctgatcgtacaaatctttgttgggatttggtagggcagacatcgttggttcgataatcaatccgttaaccccagtttcaatcatacgcatcaaactttgacgctcgcgctcataagtgttgtgcgtgttactaatgaagagcgaatatccttcgtcagagataacacggtcaattccactgatgatctcagggaagatatagtcggctaggtgcgttgtgatcacaccaatcaccttgttgtcagttgcaacggctggcgctttattccagtcatcaacatacataccgccaccttgaacacggtataggaagtgttcttgttccaaatcactcgttgcgcgacggacggtgtagcggctcacgccatattgttcagttaagttggcttcggttggtagtttgtcgccgatggcgtacttaccagcgagaatatcatcgcgaagccctttcttaacgatatcgtattttgtatccatatgaattaaatcttatctttctgtctttatcgttctttcattatacaagggatcgtctgaatttgttagacgaatcagtgaattgttatgaaaagcgggatggttttgcgggttgtccgtacaaatgtaagcgcatccgatattaaggacagatatcactatttgaacattagttctgggaagtaaaaagatgatatctgtgtaaatgcacgtatataaaggttttctgctatatgcaacttacaattacattgtgaataaagtatcaaactttaagaaactgtgaactgttcgtgaaaaggtcttatttggggttgcgagttgtccgtacaagtgatttaataataatcgttaaagaaaagaaaacgctttcagataatttaggagttttacagatatgacagttagctacgaaaatccggttattatccaacgtgctgatccattcatttacaagcacacggacggttactactactttgttgcttcagtaccagcttacaacttgatcgagttgcgtcgcgccaagacgattgacggtttggcacatgcgatgccacgaacaatctggcgtaagcatgattcaggtactggtgaacaaagtgaattgatttgggcaccggagctgcactacacagatggtaagtggtatgtctactacgcagcatcacacacaacagcatttgatgaaaatgggatgttccaacaccgcatgttcgccattgagtgtgaagcggctgacccaatggaaactgaagataactgggttgaaaagggacaaatcgaaacccaccttgattcatttgcgttggacgcaacgtcattcgaattgaatgacaagttgtactacgtatgggcgcaaaaggatccagcaattaagggtaattcaaacttgtacattgctgaaatggaaaatccatggacgctgaagacagcaccggtcatgttgtcaaagccagaatttgattgggaaaccaagattttctgggtgaacgaaggaccagcaatcttgaagcgtaacggcaaggtgttcttgacgttctcaggatcagcaaccgatgaaaactatgcaatggggatgttgtggattgaagatgataaggatgtgcttgatgccactaactggcacaagctcgaccacccggtcttccaatctgacatggaaaacggtttgtacggaccagggcacaattcatttacggttgctgaagatggtgaaacagatttgttggtttaccacgtacgcaactacttggatatcaagggtgatcctttgtacgatccaaaccgccacacgatggtgcaaccattcgagtgggatgacaacggcttcccagtgttcggtaagccacaaccatttacttttaactaatacatgaaaactcagggggataatcatgagtcaagttgttaaggaaagcaagcatttttggggatttgctgcttcacactttagttacttctttatttgggccatcacatatggattcttgacgctttggttgggtcaagaagcaggtttgaccggagcacaatccggcgtggtcttctcattgatggcaggaatgtcattgctgttccaaccattgttcggaattatttctgacaagttggtcttcaaaaagacgctgttgattaccatcgcagtcgctggaatcttcattggaccttacttccaatgggccttcatgccaatcttggccattagcccagtgttggcatcaatcgtaacgggtgtggtcttggccttcatcttgaacggtggtgtgtcagttatcgagcaatacgtgcaacgtgcatcattggccaacaagtttgagtttggtcactcacgtatgggtggatctgttgccggagccgtatcagccttggttgctggtcgtttgttcttgtggcaaccaaatgcaatctggtgggcctgctcggcttcagctgttttgctaacaatgttgttgttgttctcaacgaagattaacttctcaaatgcagctgctgcaatgggaacttcaaacgaaaagttgacgaagaaggatatcttctcaatcttcaagttgcgtaacttctggattttggccctattctacatgggtgcctcagctttgttcgacgtgttcgaccaacaatttatcgtcttctttaagacattctttgagactgatgctcaaggaacgatgatgtactcatacatgaactcagcacaaacggttatcgaattgtgcttgatgattccaatgccatttatcatcaacaagattggtgcacgtaatggattgttgatttacggattcttgacgttcgttcgtatctttggatcagcgatggcaccatcatgggagtggatcgtattcttccgtttgcttgctggattcgaaatgcctttgctattggtttcaatcatgaagtacatctcaggtgccttcgacattcgtttgtacgcaacggtttacgctttggcatcaaactttgctaagcaaatttcagtctttatcttctcaactgtagccggatcaatgtacgacaagattggttaccaatcaacgtacttgatgatgtcagctgtggttttggttatcacgttggtagccgtattcttcttggaacgtgaaaagaaggttaacccagttgaagaagcagcgggtggaccggtcgagcaggtgaccgagccacaggcgtaactctaataaaaatgtaattgcgacagacgtttaagttataaaatagttatcccgattggcagcgatgccgattgggattttttaatttgtacggttaaaaattaacttacatataattcgtttaaaacaacagaaaactgattaaatcaacgttttgtagcgtttttcaaaaagaattatctgtgaatattgtgtatgttgtatgaattgtacggataacctattgaattgtccgtacaagtggtttaaactatttcatgtaaacgattacaaaagaaattaaattctcgtttgaggggaacggaatcaatgaataaagaacaaattcaaaatgaaatcatgaatggccaaacggctttggggatcgaatttggttcaacacgaatcaaggcggtgctagtcggaactgacttttcaacaattgcggtgggaagtcacgaatgggaaaacaagcttgaaaatggcgtttggacatactcactagaagacatctggtcaggtgtgcaagatgcctaccgcgatatggcggatcaagtaactgataagtacggtacggtcattcgtaacttgtcatcaattggttttgcagccatgatgcacggttacatggcgttcgataagggtggtaacttgttggtgccattccgcacgtggcgtaacgcaattactggtgaagccgctggtcaactaacagaattgtttgactttaacattccacaacgttggagcatcgcacacttgttccaagcaatcttgaatcaagaagcgcacgtgaaggatatcgacttcatgacaacgttggctggttatgtgcactggcaagtgactggtgaaaaggtgttgggtgttggggatgcatcaggtgtcttcccaatcgactcagacacagttgattacgatgaaacgatgttggcgcaattcgacgagttgaagtcagtgcaacaatatcactggcaattgcgtgacatcttgccaacggttaagacggctggtgaagttgctggtcgtttgaccgatgaaggtgctaagttgttggatccaagtggtttgcttgcaggtggggctatcgcggctgcacctgaaggagatgccggtaccggaatggtggcaacgaactcagttaagcaacgtacggccaatgtctcagctggaacgtcagcgtttgctatgatcgtcttggaaaaggcattgtcacaagcgcacgaagatatcgatatggtcacgacgccagatggatcagcggttgccatggttcacgccaataactgcacgtctgaaatcaacgcttgggcccgtgtcttcaagcaattctcacaagcaatcggtgttgagattagcacaaacgagttgtatggtgctttgttccgttcagtcttggatgctcgcccagatgcaggtggtttgctaagttacggttaccactcaggtgaaaacattacggcagttgatgaaggacgcccattgttcgtccgcacgccaaacgccgaattcaacctaccaaacttgatgcgcacgcacctatattcagcgttcggtgccgttaagattggcttggatatcttgaagcaagaagatgttgcgatggattcggttgttgcacaaggtggtatcttcaacacaccagttgtgggacaaaagattttggcagctgtgatggatgcaccagtcacgttgatgacaaacgctggtgaaggtggcccttggggaatggccgtcttgtcacaatacgtcacgatgcgcgaagctggcgaaaacctagctgatttcttggaggagcgtgtgtttgcgaaccaagaaagcgttacgatggcaccagatccagttgatgtaactggatttgaagaatttatggaccgttacaaggccggaattgcaattgaacgtgtggcaattaatgccatttcagatgagccagtatcagtggtcgctgagactgaggaggaagaagtatatgcttgagaatttgaagcgtcgtgtgtatgacgcaaacatggctttgccaaagcacgacttgattaagttcacttgggggaacgtgtcagaaatcgaccgtgaaagtggtttgtttgtcattaagccatcaggtgttgattacgaagatttgacaccagctgacatggttgttgtcgacttggacggtaacgtggttgaaggtgacttgaacccatcaagcgatacggaaacgcaccgtgtcttgtatcgtgatttcccagaaattggtggtatcgtgcacacacactcaccatgggctgtttcctttgcccaagcaggggtagatattccagcatgcggtacgacccatgcggatacattctacggggatattccggcaacgagtttgatgacggaacaagaaatcaacggcgaatacgagcttgaaacgggaaacgttatcgtcaaagcgtttgaagagcgttgcatcgatccagttgaagtgccagcagtgctggtacaagatcacggcccatttgtttggggcccaaacgccgccaaagcggtctacaactcagtcgtattggaagaagtcgcacaaatggcgtaccacacgatgatgttgaatccacacaatgtacacatgtcacaaacattgatggataagcactacttgcgtaagcacggtgcaaacgcatactacggacaaaacacggcgaagccggttgcaaattaaaattagcgaaattactttaggggattaatgattatgtttaacgaaaataactacaagttctggtttatcacgggttcacaattcttgtatggacctgaaacgttgcaagaagttgagtcaaacgccaagaagattgtggatggcttgaatgaatcaggtgtattgccatacccagttgaattcaagttggtagcaacgacctcagaaaacattgcggctgcaatgaaggaagcgaacttcgatgactcagttgctggtgtaattacgtggatgcacacgttctcaccagctaagaactggatccgtggtacgcaattgttgcaaaagccattgctgcacttggcaacgcaattcttgaacaacttgccatacgagacgattgacttcgattacatgaacacgaaccaatcagctcacggtgaccgcgagtacgccttcattaatgcccgtttgggtattaacaacaagatcatctcaggtcactgggaggatcaagaagttcgcgaagccgttgcaaactggatggacgtagcggttgcctacaacgaatcatttaagattaaggttgtgacattcggtgacaagatgcgtaacgtggctgttactgacggtgacaaggttgaagcacaaatcaagtttggttggacggttgattactgggctgtcggtgacttggtagaagcggttaacgccgttaaccctgacgacatcgacgctaagtacgctgaattggcttaccaagaatgcgtcaagaaaagaacaccttctgacgagagacaatgtgactaagaatagtcgcattgtctctttatttttgcactcgatacctgccacgttacggcgaaagagtagaacgcactcaggacaaagaagcctacatggagagtaggacggcacgtgaagggccttgctgtatgctccacagacagcgtaaacagagacgtggagaagagatagttaaccgtccaacacaatgggtagcggttaggtgtccgatcgcgggttgcgccgtgatgaagaaatatagcatgcggaaaagctgaacgagtaatcgttcgaagtcagtagtcctagcgttatgtcatgggttaaacagttaccatatgtcaaaaaacgccctgagaagctctcagaggcatttttaggtgtcagccatataaatagacacaagtagatataaaacaacgtcaaaacataaccaaaggttgtgaggggtagcttgaacataatctactgtgacataagtcagtcgttgcgagatgcactcaacgaaacacaccaattagccccaataaggggatagttggtggagtgtcgagagagagagccttgcaggctatccgaaacgactgattgagatattgttcaacatggtgtttaataaatgggtctttaaaaggcgtcagcatgtaaggggtccaggggcttgcccctgtgtctgccgaaggcttctaggtagccggtgtaaagaatacgcggggcacgaatgcatatggctttcacttctacgaacttgtccagcgtgtggtggatatcgttgaacagatccttggagttatttattgcgatagccagagtactatttatacttatattttgctgataattggagggattatgaacgagttaggaaatgaattacaatttgttcaactcgatgccgactgggttgaacttgctgaaaaggttcttgttaagcatggtatgagtgtagaagaatatcttactgctgcattgaaacgggtgtacttctctgacgcgctccccttctaccctgaattatcatatgatgaagaatttgattatcaaaatgaacatggcattgatctaacccatgatcaaaaattagcagattggtgggcagatactgccgaagattacgaataacaaactgttcaggtagggcttacactttgaacagtaataaatggacaggtgaacacatgactgaacacttatataaatctgtaaaagcacttgctgatgagttggggatatcgcgcacaacgctctataaacgggcaaagttaaatggtattgagttgactggtaattatactagtcaacaaattgaacagttaaaaactgttcaacctaaaatggacactgaacataaaaatgaacactttgctgaacagaatgaacacaaagatgaacacgttttccaatcagaaattcaaagattatcatctcaattgacggttaaagatgaacagattgctgaattaaaccagcaacttaagcaagcacagaaattagctgatcaagcacaacaattgcaacttaaagcgcagctgcaattggaatcggagcaacaaaaagtgttggcattggaaactgaattacagcaagaagaagttgggttagaagccagcaccaacggcgtcgagaataaaaaaggtttttggcgtcggatatttggataatgggtttttttactagataagatatagccattatttcattgccaccagtcagcgttttgctgacaatgcgcacttacacgtcatttaaaaatggacgtgagtgcttgcctgattttcgccagaatgcgcacttacaccccacacataaatctgttgggcgccgtgcttaaattttgtatcagaagttgctaccgcaacaacgcaactaaccgcccgttggttggtagaataaaacgctagggtgtgaccaaaaagaaggtcacaccctagcgttttatgatgatgactgctgcaattcggcagtcatcgactttaacctggttatttatcactccgctaatcagggagcggactactggatacctaatcttgattaactctgccgattaggaagcagactactcgatacctgattgatttatcactccgccaattcaggaagcggacaacttagctattagtagtatagcaacgattgttgatgtaataacaattattagctgttagggtgaggatttatatagcaaccgatagttaatttaatgaggttttttcagtcagaatattaacaaattatgcgttgattacggaagtaactgctcgttttttgatagaaaaaaatccagtcaccatcaaaaaaaaacagacagcgattggattttcttgtacatgtacctaaaatttgatgtttaaaattatactatatgtttctctaaatggctaattaagctggttctttttgaattggtctaaattgtgaaaaagcccgagactgacgtttgtgaaacgcattctcaggctttttttgagtttgtgaatgggggttgctgcacaaagtgctgtaaaccgcgccacgacaggcactgtgtataatcgatgttatgttaactccctttggtatagctatgatatgtattaataagacttattatttttattattttaattaaagtagtattttctatattaggaacagtgttaatttttttaaatatttaattataggaggaatgacgtatgatttggtcattaatcgttggggcagtaattggggcagttgcaggtgctttaacaaaccgtggagattctatgggatggatcagtaatattttagctggtctgattggttcttcaattggacaaggtattttgggacattggggccctagcttagctggaatggcaattttcccatcaattattggagcagttattttagttttgatcgtgtctgcaatctttggtattaaggcaaaaaagtagcattatatcgtactgagggggcatgctatgaagagattgtacaaggtgttacttgttattattcttctaatttacttaattagtatctctacgataatctggcccgatataattaccaaaatactttcgtttttagatcatattaatttacacagttcgctaagcgagcaaatgttacttagatataatgagctatttattctaggattaactagtgtaattttaattgttgtaatagcgttgcctcggcaaagaaagtctattttgttaattaactcagggaaaggtacactatctttgggaaatgaaggaatcagcagttttattaagacacagttatccggcgaaggattaagtaatattcaagtcaatatcaaaaacactaaacatattaagcgtttcaacgttaccgccgattctgaatataaaaaatcaattatatctgatttgccacgagtagaaaaaaacttaactgatagcttgagaaacttactatctggggttgataaatcacctattcgagtaaatataaaggtaaatcaatctaataagcgtaataataaagcatcgcgagttatttaattttaggagtttatcgagtatggatcgtaaacagacagtagtttttttaagtagcttaattggttttgtaattactattttattaattcaatttggctttataaaaacgatactagtagtttttataacaggaatgttcggtttattaggccttttgtttgataataatcgtatccaattaagtaaactgttacatgacatttttaataaataatgcggggggataaatttatgactacggaaaataagacagtaacacaggagactgtagcaactaaaggacaattgacgtttgatgataaagtaatccaaaagattgttggttatgcaattgaaaatgtatcaggattgctaggcgtagatggcggctttgtagctaatattaagaataaaatcgttaatagtgataatccaactgatggaattaatgtagaggttggtaaagagcaagtagctgttgatttgaatattgtgatggagtttggccataacgcacatgatgtctataaagaaatcagtaaggttgtagcaaaacagatagaagaagcaacaagtcttactctagtggagctgaatgttaaagtgatcgatattcagacaaaatcagaattcgaagaatcacaagtaaccatacaggatcgtgtaaccgatgctggaaaatcagttcaagataaagccacggcaggaattgataaggtgaaatctgttaccgattcagatgatgctcgagtacaataactacacatgttatcttaatagggaagaaggtcattgattaatggttaacactatattaaaagtcgctgctgtaacatcacttgtattgggtggtattgttgttgcagcaacagtttttacggcaaaagaaattgataaggctggtgataagctagccgataaactttataattaaaataaaaaatgaacgacagtattatcgttcattttttattttaattataaagttttattacataatattttcaaaatacgctggtaaaagtgcagaatgaaaaaataaacacttgcaagtattcgttttgctggttaaagttaaatcaataactaatcaaatataaaagaaaaggcacctatcgagtttcgaccctcgataggtgccagtgcaaagaatgttacgaccattcagagcacgttgtcattcaatatgtaagtacattatagggtacttaccaaggtggtgtaaggctcaaacgaagtttgatttacaaattatgattcagttttgagagagctaaattttctcaattaaatagcgtgtcgtgatgatggcattgaggtcacacctgttcccataccgaacacagaagttaagctcaatagcgccgaaagtagttggaggatcgcttcctgcgaggataggacgtcgcgatgcaacgtaaatcgtaccagaaatggtgcggtttttttgtgcctattggcggtataatgccgttaaaccatgcaaagggggaatgagtatgagctttgacattgttttgatacggggaaattcagccagtggcaagtcgacggttgcgaaagcactacagctagttttaccgaatacaatgctgatttcacaagatgaaatacggcgcaatatgttacgcgagtctgaccgggacggttcagatacgatgcgtgttattgagctgttggtggcagcggcgaaggagatgaatcgtttagttattctagacggcattttcagacaagatacttatggtgattggctggtgcaattgtttgagacgtatagtggcacagcgtggtatttgaatatctcattggcagcgactaaggttaggcatgccggcagagcgcaaagcaaagactttggtgatgaacatctagaagcgtggtatcggccacatgatacaatcgatgcactgaatgaatatcttgtccccgaaacatggacgaaagacgacacagttaaatcaattttacgtacactatctgaataaataagaatcgtaattcagaaaaggtcccgcatcgctatatgtgatgcgggacctttttaactaatttggataagttaatgttttcaacgtcttgttattagaatcaaccacttggatagttaagcttggatttttggtgcccgcatcggtcattgagcgaagtactttgtttgccaattggttaacttgatcaccattagttgcaagcgccatattaatcattgatggcgaaagcttatcagaagtgactgtcaatgtgactgcgtcgttttttgcgacggcatttgtatccgtgaacagacctcttgagctttgcttcaagttaaaggcctcgttgttcaattgaaccgcgacttgatccggtgtcattggtgctacgtcaacgtttttaagttttacacctgtagttaatgtaccatccttaatgggtagcatttctgttacgcggcgctcaacaaagtggcgttctaactgaatagcgccaaagataatgatgcctagtagcagaactattccgatagctattttccaaccctttttcatgtgttttcctcctaaaactgtacacaaccactatactgctattttatgcaaatggcttaaattttgaaatgagatagtttcccaacacgagcagtatgttcgccaagacaaagagtctcagactaaccattagaagtgcctgttggtcaaaaccgatagtggccatatagctaaatctaattaaccaggtagtgggaataaaaaacatcgtgtaatcaaacaatgcggtttcagctattagtgcgatcacagcagcacctgtcatgattaaataggcaatcggcgcattaaaattccgcgatagtatataagtgatttgagctaccattagcaagttgagtattaatagtattggtaaccaacttatggatatatgcgtcatatgaacgaggatgtcataactaataagcgcaagtatgctatgaagcatccaatgggtaagaacttgcatttcaccccatgcaaagtaggcatttcgcagatgagtagtaatcataaagtttccagccaagcggtcacactgtactgtttgaataattgagatgctcattaacactggactgaataaccccatgaatagtttgacgaggacgacaaactgaccgggttgttgtaggcgtggtaagtaaagggcgagtgccaaagttgccataagataactgagtagcacggctggtagtaatctttttcgatgtttgataaattcaacgcctacaattttacttgtcatgtgtttgcctccttgtatataagtacaagatgctttctagcaccgcaaccatgacaaacgttgtgatgattgctggcccaataaggttattactgtaataatctatagccatgccgtttggattgacgccagccagatgcgcaatgttataagttgcaatcgaccatggggtaggtagcgtacttaaacccgatattagtaaagataacactgctaaaacggcaataatattaggcaggttgataattagcaaatagatcactggtaataaccataatgcgaatagtgctataaataacattggtagcagaatcccctggtagaggttgagattggacaagccgtatgtaaaggttaaaaatgcaagggataaaacttcgtagagagccaaacctttaaggaataaccagtacagattcaatactagggcgcgatagtagtttggaatatcgatgactgactgacgcacattaaagaaattaccggcgttttgttcttgcctagctttttcaaacgctaacacaactaggccgatatatagccagatggttacaaagttattttggaaagtcgccagacagacgttgtttgccagagacgcgggcaacaaccagatgcttgtgaacccagcagcaataacatcggtagcgatgaccacccaattgatatgactatggcgcagcttcaagtattccatggatagataatgattcatgatgctatggtgcctcctttagttattatgctcacggtagatagccgtgagttcttcaggagtgtagtggccactattcgacgtgtaagttatttcaccatgcttcagaatagcaaaagcatcaaatacagttgccagttcggtaatctgatgcgtcgttatcataatggtcatgccatcagcagccagggactgtacaatcgacttgaagtcatcaacaccggccatatccaaaccattagtcggctcatcaagaattagaaactgtgggttatggataatagccatggcgatacccaaacgctgcttcattcccagtgagaagttctttacctttagtttgtcattaacatcggctagaccgactgtttgaagtgttttgttaatcgactcagctggtaggttgtataagagcaccatgattcgtagattttcgtgcgcggttaagttagggtaaatggcgggtagttcgattagagcgccgaagttcttagcttgatcacgtgatagtggctgattgtcataagtcattgatcctgagaaatgtttattaaggccgagaatggtttttaataaggtcgtcttaccagcaccattgtcacccaataggccaaagatgctaccggctggaatattcagtgagacgtcacgaagtattcgttggtggcgatgctgcacagataagttttctatcagtaaggtattgctcatattgttactccctaaaatgtaaatcactgcttgattatgggggtgctccctaaaatccaagacggttaccgtaagcatactgctttaaaattaactgagtgtatgcattattgaacgtatcattaactcttctatataaaagatggatacttaatcaatcaaacattgtcatagtccggttaatagtagatttgactggtacgttggcgaaacatttggtaggatataaatactgttttaggtattgcgtcaattctttaaaaggggtaatatattcaagttgtcttttgaagaaagcaaccccaaaaaagatgttcaacaaagttgttgacattcagtaaaacgttctgtattatatattaagtcgtctcagagatatgaattatctatgaacgacgtatgaaaattgattgaaattagttgttgacttttcattctttcttctgtaatatagattaagtcgtcagggcgacgacgtaggtcattgaaaactgaatatcgtttcgatgaaacaaatgtgtagggtcatcaagctaagcgtggtgtaaggctcaaacgaagtttgatttacaaattatgattcagttttgagagagctaaattttctcaattaaatagcgtgtcgtgatgatggcattgaggtcacacctgttcccataccgaacacagaagttaagctcaatagcgccgaaagtagttggaggatcgcttcctgcgaggataggacgtcgcgatgcaacatgaaccgtaccagagatggtgcggttttctttttgtacataaaaatgataagctagttttacatacaaatataaaaagagaagaaaaaacatgagtaagattgatttgaaaaatgccattgattatcgtaatttaggtgatgattttaaaggcatgaccaacgatgatattatgcaggccttggatcaacgtcgtggttacatgattactgcacttcagaatttaacccacgatttcaataaagcgacagctgtacgtaaccataacgcattttctggtcgtgaaatcgtctttttgaatccagaaaacccaatggatcctgaaaatgaagagggtgcaaagaagtggaataaaaccggtgcggttggcgcccaacactacgagcacattaagcaccgtaagattacggattatcaagccttgtttgatgaatggcatgctgagggatacacaatttatgccgttgataacacgccaggttatgaactacacaatgtctttgagactgagttccctgagaagagtgtctttttgtttggtgaggaacaaattggattggctgatgaattgattcaagctgcggataagatgatttatattcctcagactggatcggtgcgttcgctcaatgtatcagtggcgcatggtatcattgcagcgctttataccgcacaacatccagtacctgaaaactaatctatgtttaagtgtcgattgttgaagtcggcactttttttgtatctttgatagacttgttcttagatactaaatatgggggacgttatgaaaccagtagaagaagcgtattggaaccagttcaaggaagaacacaacctgccaaatgcggtattcggtagtgcatgggcgtttggggcgtcaaagtcacaagctgatgagcttgcacagttgacgttggccggagaaaaaacggcgacagctagtgcatatgagttgtatcaattagaaggggagccgattccaatggctaactcttgttacgatatcctattggacggtagtggcaatccagtagcagtgctatgcacaaaggaagtgtcagtagtgccttatcacaaggtagacagtgcacatgcctatgcagagggtgaaggtgacaagtcacttgaaacgtggcgccgtacgcatgaagaatttttccaacgtgaatttgcggaggttggtgaaaacgtcgatttcagtcggttgcacgttgtattggaaaagtttgaagttgtctatgcgttgccattagctgcttaaccatgaaatgaaaaaagtgatcacaggctcgtttctgtgatcactttttattttggcgcaacctcaacttccaaaacagtatttaaccggtctggcgcaatgcgacgcgcatcattaaggtaatattcagtatgattctgagaagttcgggttagttgattctcatttagaaacatctcaatatggtcaaatgatatttgctcatcgtcataaggaccaacgtgcaacatttgaaccacacgcttctcaggtaacttaacaatattaactttatcaattaacttagcttttcctgctgatttagcgtccaatagtattttttcggcaagtgcaattggtacaaagtctggaataagcatgcgtagtctgaatacgaagtcgtctttggtccaggcgccacgttctacggcaacgcggctgattgtccaatcacctaatagcggaggcactgtgtagtcagtgtagataccatgaactgatggatcagctttcttgaaggccatcttggtcggatacgcgacgctatataaggctgcgatgtaatcaggaaacaatgcgtcgttaggatttcctttaccgtgaatttcaaaataagaatggctaggaaccacaacttgtttagggcgcttagttgaattgaactcaaccgtggccatttttttaaaatcgtatttcataaggctaacccataataaaatcgtaaatttgattcttagcagccaagttgcgtgtaagtggccaaattggataggcgtgtggcaagccggtaccttcaatgtaggtcacgttgtctgcgaattttttggcaaaaatacggttgtccgggtttgttaagtcgcgggtaccactgattaaaagaatcttttggttatcaaagttgccgttgataggagagacaatcgggtcgccgatatcatgtgtgccacgaatagcttctatcaaatccggcatggcgtttaatgacaaaacaggatcgtgctttgcggcatccacaatatctggattagctaacgtcatatcaaccattgggctgattgcgacgatacgctcaataggaaatgcctccatgagctgcacgtatccaagtgcaatttgtgcgcccgcagagtcaccaactaaaacaacctcacaaccgtcataggtatgacgcaagcgccagatagcttggtgaacgcgttcatagatttcatcgagtgttgcatgtggtaccagtgggtaatccaacacggcacacggaatatccgtattacgaactaagtcaccaatgaaatgccagtggtaggcagttattggctcgataaaaccaccaccgtgtaagtaaagcatgatagtagtgggtttatgaagattaaaattcttaggtactagaatctccatgtactcttcagatacaacttcgaattcgtgacgcaatttcgtgctaggctcagcagctgtggcaggtttacttgctaactcttcccatagttctataccagaaagttgccagacgtgattaagcccaaggatacggctaccaaatacaaaaagttgacgatacatagactttcctcctttcgagtgagttctcagtatcgccattgtagcaactggacgtgatgaaattgcgtaaaaaaataccccagtaagtgaatactggggtagaagactatagtagcaattcgaattcaaggttattgtattggtcacgttcgcggatttggcggtaaccgaattcttgctcttcacgaacgagtagatcggtgtgccaagtaatcttgtcagcgaagctagcaaacatttcttccttgagttggttaactagggataggaacttggttgcttcatcggcagtcattgatgcgtatagacgttcgtcgttaccgtacttctttgagttacgcttcaacatcacgttcatcacttgacgtgtgtaggcagggttacggttcaaacggacactaacgttaatgtggttgtagtggaagtcgcgactgtattgtagcaacattgctagaaattcagcagcatccaccttttctggtttgtttgccatgtatgtttaattccttaatttgttttattactgtctactagtatagcacgacttaaatttgaactgagaaaatgtttctgttaaacaaaggggttgcgctaattaaataaaaggggtaatatattcaagttgtcttttgaagaaagcaaccccaaaaaagatctctcaaaactgaatcataatttgtaaatcaaacttcgtttgagccttacaccacgttttcaacttggttaagtcctcgaaccattagtactagtccgctccatgcgtcgccgcacttccacttctagcctatctacctcatcatctctgaggggtcttacttcataaagaatgggaaatctcatctcgaggcgagtttcacacttagatgctttcagcgtttatctcatccgtacatagctactcagcgatgctcctggcggaacaactgatacaccagaggtacgtccaccccggtcctctcgtactaagggcagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttgtccgttgagcgatggcccttccatgcggaaccaccggatcactaagccctactttcgtacctgctcgactggtaagtctcacagtcaagctcccttgtgcctttacactctgcgaatgatttccaaccattctgagggaacctttgggcgcctccgttaccttttaggaggcgaccgccccagtcaaactgcctgccagacactgtcttccaccacgcttagtggtgcgagttagagtggtcatacaacgagggtagtatcccaatgacgcctccaccgaaactagcgtcccggtatctacggctcctacctatgctgtacaagctgcacaaacactcaatatcaagctacagtaaagctccatggggtctttccgtcctgtcgcgggtaacccgcatcttcacgggtatttaaatttcaccgagtctctcgttgagacagtgcccagatcgttacgcctttcgtgcgggtcggaacttacccgacaaggaatttcgctaccttaggaccgttatagttacggccgccgtttactggggcttcaattcgtaccttcgccgaagctaagcactccttttaaccttccagcaccgggcaggcgtcagcccctatacgtcatcttacgattttgcagaaacctgtgtttttgataaacagtcgcctgggcctattcactgcggctcagctttcgctgagcaccccttctcccgaagttacggggtcattttgccgagttccttaacgagagttcactcgctcaccttaggatgctctcctcgactacctgtgtcggtttgcggtacgggcaggtaaacactaactagaagcttttctcggcagcgtgacatcacggacttccctactttatttcggtcctcatcataacttgtccttaaaagataaagcatttaactcgatctaagacttattatttaacccagcatatccagcagctgggatccgttagccttctgcgtccctccatcgttcaaacatgttcacctggtacaggaatctcaacctgttatccatcgactacgcctctcggcctcgccttaggtcccgactaaccctgggaggacgagccttccccaggaaaccttagtcatacggtggacaggattctcacctgtctttcgctactcataccggcattctcacttctaagcgctccaccagtcctcacggtctgacttcatcgcccttagaacgctctcctatcgcgccacttacgtggcacccgtagtttcggtggtgtgtttagccccggtacattttcggcgcagaatcactcgactagtgagctattacgcactctttaaatggtggctgcttctaagccaacatcctagttgtctatgcaactccacatccttttccacttaacacacacttagggaccttaactgacgatctgggctgttcccctttcgacaatggatcttatcactcactgtctgactcccggacatacgtgattggcattcggagtttatcttaatttggtaacccgagatgggccccgcaccaaaacagtgctctacctccaacacgctacattccgaggctagccctaaagctatttcggagagaaccagctatctccaagttcgattggaatttcaccgctacccacacctcatcccagcatttttcaacatgcacgggttcgggcctccagtgcgttttaccgcaccttcaccctggacatgggtaggtcacctggtttcgggtctacaacaacatactaattcgcccatttcagactcgctttcgctacggctccggtctttccaccttaaccttgcatggtatcgtaactcgccggttcattctacaaaaggcacgctatcacccattaacgggctctaacttcttgtaggcacatggtttcaggaactttttcactccccttccggggtgcttttcacctttccctcacggtactggttcactatcggtcactagggagtatttagccttgcgagatggtcctcgcggattccgaccggatttcacgtgtccggccgtactcaggatcctgacgggaggtcaacacttttcgcatacggggctatcaccctgtctcgctcagcttcccagctgattctgctaaatgttaactttgtaactccacaatgtcagtcctacaaccccaaagtgcaagcactttggtttgggctctaccgatttcgctcgccgctactgacggtatcgatttttctttctattcctgttgctaatgagatgtttcagttcacaacgtctaccttcaacctaactatatattcattaggtgataacttgcataacaagttgggttcccccattcggaaatctccggatcaaagcttacttacagctccccgaagcatatcggtgttagtcccgtccttcatcggctcctagtgccaaggcatccaccatgcgcccttaataacttaacctatcaactcttaccaagaatgcgtcaagaaaagaacaccttctgacgagagacaatgtgactaggaatagctgcattgtctctcgttatttttttgcactcgaaacccaccacgttacggtgacagagtagaacgcactcaggacaaagaagcctacacggaaagtaggacggcacgtgaagagccttgctgtacgctccacagacagcaaaaacagagacgtggagaagagatagttaaccgtccaacgcaatgggtagcagttaggtgtccgatcacgggttgcgccgtggtgaagaaatatagcatgcggataagctgaacgagtaatcgttcgaagtcagtagtcccagtatcgtgtatcgggttaaacagttaccgtatatcaaaaaaacgccctgagaagctcttagaggcgtttttaggtgtcagcaagataaatagacaccgccagatataaaacaacgtcaaagcacggacaagggttgtgaggggtagcttgaacataatctactgtgatagaaatatcagtcgttgcgagatgcactcaacgaaacacaccgattagccccattaaggggatagttggtggagtgtcgagagagagagccttgcaggctatccgcaatgacttgattggtatattgttcaacatgttgtttaataaaggatttaaaaggcgtcagcatgcaggggtccaggggcttgcccctgtgtctgccgaaggctccaattagccggtggaaataggagacggggtaggcatgaatttggctttcacttttgccaaatttgtccagcgagcgtaggggtctttttagcggctaattagtattagatcgataaaaaaattccttgggcatctgtcagtgttttttctgacaagcgcacttacacatcactttaaaaagtgatgaaattgctcccctgattgcatcagaatgcgcacttacacacaacccaattgttgggctgtatttgtgcttaaaatttgtattagaagttgctacagcaacaaatgttttaaatgataaaatgtttatttgtctagggttattttatatgtattaaggagatagtatgaattacaacaaaaaatttaattggataatttttttgctaacgcttattgtattgttgttgttttccccttttatcgtgggaggactggcagtcactttttcaggagtatcttcaacaactggggaatcgaattcacaaattgctgtagatttgttaggcggcatatgtgtactaatagttttgatttgggcaattcgtaagactattcgaaaagaaatgacttataaattggcatatacactcggaggtggactttggttaataggagttgtaactggaatggccagagatggtatttttagattttttaatctagggatgatgattgtagttattacagcacttgtttgggctattcgaacattacttaataaagattgatatcaaattatgtttcggatatagctttaaaattaataaccgcccattggttggtagaaacacaaaaaggtttagtgaatattcactaaacctttttgtgttgtgtaagagtaacttataagcatagatatgatctataggttacaactaatatatcatgttctgattaaagtgaactaaattagctcctgatatgacttaatttgacgggtaattattggtgacaacaaaaagctagtcgctgtccacttttgtggccggtaactagctttttgttaaaagacacacataaaatgaatctctggagattcttatattatagcgctatatttcagattgactagtttaacgatcaatctctgagctaaattggtctaaattgtgaaaaaagcccgaaaatgacgtttgtgaaacgcattctcgggctgttttagcgtttgtgaatgggggttgctgcacaaggtgcgccaaaccgcgtcagatcaacgacttgggataatgcacgttatgttaactcactttggtctagctgacgttgattttttcatattttttaatgaatataagttgtgatggtttggattataaaaatttgtcatttaaaaagagcaattctccttttagatgactgtcacggtctattttattctgtatatcctcagtcagtacaaaaaattgttcaagggtgtaattgtcatatccagcgtcattgttatagaactcaattattccatatttaagtaatgtatttattcttatatcttccatgtatatacgacacggataaggataggcatgcattactttagaaattaactcttgataacgataatcgtgaagcatttttgtttgcgtttttattaattttcttttcttgaaaaaggtacagcagtgtttgtataagggatttaagatagtagatatcactgattttataacgcctagtttatttgtttggaatattgataaaattgtattttttatcaattgataatcgttattgttacacatatttataccttcatgaatgtgattgttaaattaaatggttgcataatggcaggattatagttaaatttaaatcaataactaatagaatataaaagaaaaggcgcttatcaagccggcaagcaagataagcgccagtgcaaagaatggtggttcattcagagcacgttgtcattcaatatgtaagtacattatagggtacttaccaagttgaaaactgaatatcgtttcgatgaaacaaatgtgtagggtcatcaagctaagcttgatgcaaaaacatttgcgaagtcaattcgctagtaaattcgtttaacttctgttaaacaacaaaaattgagttatactcaaacttcaaattgagagtttgatcctggctcaggatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatgacaaccgcatggttgttatttaaaagatggttctgctatcactaagagatggtcccgcggtgcattagctagttggtaaggtaatggcttaccaaggcgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttccctttggggacaaggtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaaaatcggaaacctacacattcgttgaaacgatattcagttttgagcatggggttttcttatgttctcgaaagaaattcaaattgaagcagtatcgatgtatctcaaaggtgttccgcccgttgaaatacggagaaaattcggaatcaaagctcattcgactcttgaaatctgggtgaaatcaatcaaacaggatggtatttatggaatcaaagattcccacagaaacaagacaagttatccgtattcctttaaaatcaaggtaattaattggcgactgaatcacaacgcgtcgtatcccataacggctagaaagtttaggataacaagtccatctttaatttggcattgggaacgtgcgctagagtctggtcggctaaaacctgataaacgaaggcggaaacgaactatgaataagcaagaacacgacaagatcaagaagctcgaagaagagaatgaactacttcgaattaaggtagcctacttggaaaaactcgaggccttagctcaggaaaagaagaaattacaaaccaagacaaagcggtagtaatcactgtgctaaggcaagagttgaagtgcaagttgaagctgcttcttcaagtagccgagatgtctagcagtagttatcatgacgcgtgcaagcgtgcgtacaaggagtatccacgtgagctaattgatgcgattatatcaattcgtgatgacaacccggactacggttaccgtcgtgtcacacaagagcttcgtaatcgtggcttcaacaccaaccataaggttgtgctgaaaattatgaagatgaacgggcttctctgtactgctttcaaccgtctgacacggaagtacaattcttacgccggcactgtcggacatatctcaccgaatcgtgtaaaccgtcggttcacaacggatcgaccatatcagaaggttctcaccgacgtcactgaagtccgttggggatcaggcacgatggctgaacgtgcttatttcaccgcctatattgatgtttatagtggtgagattctcacttggaatatcgatcttcatccaactgtcgagttcgtcacaaagccattagatgagcttctacaaaataggccagaattgaattatcgaatgacaattcactctgaccaaggtttccaatatcaaaattatgagtatgtatcacggctaaagactaaccgtgtgttccagagcatgagtcgcaaagcgacatgcctagataacgcaatggctgagagtatcttccacatcttgaaggtaggaacggtacataacaaccattatcaaagttatgacgaattaaagtccgccataactaactatgtctattactacaacaataagcggataaaaacaaaactggccggaagaactccggttcaataccgaaatctttccgaccagttagccgcttaaacgtcactccaattttcggggttcagttcattttttagtgagacactagttttaactttccgttcccacgaaagtttttctaaattatctttcctattttctatatcttggacgattccataatcagtgtttaacgtgccgctttgttcaaatctgtttgccatactctatccctccaatactttgtcaaaaattatacttaatgacttaataaactcacgtttattcttatctatcctatcagtatctgaaaattcaaatactgactttttttctagcatagctgaatttaccatttctttctctggcacaatgcctaatagatcagaaaattgggatatttgctcaacaaattctcgtgaactcgctgtattatgcttaacacggtttcctaaaaatagtaaatctgctattacatacgacttaccagtcattggatcaacaacttcctgttttaaggcgctgatactatttaacaccttttggtggctatcatatccaaatctacttggctcaattggcgatataattaaatctgccacagcaacaccattcttagttagtaaattccatgctggtggcaaatcaataatgacataatcgtaaagttcatttaatttcgtcatattttgaacaaaccacatgaacagtaataattccttattcgccttagttaccaataaatcggtaatcaaatcaagactttgatgtgaaggtataatatcgatccctttttcaacattagtttgaattaagccaatgttaggatcatttaacaaatcaaccattgtcttagaatcagaaaacttttgtgaattagtaatgaacgtatctgttaaacttttttgagaatctaagtcgatcaataacacatttttattatttaattgagcgtactttgcaagttggtaagccatagtggttttaccaactcccccttttatagccataaaactaataattttcatatcattcctaccttagcaataccttggtaatactttcttgctacttatataataacaaaaaaacctccacctagcaatgtctttatgctactaaggtaataccttcgaatgaccttaacactaccttggtagcaacatggaaataccaaggtggcactggctatcgcagcagatgactacaagtatctaatcaacgctatccaacgctcgctggacaaatttgcataagtgaaagccattttagtttgaatcacgcttgtaatgtacaccggctaattagtagccttcggcagacacaag
